United States Patent 7,482,117 (GENETIC POLYMORPHISMS ASSOCIATED WITH MYOCARDIAL INFARCTION, METHODS OF DETECTION AND USES THEREOF) - sequence listing, part 4

SEQ ID NO: 17606 - DNA, 510510 bp, Homo sapiens
tgttttctataaggataaagccttaacctcgaaacaagattgatacggcccttttttcaaatgcacacttcagctctactaaactttcttctccttccttgtccacaccccgactcctctcatcttgcctattgttgccccacacacgtctccaccttccggaatcatttttgattcatgcttcagatcttagatctctgagaagttccctgggttttgtgcaccactctctgccccactaactttgatgcccttccagtggtgtgctgaagccggctggtacaggctctcgaagccgactgtgcatatcacttcccagctccagtgttgcatgacatcactttggcatctggaaattggccatgatggaagtattgatagcatggaaatcaacaaatggtacaaatgagggttttattaaaaaaaaacaacaacttgttggtaagcatttacaagcacaccaccatgcccctcttatattttcataacactctgagcactgtgtatttcttcatttgttcagtgaatatttactgactgtgtattatgtgccaggcactgccctctatactgaggatataaatgtgggtaaataatatcgttcttgccataatggagcttagagttaaaaggcggagactgcccttagtcaagtaagtaagtaaataaataaatattcagtgataattacgttaagaactaaaaatgctttcaaaatatataatagggtatttgacctcatctaggaaggttttcctgagctaaaatctgaaggacaattttgagttgaggaaggaacaaggtgagggaacagcattccaggccaagggaaccgcatgtgctatggttggagggagcatgcctcctaggagcaaggagataagacaagtttggctagaagggagtcagagagtttcgtgtgagatgcagctgaagagttaaccaggaagcaagccatgcagagttttgtaggccctactaaggagttttgtcctatcctaaaagcagtgaagtgttttttgttttcttttcttcaacttttaagttcaggggtacccattactgggtatatacccaaaagaatataaaccattctattataaagatacatgcacrcatatgttcattgcagcagtattcacaatagcaaagacatggaatcaacccaaatgtccatcaatgatagaccagataaagaatatgtggtacatatacaccatggagtactatgcagccataaaagggaatgagatcatgtcctttgcagggacatggagctcctttaggagctcttgaaaggcaggcctggtggtgatgaattcccttagcatatgcttgtctgaaaaggatcttatttctccttcacttatgaagcttagtttggctggatataaaattctgtattgagaattcttttctttaagaatgttgaatattggcccccaatctcttctggcttgtagggtttccactgataggtccaccgttagtctgatgggtttcactttgtaagtaacttggcccttctttctgagtgcctttaacattttttctttcatttaggccttggagaatctgatgattaggtgtctttggattgatcttcttgtggagtatcttactgcagttctctggatttcctgaatttgaatgttggcctgtcttgctaggttggagaagttctcctggatgatatcctgaactatgtttttcaacttggtttcatcctctttgtctctttcaggtaccccaatcagttgtaggttcagtctttttacataatcccatattcttggatgttttgttcattcttttttattcttttttgctctattcttgtctgctggtcttatttcagaaagatagtcttcaagctctgagattctttccgccacttggtctattctgctattgatacttgtgattgcattgtgaagctcttgtgttgtgtttttcagctccatcaggtcagttatattcctttctcacctattctkgttatctggctatcagctccagtattgttttattatgtttcttagcttctttgcattgggttacaacatgcttctttagctcaggaaagttcgttgttacccaccttctgaagcatacttctgtcagttcagccatctcagcctcagtccagttctgtgcccttgctggggaggggttgtggtcatttgcaggagaaaacgcactctggctttttgggttttcagcatttttgcgttgattctttctcatctttgtgggcttatctacctttaatctttgaggttgttgactttgaatgaggtttttgtggggtcttttttgttgatggtgttgttgttgttttgtttgtttttctcttaacagtcaggccacttgactgctgcagtttgctggagatccgctccagaccccagttgcctcactttttcctgtatctggaggtatcactagtgaaggccacaaaacagcaaagatggcagccagcttcttcctctggaagcttcatcttgggtggtttctgatctgttgccagccctcatacacctgcagcaggtggttagagacccccattgggaggtttcacccagtcaggaggaacgggattagggacccacccaaagaagtagtctggctgctttttgtagagcaggtgtgctgtactgggagtgggggtgggtggggccctcatagtctggaccacctgtattctccacagctggtaggctggatcagctgagtccactgaaccataaagatggtggttgtccctctccaaggcaacctgtcccagggagatatcagagctctctccatagcgccctggctggagtgactgaagctcctgcagggaggacccacccatgaggaggaatggattggggtcccacttaaagaagcagtctggctgcaatttggcaaggcagctgtgctacattgtgggggacccttccttgtatggtccatctgtattatccacagctggcaggcttgaatggctgagtctactgaactgcagagatgatggcctcccctccctccaggagctctgtcccagggagagatcagagctctgttcataaaacagttgctggaggggcttaaggaggtcctctctagcgaggaggaatgacttggggtccygcttacagaagcagtctggctgctttttggtagggcaggtgtgctgcattgtagcagagggaacccttcctagtttagaccgtctgtattctccacatccaggaggctgcagcagctgagtcggctgaatcacagagacggcagctgccccacctgctgggaactcaaacctgtctcaggcagactcctatccactgccattggctggctgggattccaagctggtgggtcttaacttgtggggtgtcatgtaagtggggcctgaagaatggtattgcttggctccctggattcagcccccttcctacagatggatttcctgccttgctgatgattgtggccagagtatgtaaaacttctgggcctctttgtatgtgcctgagtggctgctctgtcaagacaacacacagctctgtgtatcagactcaaggccctggtggtgtggagtcatgagggggtctcttgatccacaggttgcaaagattcatgggagaagcatggtttcctgggttgcacaatcactcaccacttcccttggctgagggtggaggttcctttggctctgtgctgctccgaggtgggctccccaccctgcccaacttttcttcattctccatgggccggtggtttgcctagtcagtcccaatgagagaacctggatatttcagttgaaggtactgaattcacttgccccttctcattcctccctgagtgctgcgggcaggggcttctaattggccattatggattgatctccctgcagtgaagtgttctaagtaggaagaacacatggtattgtggaaaatcaacatagcatggtggctcagaaatagattctggagccaggcaggttgcttggtttggaattctggtcctgcaacttactgcaacctctctatgccttagtttcctcacagtttaaagagggataaaataatatctataggtctatttgcgaggttttaaaattcttggaatagtacctggctcattatacatgctatagaaatgcttattcaattaaataaataaaagcatctttggtaagataactctgaacattgtatggtttagtagaggatgctgacaagaataaataattaaaacatatcatgaagtaagcataaaagatagtggtaatgcaaagatgcgaatgagctctgcttcctgtgattagtgtgagcagacaaattcactgtactcagaagcttaaagcctagcgtgggaagctgacatgaatgaaaaccaacgggaaaaaatgttagagtagaggtgtaagcaagagtgattaatttcaacttgaaagcaaatgggggaggtttcacagagaggggcccagcatgttggttgattgcttgggctccagaatcaggccagctcagtttaatgctgactttgtacctcactggttttgtgacttgacctctctaatcctccatctccttatctgtacagtggggggaaataataatgataataataggtagctcataggacaaataagaattcacagttaatgcatcaaaaatcttagcacaaggcactcaataaatgtgaagcttttattgttattacgagttgaaacttgagtgggaaagaacttcgttcacattaaacatgagaaaaggcccagaagttgaaaagcatttgacataattaaagaacagcaagtcagtgccacttaaacggtaatccaaccaccgccagtcagtgaacagctttttactgctccatgaacaggtaagtatagaaattgtgagtaagcatttagaaataaaaacaacaacaacaaccaataattgaaaaactaattttatactttttggcatactcattgtacacttgtaataaaaactgggcttgtagtttttgtctcttttcttatttgctagcaggttttgatttgtattttacagaaataatggtccatgtcagattggaaataataaaaacttgtcttttacccttgatagtttgagaaaaaagtaattcagtggggttagatatggcatccgagagatgattcgggaaaggtgggccagggccatgtttatgtggaccctccaatgcctcagagttcacacttgtttcagtgggcaacaggactagtaaggtttagagggactgttaaccgaaggtgagtggactttgcacattttatggtattttttttttcccagtaggcatgtgcttattctttcttttcttttctaattaaaagttctgtttggtttttttagttaagaggagagactggaactgctcagtgtttcacaaagataactgtttgtatttgataagagtttcgttaaacaaaggaatttgcacttatcaaaacataaagcattgaaaacactgagcacatactctgtgaccagaatgcgtgtgacttgttgagataagccacaccgggtaatcagatgagtctcctttcttcttgggcaccctcatataattcaggcacaaacgaaagagaaaacgctttttctgatctctcagttcgggtcatctctgccttccatcatcaccgcctaacaatcctacacctggcagggtgggaaaacggtttaataatctcttccctttgggaggcgtttgacagctcagaaagcatggcctttactcaggctcagagacacacaaaaacctttcacgttttcctttcagcttcgcagccccgtccttctccacctgcacgggcacccactgaagcacaggacccttctgccaagccatgagccttctcaggcccctgccgcccgcctcgcctgaggctgcgcttctgaaaagcacgcggccctggcctgcgcaccacccagtctgaaggcgacgcccctgcacgaaggagtcaggcctaggggctcgggacccagggcgacactcaattttctaacaggagccacagcccagaagctgagaagccttccggccgatctgtggccctgaggtcgcccttggagggcgagtgagaaccccccaggcgttccggaggtggcscccagcccgaacccggcgcccgccccggcttcccgagtcaggtctttgccccgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcaggtgtgtttgcagccgaactggcagtgcccgcgggcggctgggccgaggccttggctcctacccgcgggggtcgggcgggctgaggctggagcaggccaggggcgggggcagagggggacggacttccagcatcgctcattcgggggcgtgacgggaggacctggctggggagcggcgggttgggagcctgtggctgccccttcggtgacagtggagtcaccgagcctagaaatggggaagctgtgacgtgggggtggtggaggrtgctgcgggacagcagcgagcacggccctcagccgtccttcccaacacggtttcacttcccctcagctccagggctcagccccaagccgcccccttcatcccccatctgcaaacaatcctggtccccctgagcctccaatatgccttatgcagttcttttggggttcctttcgcattttaccgtgtactttcgcttttgatgcgtctagtttctgctactggactctcctagaatcgaagttccatgagggcaaagtcccatctgacttaggactcagagctactcaataagtaattgaatgagtacctatgccgtagaactgagtgaattaacaaatgagtaagtgaataaatgagtgcatacgagatacagctgaatcaatcagtgcatgagtgaaaataaagatgtatgaagtggaagcagtggagacgcaggcttacaactcctgttttttgatagctttccaaaaagttgtgtgaatgtcgcacttttgcaaatggaggcattctgattgggaccacttaaaaagagttctatgctgttcaaatggtctctggaaacgccccctggtatttccatttttgttggacttggctatatgtgtttgcttaaaacaaaatatgcctaggttttttcttgcttgtgttttgttcacttctactttggacgtttaaagaatcattgtcactataatattatttcatgtatttcttaaagataagggtgactctgaaggcagaaccatatgactctgacttgtttgtaaaaccaggcttttcttttgaattcagagttgttaagaatcttgtctgttttcctgagacaggtgctggctgatttgcaggtgactgaagaaggctacataaggcccagaaagacgcttatctgtttgtaaacaaataggcttagcacatagctttaatacagttggtcactgcagccgttcttacttgccaggtccaggttccagaagagctggatgaccttggacttgccacttgatctctttaggttttaatttcttaatctccaaaatgaagatgtttagctaggaaccctgcctgagttaaacctctgggattcttttgtatcagggttagaaggtgaaattacagatgatttcatggagttctgcttacttcacctcccatagcattttgtctctgctctcttctttgctgtttacagctcatttcctttcttctccacatctgcaacaagaaagcctgggagctcaagataagtgtaataaaccctaggctggtggggagaaaggagggtaagattttcttctacattgtcacaggctcctggtcctgggtctgacttttttccagtgcaacccagtctgacaatgccatatattcccagtatatctggggaactgcatcactatttcttcrcatgcatttgagattagttatcatagatcacattttggagctggaaggaccttggagattttttaaaggcacttcaaaagtcattatacatacatatttaaatatttttgcatgctacatttaacaaacacaaagttccaaatgtgttaagtaaaatgaaattaatgttacctacttcagtgaattcaagtttataaggagaagtggaatacacatgttgcttggtgaaaagggccaactttctcacactgttttcccaatgaggtcatgtgtcatacaggcatggaatgttacaaagctgatatttatggggcactgaccatacaccaggcactgttatatttaacctttttacttatrttgccccatttaatcatcactatatatctaagagctagatactatggtaagtcctatttgatcttcttaactagaaacagtacatggaaaatgggagagttaggactcaaaactcaagcagatggaaacagggtttctcccagaaacaagacaatcctgccaggaaaaactgtgtgactttgaagaatgtggtctctgtgtgtgttcaagcatatatacaaaccctgggttatttgggtaaatgaatttagaatgagagcacagggtgaaatgatgaagactgaattataggggagttggttgttttatcattttgaaaattattgaattccattgagattccaggagactctgatactttgacctaggtgcccatgcatcttaattttaaatgtgttcagacttaccaatttagggaatataaaatgagtgacatcgacagctgccatcagtgaatggcacttaagggctttgaaccatgagtgctaagcagtgttgtttcttggactagctttgtgcccttggtaaggcactgcctcccaacctctttctttataagaccaacaacccctagtatagacaaagaacaatgcctacatctgtgtaatccagagacaagaatgcaggatgggtttccagaacccttataattaattgaagagagcaaaagacgaaaagagaggcccataaaataaatgggaaattattttgtttctttttcgtcagccaagtttagccccatggaaagcagagaccagttgtggccgcctgaaaaactaagagctgatgccagtttgatttagctcaggaggctgaaactttctgccccgaaggctggtgtgatggaatagaccttcccattgctcacaatattatgaaaaaaacattaaagcaacaatttttattacttgccctgcagctagagctttaaaatgtactttcttctcccctaccctccctaaaccacttagcttttaaaaacaaacaacccattcatgtgtttgttacagtcacattattagttctttctctttattcctgggcccttttctttaatgcagcaaagtatttggagggatgtacttgtggatctgtggaattttactttattttattcagaaaatattaatttcaataaccatttattgagtgtatactatgtgacaggtaaagatgaatgagaacaaatctaaataggagagtgacccatctgcaaacaattgcaccacagggtaatgtggaagtagtggccactcactcttccaggaaagaggtatgattggaactcaggaagactttgcagagaaggtgaattttgaactgtgttttaaagcctaaagaccaagcagagggagaagggtattccaagaatggagaacaacaagagcaaggaaaaggaggcaagtatgaacatggcattcttcaggagatgggagttcagtgtggctgtggtagggaggtgtggtaaggttagggccagacagtgatggtccttgaatgtcatgttatttaaactttatcacagtctagataatccttttcagcattatttttgttttgttttgttttgaggcaaggcctctctctgtcacccaggctggagtgccgtggcaagatctcactgcgacttccgcctcccggttcaagtgattctcctgcctcagcctcccaagtagctgggactacaggcacacaccactacagcctggctaatttttttatttttagtagagacgggactttgccatgtgggccaggttgatctcgaccttctggcttcaagctatctgcctgccttggcctcccaaagtgttgggattacaggcatgarccactgtgcctggctcttttcagcatttttaagctgaattttaaacagaggaatgatatgattggattttccttagaaaatagctacagtaataatgtttcagaagaattggggaaggaagagccagaaggccacaggaaaatgaagatgctattgccataggtctaatgaaataggataaggatctaaactaagataggtttgagagactatttgaagacagagcaggattaatgactagctggagctggatatgggaaatatgtttgaaaataatctgaggttttggaattgcttaactgggtgagtggagatgccactaatgagggtaagaaatataaggtgaggaagaagtttcgggagaaagacggtgagtgagcagaggtagctgtggaacatctgggtggagatcccaggatatagccttttctgtagctgtgctgtgatgtcacacagtcaagaccttggccaaacattacaatagggcctcagtctaaaaagacacatcaatttaataactcacttaaaaaatacatcatacttatctaatgaccattacattatatttcaggcaagttmttagagaactctgattcttatgtaagtgccagtgaaggaaaaaagattggagactcaaacaatgaggagttattataagctgccaggagaaactgaaaaagagaaatacagaccagagtcattcaaaggaacaaagataaggaaatggcaggagtgttgcagaaagcagtggtttctgaagacacaggtataggcagatatgaaatacagagaagaaatttgagctggcgcttccaaataactgtacttctttaatggtaagatatcccaagctttgatttctcatcttattcastttgtcaggaagagacaaacaggtgtgggtgctgggcagagggcttgatctcattttgcagagaaagtgtttggagactttgaactaagcaaagagtaacagggaaaataagataaaaatgaaaagggtaatgattcggagaaatttttcagagaatttaaggaattctatgacaaacaggtgttaaagaaaaaggcagatcaacgcagtgttctcttgatatagtggtattagacttccttggaaaaaagattcgcatagcgccttatatttaaaaagcaattttatatttgattgttacaagaacctaggaagcaggtgcagccaggcattattatctttcttttataaacttaaaatctggcatgaaggaggctgcagtttgtttcatggctcagacggctcagatcccatggctggcagggactcagagccttctgactttgggtccattgctttgtccattgtatcaacgccttgccttaccttggaaccttggccttctgcagtgtgcctccttcccttatcatatcatatcacataaatgtaaaagtaaagcagatggtatttgaagaccaaaagagccaagatctctggggagacaggcagtgatgtgaaaggatccttagcactgattatgctatatacaatagggatgttcatgaagagttgtgcatagagtgttatctacgtaaatcaaatgacactttcagtgcagtaggggagtccacaatatccaaagtgttatgaytaaattttttatgaggcaaataatccctttataaaatgaacaatcagtcactccttgatatattatctgaataaatccagattttcaaatatggggttgacttaaagcaagatacatctctagtagcctacatctatatttatcatataygaagatttttctgacttgggtattgaatatgaagatggggatctggagctgkatcctctaattgttagagaccatttaaaatacaatggacatcatgacttgcagctaaatccattcagctacctttactgtttaccaagcacctaacaggtatgccattggatggggcaaaactcagctgggaaatggagagagaagcccagcactggcactgccttgagtctgacagttagaccacaagaaagtcataaatgtaaattcaccaatatagtgagccagggtaagaaaactagaaactcttatggtccttgaattctacatcagtattaaaatgaaaccaagtatatttcaaagcaaagactgttatattagacccagagttattctgtactgacaaaagataatctttgtaaggaagaagaggtagttgtgactctttatgcatcaaacatttaaaaatgcatatctttaaaacatgtaaaactaatgattagawctatgagaaataagcgaagctatttgtaggacactttagatctgttgttttacatgacaaatcaagtagacaaagtcaaatggtaatacacaagatttgaataatataactaatgaggttgaataatataatttatgagtgaatagggatatggaacatttmatagtatattttattattaatcaaaaaattatgttatgtatgaatatatatgtacatgatatatattgggatatatatggggtatatgtatgtatatatgtctccttttttgcattaataagttcttttttattttactgtaaattggcaaattatggttgtatatatttatgaaatacaaagtaatgttgatatatrtcataatacaaccttccatacaatgtggaatgattaaatcaagctaataaacatacccatcaccttaaatacttatcatttttgtggtgaaaatatttgaaatttgctctcttagcaattttgaaatatacaacacagtataattaactatagtcatcatgctgacaatataatctcaaaaaatttattcctcttgtttaattgaaactttgamccctttggcattccccattttccccaacccctcagactttggtaagcaccattctactctacgcttcttagttctgttgtttagattccacgtagaagtgagatcatgtggtatttgtctttctgtgcctatgtctggcttattgcatttagcataatgtcctgcagcttcatccatgttgtcacaaatgacagaatttcctcatttttaaaggcagaatagtatttcattgtgcatrtgtgccacctattctttagccatttatctgttgatggacacttcggttgattctataatttggctattgtgaatagtgctgcagtgaacatgggattgcatatgtctctttaatataattatttcaaatctttggctatgtacttagaagtgggattggtggatcatatgatagttctatctttagtttttttgaggaccctccatgaagttttctgtaatggctatactaatttacattcccatcaacaatgtataagagtttcctttacttcacattgtcaccagaatttttttttgtttgtttgagacggagtcttgctctatcgcccaagctggagtgcagtggcgccatctctgctcactgcaagctccgcctcccgggttcacgccattctcctgcctcagcctcctgagtagctgggactaccggcgcccgccaccatgcccggctaattttttttgtatttttactagagacggggtttcactttgttagccaggattgtctcgatctcctgacctcgtgatccgcccgcctcagcctcccaaagtactgggattacaggcgtgagccaccgcacccggccccagaattttgtttttgaggcaggatctggttcttttgctcaggctggagtacaggggcgtgatcttggctcactgcaacctctgcctcccaggctcaagccatcctccctcctcagcctcctaggtgactgggactacaggtgtgccactgggcctggctaatttttgtatatttgtagagaaggagtttcgccatgttgcccagactggtctcaaactcctgagctcaagcaatctactctccttggcctcccaaagtgctggattacaggagtgagccacagtgcctagtacatttgtcattttctgtctttttcataatagccattctaactggggtgagatagtctcattgcagttttgatttgcatttctttgataattaatgatgttgagcattttttaatatatctgttggccatttatatgtcttttgagaattgtctgttcaggctctttgtccattttttaatcaggttgcttgttttcttgctattgagttgtttgagttccttatacagttcatccttgagcaatgcggggcttagcggtgctgactccctctacagttgaaaattctagtataacttttgattcccccagaacttaactactaatagccaactgttgactggaagccttaccagtaacataaatagccaattaacacatattttgtatgttacatgtaatatatactatctgcttacaatagagtaaggtagagaaaagaaaattttattgagaaaatcctaagggagagaaaatatatttactatttattaagtggaagtgaatcaccataaaggtcttcactcttgtcatctttatgttgagtaggcggaggaggaggaggaagagaagggattggtcttgctgtcttaggggtggcagaggtggaagaagcgaggaggtgaaaggcgagggaggagaggcaggcccacttggtgtaactgtctggaaatacataataatttctgtatggctacttttctctttctaaaaatgttgtaaagtttatcttaaaatgtttctatacagtatcagtctttcttctgctatttgcattagcttcagtgcccatatcatagaagcgttcatgtcataaaagaagtcaaatgcagtcttaaataatcagaacgcttctgccagattgtctgatgttaatttgctttttggtacttttatatcctcctcatcatcataaggcactggttcagaagcactccgtcaagttgtcttctgtcaattcctctggtgtgtagtgtctattagctcttgaatttctccaagattcatatcttgacaccttcattcaccaccttttttcccactatatttacaatcgctttcattatttccttgaattggctttgtcataaaccctgtgaagtcatacacaacagctgggcacagttttctcctgcaggaacttattgttggcttgatggctttcacagctttttctataacaatgatggtgtcttcaatggggtaatccttctaggctttcatgatgttctctctatcggggttctctaacatagcactgacatcctttccatagagtactgtgtataatgagccttcaaggtccttatgatcccctaatctagaggatgattagagatgttgcgtttgggggcaagtaggacacttggatgtctttgatgttgaactcatggggttctaggtggccaggggcattgtctaatatgaaaataattttaaaaggcattcccttaccagcaagatactttctgacttcagagaaaaagcatcagtggaaccaatccagaaaaatagttcttgtttaagccaaaagactggtagctgatgtttatctttttccatcaaggcttggaggttagcagctttatagatgacagtcctgaccataaacctgactgcatttgcatgaaacagtagttagcctatgccttcctaccttaaatcttggtgctcacttctcttccttactaataaatgtcctttgtggctttttttttttttccagaatacagcatgttcagctgcattaaaaccctgtttaggcaggtatcctttctcctcaatgattttttaatggctttgcaatatagtttgatatcaggcagtgtgatgcctccagttttgtttgttttatttaagatcatcttggtgattttttttaattccctatgaattttagggttattttttctgtttccttttaaaatatactttctggccatttttctctctcttcgtcttctgaaattatgtgaagattagttcccttgactgtgattgtgtcacataattcttgtaggttttcttcatcttttccattcttttttctttttgctcctctgatgaataatttcaaatattctgtatttagctcattgattgtgctgcttaattgagtctgctgttgaagatttctattgcatttttcaattaagtcattgtattctttatctcttgggtttcttttttattgtttctacttcttctatattctcattttgtgtattgtttctcaaatttcatttaattttatatccatatattcttgtagttcactgaactgctttacaaggatttttctgaatcttttttctgccactttatagatcttcattttttagtctgttattggaactttgttagtttcttttgatgattacagatgctctttgacttacaatgggcttatgtcctattaaacccatagtaatttcaaaactttgtaagtaagaaatgtgtttaataccccagtaaaccaattgtaatgtcaaaaaattatgagttgaaccatcataagtgcagatgctccttgacttacaatggggttatatcctgataagtccgttrtaaagttgtatagttgtaagttgaaccatcataaattggggaccgtctatatttgtaatccttgtgttctagcattggtgtctgcacatttgaagagacagcttcctcctgagtgcagtggtataatgacagctcactgcagccttgacctcctgggctcataagattctcccacctcagcctcttgagtagttgggaccacaggtgtttgccaccatgcctggctactttttgtattttttgtagagaggggtttcaccatgttgtccaggctggtcttgaactcctgggctcaagtgatctacttaccttggcctcccaaaatgctggaataacaggcataagccactgcatccagccccaacagcttgctcttctggtctttacaggtattctttgtcagggattgacctttacttcttagtctaggctgtgattctagttgggtcaggtggtaatgaccccatgcaggcagagctcgctatagttggctgggtgctgcctttgctctgaggtctgatggggctgctggctcggctcccatgcttcggggagaccactggctgagctctgctataatttctgattggacaaggttgtagggtgtacttcctggctgggtggtactacttttttggttcaacagttgagcagggctgcaggctggactctgagtttaggtggagttgctgctcaggatggatggggtctggagtatatgctgcatagaactgcacagttgaggattgcctgtctctgggcagggccttagagtgggctctgagtctggattgagtcactctttggatttctgcgtcaggcaattccaacccctatgatccacagaaatgccctgtgatggtcatctccacatctcccgcctgggtaaggcattgaggtcgcctctgaggctggccgtctaaagactcaaagcaggctgaccttctcatcatgtttctgtgaacagtgaacttggctttgcaagtgagccataccattggctggtatctctgattgtgcaccaccactgggaggaacatagagccatcaccaaaatttgcacactggtccctgtgagctctgcctcctttctttgtttatacctaacccaggaggtctagccatgtcattactgccagtattccccatgaggtcagatgggagtgggctttctgggaagtgtctcagaatgctagggagctggatgtctagaaactctggttaccttttttttttttttactgtatgggcccagttaaaaagatcctcttggctgggcacagtggctcacgcctgtaatcccagcactttgggaggccgaggtgggtggatcacgaggtcaggagattgagaccatcctggcaaacatggtgaaaccccgtctctactaaaaatacaaaaattagctggacgtggtggtgtgcgtctgtaatcccagctactcaggaggctgaggcaggagaatcacttgaacccaggaggcagaggttgcagtgagctgagattgtgccactgcacttcagctggggcaacagagtgggactctgtctcaaaaaaaaatcctctctctgtgtgtcaccatgctgatctgggggagcaggaggggcagtgtagtcaacgtgagattgttcctcttctaatgtggtttttatttgattcagtggcctattcattcagctgtctccgtttctttctcaagtttgtaagttttcacaaaagtgttcttgtctttggattgttgcttgttggactttctgtagagggaagtgaagccaagtgaagcctgggacttcctattctgccatcttgctgatgtcatgcctacatgtttacagaaaattcacatcctcttataacatttatgagacattgtaaaaaacaaaacaaaacaacaacgacaacaaaacccaaaagccttaaatgaagactttagtgaattccagagtccttcttactcttactggccttgtgccttagccctctggtttagcccctgtttccagctagcttttaacaggttgagatgatgaaaagaaaacatacctctctcctttcataatgctgtgaagtagctcatataattcatcttccacgtttatatacgtatgtctcttttgtgcccagagcatcattttgagattcttttttcattatcaaaatacattggatctatgttattcataactaatctgaggctgtatttgttacatttgagtattttaaatcattaatgccatatgtattgtataccaaaatttaccatctaaaacacctggctattcttttgtagggtttttcttttcattagcttttttgagctaaagcttaaagaaaatcagggaccaaaggaaggttagaaagtggctggaggtatcataaacaccaactaagttctttgagaagcagaaggtgcatcatggaaatcagcattattctgacttcatttcattgcctactcagtccaaattttagggtttacaacttaaactaataactcactggcaccttgcatttcctgtggcttaatggttaagaacatgggctttgaagtcattgtcctgagttcaaatttgaggtctaccaccatcacctatgtgactttgggccaaacacatatactctttatacctccatttcttcatccataaaattgggataaaaattataactgtctgcagtgggcagaatactgtcttccctaccaccccctacggtgtccatatcttaatccctgaaactgtgcatgttagattacattgcaaaggggaattaaggttgcagatagaattaacattattaatcatctggccttaaaataggaaattatgctggattatcctggtgggcccaatgtaatcacaaaggtctttaaaagtggaagagtgaagcagaagaagtcagagagttaggaagatgtgattatggaagaatgttcaaagagagacagtgccactggctttgaagatggaggaagrgggccatgagccaaggaatgtgggtggccacgagccaaggaatgtgggtggccactagaaactgaggaaagcaaggaaatagattctctcctaaagcttccagaaagggatgcagtcctgccgataccttgcttttacgtgatgcatacagtgtcagacttctgacctaaagaactgcaaaataataaatttgtattcagataccaaatttgtggtattttgttacagcagaaataggaaataaatgcaccgccatatggggttgttgtaagggttaggaaatgtaaacctttaagatagacctgccacatggtaaatgctcagttagtattagccactattattatccattggtactttagtttcccttctgtctttgctcttttgtggtagttgtcttgtaattacccaaatttgtggttatcttccctacaaagactatggccctaggtgtttttcactctcattttagtctatactcagcctccagtaatttgtcaaaattaccatttcagagttcctaccattttgtggttccagcagcttctgttccaggtgagtagatcttggctgtgactctctggatttgcctgtctctccagattttagggtggtagtttgccctgcaacttcagttctgtggggcatccaaggaaagtcgctggttttcactttgttttgtttcattattgtaaggacatgagtgctgacttccgagttctttacatgttggtactgaaattggaagtgtgggcagtgctctttaccctacggctttaataatctttctatacacatgagatcttcatctctacactttacttctttctgatttccattatctggttttcacttcattcatttcatttccaaacatgctttttctgtattttctatttargttagtggcatctcaatccaagggatagtagttaatttgatgtgtctgaaatacagggtacaaaacaggctcatagtcggggagattgcccttaactctccacctttcctgaatccttttcttcagaattagtaagtcgccaagggctgttgtgtctatgaattttgcccacatccttgctgtcattacgctagtcctaactcttgactcggccatgcagaatattttaaaccactttatcctctacactgcctcagagttaratcataagttggatcatgttacttcctctctcagaagacctacattttgaaaaattgcttgtggaataaatcccaaactcctaatttggcatttaaggttcttaaagatctgtaattaaggtatatttctaggtggattcatagtgcatgtacctactgtatttgctagtgctaccacaacaaaatcctgcagactgggtaggttaaacaacagaaatgaattttctcatggttgtgggggctggaagtccaagatcaaagtgtctgcatgtttggtttcttctgaggcctctctttttggcttgcacgtggccatcttttctcgaggtacttacatagtcttctctctgtgcatgcacacccctgatatcgctctgtgtattccagtttcctcttcttatatggacaccagtcagattcttttagggcccaccctgatagtctcattttaccttaacacctctttcaaagccccattttcaaatagtcacagtccaaagccctgggggttagggctttaacgtatgaattttggggaacacaatttagcccataacaccgactgtatccctctatgtattctgtactcatgaatgtataatggatcacctaggaagatttagaaaatactgatttgggggtctcacccaacttcttgtaggttctgaatcagtaggtctgaaatggggctgagaatacatttggtgtgtgtgtgtgtgtgtgtgtgtgtgtgtgtttatacttctccctagtgctttcccagctttcctagactctttaacattattggtgaacatactataaatgttcatacctttgctcatatttgttttttaactgaaaattctcttcctaccatacctatgaaatttaatatctatgaaaattaattyagccttctaggctgatctgaaatatcatcttttctgttatctttttcttattctctccagagataatcctgcaatactttgttgtgattttattttactttatataagtactgaagaatttattttgttttatatgatagtcatttgccttcttctttcactagctttctgagaccaaagaggacatattctttatttctgtatatatgaaacagtggcagttgctctgaacatagtagataattaatcaatctttgcagtgtgaaaaatgaactagttaagaaatgctaatatttttattgtgactttttataaaatggagatcattgggtaaaaaatgaacatatcaaatgtaaaacaagtggcagacttttttttaaaaaagactttacttttttttgaaaagcagttttagattgagaaggtgtagaaatatcccatacactacctgcccctcacatgtgcattccctaccagagtggtacattcgttgcaattgatgaacccatatagacatatcatcatcgcccaaagcccatggtttgtattagcgttcactcttggtggtgtgctttctatgggtttggattgccctaaaaatcccctgtactctacttgttcatccctcccttcccctcactcctggcaactactgatcttttctctgtgttcgtagttttgccctttccaagatgtcatatagttggaatcatacagtatgtagtcttttcagattcgcttctttcactgagtaatatgcatttacttctcctccctgtctctttatggcttgatagcacatttctttttagctctgaataatattccattgtctgggtgtgctacagtttatttatccgttcacctactgaagatcatcttggttgcttccaaattttggcaattatgaataaagctgctctttacatccatgtgcaggtttttgtgtttacatgttttcaatccttttgggaaaatattaaagaatgccattgctggattgtatgttaagagtatgtttagttttttaagaaactgtcaaactattttccaaagtgggtgcaccattttacattctcaccagcaatgagtgagcattcctgttgctccacatcctcaccagcatttggtgttgtcagtattatggttttgggccattctgctaggtctgtagtggtatcttgttttcttttccatttccctgcttacatatgatgtgaagtatcttttcacatgtttattttccactttatatcttctttggtaaggtgtctgttaaggtctttgggtcattttttaattgggttgtttgttttcttgttgctgagtttttaagagttctttgtatattttggataatagtccttatatttaatatgtcttttgcaagagtggcagaatttttgttcattatttttttcttgaattaaatatccttaacattacacataaacagtatttttaatgtgtattttcaatttggaacttttaacatttaaaaatttctcttgatgaagatatgtgataataaaatggggggcaaagtgaagacattgtaacaatttttgataatcgcatcttcttctgcattgcatttttcagggcagagtattaatggtccagttcttaaagataaatggattcctcaatgtttatttgtagtatatccttgtttattctcctaatgaagaactgcatccttaaagctggcataattaggtagacttgtctattagctgagctactaagctttattttcctgggccaatgaataacagaaacaattctcaaaataattaaatctgttaagacccagttttggggtaaggagctggggtctggcatttcctttttgttggtttttcaaaaattattaaaacttcaatgcttggccaggtgtggtggctcatgcatacaatcccagcactttgagtggcaggcagatcgcttgagcccgggagttcaacactaacctgggcaacatggcaaaacctcaactgtacaaaaaatatgagaattagttgggtgtggtgtggcactcctgtrgtcccagctacttgagaggctgaggcggcaggattacctgagccctgtaagggtgaggctgcagtgagccaagatcgcaccagcactccagcctgagctacagagcaaagccctgtctcaaacaaaacaaaacaaaatctcaacgttaaactttctagagaatgggtaatcacctttcaagtcatttttccaaacccatttytgaaccaggacaggcaataacagagattggcaggggaaggactgatgtctcctcacaagggaaaaaggactctgcattgaaaacacagatgagcctttggatgtggaaatttacaaggctcagagagccccgaaacatcttcagaagtggagcccagcagaataatgggaggctgtgtgctggcttggcactggagactgtctggcacaaactacactgtaaacaactcctcaaacattttcatctgcatacatgacacatgacattagattctccaaatgtccaattaaacacttgtcaatggaagaaatgtttgtttcctcagctgacctgttgtcagccttggccttcctgatggggaagcagtttcagctgatactgttgtatgctcttcctttctgggcctgatcttgtccctgttgagaactgtggagactgtgccaagctgtggaccatgggattaggttaggtaactaaagaaaatatccaggctgtgagcacttttcaaacctaagaaaatctttagtttcttttgcacagttgtaaaccgtttgtgcttaaaaaattataaaagtgattgcagttgagatagagaaaagagcagtgctgatatgtgtttatatacttctaagggctgacttcatttttttcaacatcttaaacttctattgaacaaatattgtgtgtgtaggtgtgtgtttgtgtgtgtgtgtgtcatcatctctgttgacagaaatgctcaatgataagtctctgtgactggaagagcagtgaaggacttggacacatgctgtagaaacataaaggaagtgaggaaggcaatattggagaagaatcaaaggagtttaaattattctttggaaaagttggagtttataaattaaaaaaaaactgtatgaccttgagcaaatttctatttttactagtgtcagtttcctaatccataaaatagggaatataatgtcaagaacatcgaaggttattattaaaattaaataaaatgatctatgtaaaatgcagcaacacttgccacattgtaaattctcaagaaatgctagctaatattgaaatatgaaataatacttctttggtccaaagatgtttaagcattcctatttggtaaagagaaggagcaaaagamcaagagaaaaattagataattggtacagtatgaacagagtatttggctttggaaaggagggtgggcagttctttcactgggacaggagctcagaatgactctataggtaaagggatagaagaactttaaggtgaggatgaagaaagacaaagcatgtcatggtcattctattgtctcttcagttacgtagaagaggagagctttttctgagcatgagggggaataggagtgaaatttgaggcttaaagagaatggaaaagtttcatagcagctgctgtggagaatttgatacgtgtcaactgaagataaatataagggttgtgcagcaatgcagaggatatggctgaggtcagacagccttagtttatagtggcatgattttgggaatgtagatgatggcattatgtaccctggagcaaacacagagaaaattcaaaattacctttgaggaataagaaaggaggtgaggagtaagggtaaaggcgtcctaaggtgctaatgaaaatgctgttgaaatcattaaccaccaagtaaagttgtgagccaagattaatctgaaatggtgatttgtgtggatagaagtacaaatagactggaggtggggaggcccttcactggacaggcaacattaatctagctgccattgtaccrcacacatgctgaatgatgatgatacaggaatgaaggaaacataattcacttgggcagctcaagagcatttttttaagctcttagtatatactggctagatcatccatatgacagcaatgcttcccttgaaaagctttaagtctagtgatatgctctggataatttaaactcagactgtggggtactttgaaggaggtaagcagagggtccgaggaaacaatagaagaggacattcaacatgacctgtgaaaagaaagggcaggtcagtaaaagtatcctggaaaatatcttgcttgagctgaatcgattgtagagagccagggtaaagaatggcagaaagggagaggcaaaagcaagggagaaaaagcaaggaaaaaacagagcaagggagtgatttggctagggcagacaaaagatttcagagaagggataattaagatgagttacatatgatactattactaagtgagagaaataaggaagacatgaatgaaagtgataaacaatgtgttggtaggaacagaagaaagaatgtcaagagaacagaatgatgagatttaatgactgattgaatacgtggggaatgaatgggtgattttacactcttgatcctgaattatagggacaattatggtttccttaacagaaagagggaaatcccgagttagggaagatttaggggaaggtgatgagtttggagatgttgaatcagaacatatggtttcaagtgaaagtaattcaaccaagatgggattaaaccaaatgagagaatttgtgatgttcataattagtaagttcataggtgcttctggatttaggcatacctggctctccagggttcaaatatgatatgggcttatctctattcctatgatctctgtctcttagattagcttgtcttgcttgttttcattccaaagacaggctctcagtatatggtaggcaaatgggtacctccaggttcacattccagcgatcccggtggaaataacttttatttgcaacatccatatattttaaatgtaggttttattattattcagatatggtgaggccaggagattaggagaaaattgccaatggaaaatataatttgttactcatatctcctatgatatgggggcacacaatgacatgcagaccacacagggaagcaccagggtcagttaggaagcagaaggagtgagggaaagagcctttattgtggggtttgtgggaaggaatggatgagtcaaagcaagtaggcttaggtttggctagtttgaatgattttcgtgggctctgggttgtagagttctttagcaagacgtctggtacctagccctgtggttataaaggcaggagaatattggctaggtgtatgaggatttgataagggaggtcatgctggtgggatgggctttggattggctagtttctgtatgaaaggcatgcttacaggggtgttatttgctatcactagcaattagctaatgctgtgagggacagtccctcctggtccattgagtccctggatgccagaacattaagaatacagaaaataagagaatatagttaatacattgtataccaaygccaggaaagattctgatttgccttacttgagtcattccagctctgtagtttaggtgcagagtacagggtgaggaatggtattgtgattgacagtcaacctaraccagagtgtagggatcagggaggactaccctaaagaaaataaagccagaacatgggaaagtatgctggtaaatcaaaaactgtatcgactggtctatcacaaggtggctagagccgtcttggttgagatgaccaggtggccattcaaatatggctcttggcctctagacttcgaagaggctaaggatttttatttttgttttagcagctctcgtacaccatgtattgctcccgggcttgatggccctcttctgtcctgcttttctaaagcctatatagttcctgagctcagtgttaaaaaccaaactggagttttaggcatcatttaggttttctgattctcttggtgaggtaccagtgttttcctcaatgcctacctcaraaaccttagctttgactcccttcctttcccttctatcaagtcatttatcttcttctgaaatagctcccagatttacttcttccttactcatattagctgttgcctttctagtctctcttttttaatacggctttctgaatattgccagagttatctcactggggaaacatcatccccacttctcccacaaaaaaaatctaccccgccatttggacattacagagagtaaatggtgtgtacatattacatgggtgagtgtctgaagacctagattcaagtcacttcacgttcctcctctgcattttattaaagatatttggtagcttacataagaaaatgcatgttttaaaactttttataaatcataatgtagttcagatgatggtgattttttgatttctctaattttgaaattctaattttcaggcttatctttttctttttttttttttttttgagaaagtctcacactgtcacccgggctgaagtgcagtggcacgatctcggctcactgcaacctccgcctcccgggttcaagcaattctgctgcctcagcctcccatgtagctgggattacaggtgtgtgccaccacgcctggctaatttttttatatttctagtagagacagggtttcactatgttggccaggctgatctcaaactcctgacctcgtgatctgcccgcctcggcttcccaaagtgctaggattacaggtgtgagccaccgcacctggccttatctccttttctaaatgaacctctccgtcgccacacttaggccaagtttgtttctatctttatatctttctatattgttcccaacccgaaatccccttctttgctctactgtctgccaactaaatattagctatccttcaaagtgtgtctgaagtcctgtctcttatatgaagtcttgtctaattatctagatcacctgtattctctatttttcttacacttcaatttcactactgattatttacctttaattattatatatcttttattctccacaatatgtttgatgcttctgagggcagggatcctgacttttacttattttgtatcatggacagttctgggcataaatttaaaaaaaagttgctaatgattaattattaattggggaaaagtactaatttgcaataatcacactttggatatagtttgtgagcttcccttttcctcatggggagaaataagtttggattgattggactgacagatgttgaaacaatttggttcagttagacaaattcttattgagttctaggacatatgggtaactgctgaataaatattcatttgttcatttattcagtcaacaaatatttattggatatccattgtctgccccacactgtgcaagttaccataatatatgtctgcaatcagacatttagatattgaaaatctaaacatgaatcttacatggttctcatcttcaatttgctttattacatgaccaaggatgagatcattgggtgattataaagcattgcagaaaagtaaatgatatgcttgtggacatttgaagaagggagtaatttattctgactcgggtagctcagaagaggattcaaagagaccatattcaggaaaaaatgaaacatgtagaaaggaaatattaacactcatgtttgctttgtgaaaattttgcattttacacagtgtgttgttaaaaattaacgtgttggagagtttccatttccaggaagatggagtaaatgtagtttttcctatttgtctcctaagtgcaactaaaaacccttgacattatatatataaaacaaatataagaagactctgaaaggtggagagaataaggcaaaccagctggagacctcaggacctgaggaatgacacattactgagttccctgggtttttctttttgccttgtatatctcagacttagagctgaacaaatgggtaacttggagatgccaatggtgcagacaaaaaaaaaaaatctccagcaaaagcctgttttctctaacaaaggacccaaaaagggataatccagcaaaacaaaacttttaaaaagtaaccactctattgcaaacaaacagaaaaaattgtggccccacccttatgtattcagcaaagactgagtggatatcttagatgtctactctaataaggctgtgatgaggtatctgaatatccctgccagggtagggtcagagaagaccaagtagaggtactttccttcccatcaaccagtaatgagcctcctgctgcccccaccacatccccacttgtgatgtcagcggggatcttggacttgtggcctaattgacaataatgcacctctcccttgccctgctggcatgatgtcagaggagatctagtggacttttaccgtttcccagaagtattgaggccatcttaccacagtgtcagtggataccacatggaggatctacaactctcactttcactcagaatgtatgaggagaccctgcccctccttgagtgtcaatggaacctggacttgtacctctatctggcattgatgaggcagtgacacctcccactctccattgcccctgcagtagtgtcagagaaatccaactaaaatggatgtggagtctcataacataatataaatatctgggtttcaattgaaaattacttgtcacagaaagacaggaggaaaaaaaacctagagaaacaaaaaacagagaagaaaaatagaaaataagaaataaaattgtggacaagttctaatatatcaacaattacattaaatgttaatggcgtaaatgtaacaatttaaaacagattgccagaatggattgaaaaacatgatcaactctatgctatgtacaagaaacttacttcatatgtaaacatataggcaatttggaaaggagagaaaaacatatgtaattgattcttgttaatcatggtagttatgttctgtaaaactgctgtgaatgctgaatttgtaaatactaaactgctgttcctaggggaaatacagagctagattcctgcaagcctctggtcacatttttctcaactggtcaatgaataattttattttatgtgttctgtttaaagacrccttactgagtatatattatcgattcattaactttgaactcattgccaagagctctagaactcatatctgaacaaagcttatcgcacacacatgttttctctgtaaggtacatcagagctttcatttgcttaggaacaatagggctttagtactatgcttgaggccattttaaacagtaaaatcaccaacaaaaagtacaaacatatcaaaaccgtggcactaaataaactgtgagaacagttgtttacagcatgagagctaaaacaagaaggcaaagtatttacttgtttgacctaggctaggaacatgtgtatggagtgactcaattttttttwtttwtttwtttttttttttgctgtactgcacttgtgcacaaatgactgcaaaagcaatgcaagtatgattttggggttacaaataaattttagtgagtaggcaaattagcaaatatggaatccacaaataatgaggatagatggtgtcatgcaaagatcaatcaaaggaaagcagatatattaatatcagataaagtagacttcagatgaaagaaaattaacagagacagacattatctaatgataaaagccttatgctaatgtttataacagctttatttgtaatagccaaaatggaaagaatccagttgtccttaaattgatgaatggttaaacaaactgtgatatatccatactatggaatactactcagcaataaagaggaaaagattatttatataggcaatgacctggaagaatctttagggaattctgctgagaaaaaaatcaatcataaaggttatatacacgtttctatttatataacaatctttaaatgacagaattatagaaatgaacaacaaattagtggttgccaggatttaaggagtttgggtgggggtgggagtagagggatgcgtgggtgtagctgtaaaagagcaacaggacggacggatccttgtggtgatagacatgctctatgtctggactgtctcaatggcagtatcctgcttctgataaagtactgtagttttgtaggatgctgcactggggaaactggggaaagtttacataggatctctctgtattctttcttataactcaatgtgaatctacagtgatcccaacataaaaackgtaatttaaaaaacttagcgtactttactgtatgtagctcctttccttgtacttgataaccttaagtctttttgtcaaccagtgatacactggtctacaaatatttattttgaattcctgcttcgttctcagcattatggtggctggaactattaggaatacaattacagaagcataagatttagagtacatataaaaaagcgtgtgtgtgtgtaaagcatatgcaagtatgtctgagagagtaaacataattctcatctttcaaaattttagtgttccactgtaaattgtaaaagctatagtgtaaagtagcatttgtaatcctattcagctcttaacttgccaagaatatcctctcaggatgtgttgcttcactacagtaccaaccattgtgttgtcaaatccatgtgaattatgcaaaacaaaagaaaaacaaatggcctacctaaggtttggcagctgcaacaaggaaactatcaatttgaggtttattgtaatacattaaatttgaaagaatattcttccaagtaattctagggcttggaatgaatgaaggatcatttgaaaaatctgcaactcatttctaaaagattaggaaaaaagagaaaagaacatagttgccaacttctccttggtttgtatttatggaatatatgaaggtttagcattttagattctttcctaattctcagttaatttacctgtagaatctctttgaagaactacttttacatttctttcattttgatgagaaaattgaaaacttggggcaactaaaaagaagtgtttagcttgagtgatagttcattaatatgatttttaggggcctggcagaaacaaatagatcctagcaggtcttgtgatttagaggattattagagatttgggtgaaatagataagtatttctcctttgatagaatcagataattgtctctctgtgcaatgtccaacaccagctttctatgtaataaaaataaactgaaaacaaacaggaggcaaaaataaagcttcatggrcttcttaaactgtttgtgaaagttgttgttctagagatcataaggtagggagttaataaatactttgttccttgacagggctaccccattgtaccactccaaaaccatgggaatggtgtcctgtgaggttgtatagtacacagtcagccttgttctgtgcagcatccctgggacctgccatgtactagacactgttctaggtactggggatatagcagtgaacaaaacagatgagaaatatccctgccttgatggaatttccattctagactggaaattgagacaatgagccaaatggataaattaattttatagcatgcttggaggtggcatattctatgccaaaaaataaagcaaaggagttggaaaacaattgctaggattggggagttgtttcagttttaaatagggtggtcagatcacttgagtgcaggagttcgagaccagcctggccaagatggcgaaaccccatctctactaaaaatacaaaaattagctgggcttggtggtgcgtgcctgtaatcctagatactctggaggctgaggcatgaaaattcctttaacttgggaggcagaggctgcagtgagctgagcttgcatcactttactccagcctgggagacagagcaagactctgtctcaatttaaaaaaaatggggtggtcaaggagtgcttctttgagaagtgaatgttgtttctttaaaatttttttttaaaatgttagattcagggggtacatgtgtgggtttgttacatgcatatagtgtttaatggtgaggtttgggcttcaagcatagccatcacccaaatagcaaacattttcaaccaagatgaaggtgtactgttmactctgggtaagagtgtgccaggcagaaggaacagttactaccaaggtactgaggtgggaatattgcccttcagcaaagaggctagagtgactggagcagagaaggggaatggtagatgttaccagtggagtcttgactaggagtcatccaggttcttggcagtttgaacaaagaattggacaaaacacacacaaagcaatgaaagaatgcagcaacggaagtacagatttattgacgtgaaagtacactccacagaatgagagtggacttgggcaagcagctcaggagcagtggttacagaattttctggggtttaaataccatctagaggtttcccattggttacttggttacatcctacataaatgaggtagtgggmcatgaccagtctgattagtcgcctttcatgatcagtcagagactgaagtggttacaaagttacacccctatgcaaatgaagactaggcctgtgaccagcctgattggtggtgggaggggacaaatcagaggtactttccatttttcatctgataccggaaggggtgtgttgtaaagggagtagcctctgatacttttgttacatgggcttggaaagttggggttttccttatgatttagttctaggaagtcagtgtgaattggccttagggtccctgcctcctggcgctattctcctgcctcagtagagatgagatctgaacataagatgggacttgtgggacatccataagacttcagcttttattctgagcaagatagggtgcaatctgagggctctaagctgggaggtgacattagctgactagatagctgtgggtagtgtgaacactatattgtctggctagttgggaagtggctcaaatatcatattgaataaatcgcaataaaatgctaaagttggagctgtaactgaggaaaatggtggttagaaaagagaaatgaaaaacaaataaacccgtgacaagacttttctattacttgtaagaaagtggaagtggaggagtgggggatactgtcttgtaataaaaacttagtcttatttctaaaaagtaattgttcaactagaagcaacaaaactaatcatagggaatctgttttagtaggtaatgcagtatgtcaaccatttttagagtatctcaaaattttcaacattggcaaaatacccaaagctggcattacagcttggattcttcccagtggaaaaccaagttggacacaaagttctgaagaggaaaggagtctgagaaatagaaagaactgagatgcgtgtatttcctgaaccttttttccccctgtccttaatgatgttgtggttaaaacacttttgtgggtttattgagactgataaatacgctcatttacatctcattaatgtcaaattgatgtggctgaatagcatagtttggtagtctctaatgtgtgagacttcatgacttaagtaaacttttctattactctgaattagtgtcaccaagggcataggttttttaaagaaatgcttgtagagactttaaaataatgaaaaatattcaacacacctggctaagagtgattgtattacattcctgtttctttagataaaggtctgtcagcacatccattacaggcacatcttttcaggttgaaacttggcatagcagttctaaagaggaaagagattcaaacaaaatgtgaacaaaatgtttcttttgcttgaagaagacattcccttcataccctgatgcagctacatcccataaaactttgagaatcttattttcgttttgtttttggtaaaataagaagcgcctttgaaaaacagtttatctttggacacgaaggtaaagaaaaaccttttgatgtttggcaacagatttgcttaagaacaaaaatgatttaaaggactttttgaaaagagttagtgttgtctatttttattttctcagacagaccataatcacaatgactattgaaacaccgatacccttaagggctaaatttatcccgcctgtccctggaacaaaacaagaatatccacaaacatgacaccctctttggcagaatagacactaagtgcatatttgttgagaattgagaagatgcataagtcagagaaaakaaattatatttaaaaaggctttacaaatttttagtttttgaggtaatatatacaagtggaacacaactcaaaaagagtatgtagtgaaatgtaagtttccttcttcctccttgctctaagccaccactgggttaccctccacagagacaagcactgttatcagtgtcttatgtgtcatttaagagagcatattcttttttctttttagttaattggtagctttacattttattctgcaccttgctttgttctcctgacatttcattttggaggctgttcaatatatgtatgtagagagctacttctactgcattctttttaattagcttcatgttctaattggtacgttacatgtaccaatacacatagatgtaccatgatttacttagtctatacataaacatttaaactattcctaacttttcctattacaaacagtgtaacacaacatcctcgtgcacagatcattttgtgtgagtgtatctgcaggataatttctagaagaggaatatttatgttaaaagtatatgcatgtatgtagactcttctccatagaaattgtacacgcccagcagcaatatggaagtgtgcctatttctccattccctttccatcacaatgtatatcaaaaacttagtaatgtgatggaggggaacagcactctgttttagtttgtgtttttatcatgagtaatgttgagcatctttttataagtttaagaatcatttgtattttctatgaactgtttatatattttcttgcttttagaaaatattattgatccttttcttattgatatgtgaaaactcttttttaaaataagtgttttctcaacacacactagtgcatttttggtgtatgtaagttccaattggctttttatcataccaaaaatgtttattttttcctatttttatagattaataataattgtacatacttatggagtatgtgtgatattttgatacatgcatacaatgtgtaacaatcaaattgggatatttaggatatctattacctcaaacatttatcatttctttgctttgggaacatttcaattcttttagcaattttgaaataataaattattattactatgtcaccttactatgctgtccaacactaggacttattccttctacgtttctgtatataaccaatctctcttcatccctcccactgcctcacacccttcccagtttctggtaaccatcattctactctctatctccatgagataaacttttttagctaccacatgtaagtaagagcgtgcaatattttttctttatgtgaatttattcctgggttttctattctattccattggtctatgtgcctgacttatttcacttaacataacgacctccatttccatccatgttgctgcaaatgacagtatatcattcttttttatggctgagtagtattccattgtgtatatatatgccacattttctttatccagtcttctgttgatagacacttgggatgattgcatatcttggttattgtgaatagtgctacaataaacatgaaaatgtaggtatcccttcgatatactgatttctttgttttgtatttgcttttttaaaagtaatttttatttcaatagtttttggggtgcagttggtgtttggctacatggataggctgtttagtggtgatttctgagattttggtgtacccatcacccaagtagtgttcactgtacccaatatgaagtcttttatccctcatcccctttccaaccttccctactgagtccccaaagtccagtatatcattcttatgcctttgcatcctcatagcttagctcccacttataaatgaggacatacaatactggttttccattcctgagttattttacttagaataatggcctccagctccatctaacttgctgcaaagacctgattttgttcatttttatggctgagtagtattccatggtctgtatctaccacattttctttatttacttgttgtttgatgggcactttggttggttccatatctttgcaattgcaaattgtgctgctgtaaaaatgcatatgcatgtgtctttttcctacgtgacttcttttcctcttggtagatattcagtagcgggattgctggatcaaatggtagttctactttttgttctttaaggaatctccatactgttttccacagtggttgtaccagtttacattcccaccaacagttctaaaaatgttcccttttcaccacatacacaccaacatttattgttctttgaatttttaattatggtcattcttgcaggagtaaggtggtatctcattgtggttttgatttgcatttccctgatcattagtgatgttgagcatctttgcatgtgtttggtggctgtttgtatgtcttcttttgaaaattgtctatatgtcctttgtgcactttttgatgggatttggattttttttgatggtttgtttgagttccttttagattctgtatattagtcctttgtcagatgcatagtttgtgaatattttctcccattctgtgggttgtctgtttgctctgctgattatttcttttgctgtgcagaagctttttagtttaattgggtcccatttatttatttttgtttttgttacatttgcttttgcagtcttattcatgaattctttgcctaagccaatgtctagaataagttttccaatgttatcttctagaatatttatggtttcaggtcttaggtttaagtttttgatccatttgaggtgatttttatataatgtgagaaatgaggatccagtttcattcttctacatgtgacttgccagttttctcagcaccatttgttgaatagggtgccctttcctcaatttatgtttttgtatgctttgttgcggatcagcacttacttaatatattkggctttctttctgggttctctattctgttccgtcggtctacatgcctatttttatacccctaccctgctgttttagtaactatagccttgtaggataatttgaagttgggtaatgggatgcttccagatttgttctttttgcttatcttgcgttagctgtgaggccccttttttggttccatgtgaattttaggattattttttctaattctgtgaagaatgatgatggtattttgatgggaattgcattgaatccgtatattgctttgggcagtatggtcgttttcacaatattggttccacctatccatgagcatgggatgtgtttttatttgtttgtgtcatctatgatttctttcatcagtgttttgcagttttccttgtagagatcttttacctctttggttgatatactgatttcctttcctttggataaacacccaatagtgggattgctggagtgtatagtagttatatttttagctttttgagaaacctccatgatgtgtttcatcatggctgcactaatttagattcccaccaacagtatataagcgttcccttttctttgcatccttgccagcatttgttattttatgtccttttgaaaatagccattccaactagggtgagctatcttttatttgcatttccttcatgattagtgatgcaaagcattttttcatatacatgttttccacttgtgtatcttattttaagaaatgtctcttcagaccctttgcccactttttaatgggattatttgggctttttttttttttttttttagctgttgagttgtttgatttcctgttatgttctggatattagttccttgttggataaatagtccgcaaatattttctctcatactgcaggttgtctcttcactctgttgattgttttctttgttctgcagaagatgtttagtttactgtgaccccgtttgtctatttttgtttttgttgcctgtttttgaagtcttagccataaaaatctaatgtcctgaattgcttctcctatgtattcttctagtagttttatacttttgggtcttatgttttagtatttaatccgttttgagtttatttttgtatatgtagtaggggtctactctcattcttctgcatggatattcagttttcccatttgttgaagaactgaatgctttttctatgtctactgagatgattcatatggtctttgtccctcattctgttgatgtgatgtatcatatttattgttggtgttgaacaatccttgcatccctgggataaattccacttgattgtggtgtattgtctttttaatgtgttgttggatttggttagctagtattttgttgagaatttttgcatctgtgttcatcagggatattggcttttagttttctttttattttttagtgtgtccttgtcttgttttgatttcagggtaattttggcctcatagaatgaattaggaataattccctcttctccaatttttttgaatagtttgagaagaatttttgttagttcttcttcatgagtttagtagaattcagcagtaaagccatctgctcctggtcttttcttaacttgagacattttattaatgattattactaatttttattctgctcaggctttctgtttcttcctggctcattcttkgtaggttttatgtgaccaggagttatccattttctctaagtttttccatttgttaaaatatagctgtttataatagtctccagtgattctttgtatttctgtggtaccagttgcaatgtctcctttttttttttgtttctgattttatttacttgaatcttttctttctttttcttggttactatagctagcagtttgtcaattttacttatattttcaaaaaccaacttttcatttcatcgatcctttgtactttttcaagtcttgatttcctttagttttgttctaatgttattacttctttccttctgttaatattaggtttgatttgttcttgcttttctagttccctgaaatacatcattaagttgtttatttgaaatctttctacttttttgaggtaagcatttattgctataaacttccctcttggcactgcttttgctgtatcgaataggttctggtatgttgtattcacatcttcatttgtttccagaaatattttaatttccttctttatttcctcattgatgcaatagtcattcaggggcatgtggtttaaccttcatatatttgtacagtttccaaagttcctcttgttactgatatatagttttagttcattgttgaaattcccaactgatatggtttggctgtgtccccacccaaatctcatcttgaattcacacgtgttgtgggagggactcagtgggaggtaattgaatcatgggggcttgtctttctcatgctattctcatgatagtgaataagtctcatgggatcttatggttttaaaaacaggagtttccctacacaagctctttgcctgctgccatccatgtaagacatgacttgctcctccttcctttccaccattattatgaggcctcccagccctgtgtaactgtaagtccattaaacctctttattttgtaaattttccagtcttgggtatatccttatcagcagcgtgaaaacagactaattacagtaaattggtaccaggagtggggtgctgctgaaaagataccccaaaatgtggaagtggctttgggactgggtaacatgcagaggttggaacagtttagagggctcagaagaagataggaaagtgtgggaaagtgtggaactccctagagacttgttgaatagccttgaccaaaatgctgataatgatatggacaatgaaatccagactgaggtggtcttggatggagatgaggaacttgttgggaactgaagcaaaggttatgttttagaaaagagactggtggcattttgcccctgcccgagagatctgtggaactttgaacttgaaagagatgatttagggtatctagtagaagaaatttctaagcagcaaaacattcaagaagtgacttcagtgctgttaaaggcattcagttttaaaagggaaacagagcataaaagtttggaaattttgcagcctgacaatgcaatagaaaagataatctcattttctgaggagaaattcaagctggctgtagaaatttacataaataatgaggatcctaatgttaatccccaaaacaatggagaaaatgactccagggcaggtcagaagtcttcatggtagcccctcccatcacaggaccagaggcctaggaggaaaagatgttttttttggccaggcccaggtccctctgctctgtgcagcctagggacttggtaccctgcatttcagcagctccagccatggctaaaaggggccaaggtacagcttgggctgttgcttcgcagggtgaaagccccaagccttggcatcttccacatagtgttgagtctgtaggtacacagaagtcaagaactgaggtttgggaacctcttcctagatttcagaggatgtatagaaatgcctggctrcacaggcagaagtttgctacaggggtgaggctgtcayagagaacttctgccayggcagtgtggaaaaaaatgtggggttggaacccaayacagaaaccctacttcagcattgtctagtttagctgtgagaagaggaccaccatcctccagactgatagatccactgatagcttgcaccatgcacctggaaaagctgcagacactcaatgccagcccatgaaagcagccaggaggggggctataccctgcaaagccacagaggcagagctgcccaaggccatgggagcccacttcttacatcagcatgacctggatgtgagacatggagtcaaagggcaccattttggaatgccctgctggatttcggacttgcatggggcctgcagcttctttgttttggccaatgtctcccatttggaatgactgtatttacccaatgcttgtacccccattgtatctaggaagtaactaacttgcttttgattttacaggctcataggtgaaaaggacttgccttcactaagatgaaactttggactatggaattttgggtaaatgctgaaatgagttaagattttgggggactgttgggaaggcatgatttattttgaaatatgaggacatgagatttgggaggggccagcgcagaatgatatggtytggctgtgttccccacccaaatctcatgttgaattctcatgtgttgtggrggggacccagtgggaggtaattgaatcaygagagtggatttttcttgtgctattcttgtgatagtaagtctcacttactcactcgtgatagtgagtaagatctgatggttttwaaaagagaagtttccctatacaagctctctctcttggcctgctgccatccacgtaaaacgtgacttgcttctccttgccttctgccatgatggtgaggcctcccagccatgtggaactgtaaggccattaagcatctttcttttgtaagttgcctagtcttgggtatgtctttatcagcagcatgaaaatgggctaatacaccaactattgttgtactggagtctgtctctccctttatatctgataatatttgttttatatatctaggtgctctgctgttgggtgcwtgtatgtttggaattgttatattctctttctgaattgatcccttcatcattatataatgactttctttgtctctttttacaggttttaacttaaagtctgttttatctgatataactatcactattcctgcttgcttttggtttcatttgcatggaatatatttttccatccctttactttcattctatatgtgtccttacagatgagatgagtttcttggagacagcataaaattgggtcatgctttttatccattcagcttgattatatcttttaagtgaagactttaatctgtttacattcaaggttattattgataaatgaggaaatattcctgtcaytttgtaatatgatttttggttgttttatatatcatttgtctctttcttccttttttattttttatcattgtggtttagtggttttctttagcggtaatgtttcacttctttktctttctcatttgtgtatcttacttttatactttcatgtgtttttatkatggtagagattatccatttgctttcagatgtaggattccgttaagtatttcctgcagggctgatctagtggtgatgaattccctgtttttgattgtctgggaaatactttatttctttcatttctgaaggacagatttgctaggtatggtattcttagatggcagggttttttcttttggcactttgaatatatcattccattctcttctggactgtaattttttgctgagaaatttactgttagtcctaatcagacttgtatatgataatccccttgtatatgacttggcactttttctgtttttagaattctctctttgtctttggcttttggcagtttgcttataatgtaatttagagaagacctttttggattatgtctatttgtgagtttttgtgcttcttgtacctggatgcctaaatctcttgcaagatttgggaagtttttaagtattattctgttaaacaggttttctatgttgttatctatctcttgcccttctggaactgccagaattagaatttttttctttttatggtgtcccatatattatctaggcttccttcattcttttaaatccattttttctatttttttcttttctcttttgtctgactgagttattaaaaaaaaaacctgtcttcatgttcagcagttcttttctgtgcttggtatactctattgtagaagctcttgattgtattttttatttcatttattgaattcatcagttccaggcctttggttttgttctctttggatatctgtctctggtatttatcattcagctcatgaattatttttgatttctctgtattatttatctgtgttttcttgtatctcactgtgtttctgtaatattattctctggaattcttttttaggcattttataaatttcctttactttgggatctcttactggataattattgtgtttcttttgaagtgtcatgtttctttgcttttttgtgttttttgtatccttacattgatttcagtgcatctgacataacaattgcttctgattttatgcattggctttcatggagaaagactttttcctgtagataatctatagtgttggttgggtaaagtgctttggttttgattctggttgggcacggtagtatagtctgcatgatttctttggctgtaattagcatcagtgttttctctgagttcctcagtggcttagactgcagttgttaatggatgttgtggtgaggctttgctggagatgggcatgccatgcaggctggtccttgggtaccagtggtgttggtgaggcatgcctgtcctcaagtccctgatggtggatgcaggtgttagctgtggcaggtacggttaggactgatccttagacccccacacagtatgctcgggtgcaagcaatcatggtggtgggtgggatcggcttgtctttaggccccagatgatgtacttgggtgccatcagtggtggcagtggatagggtagccctgtcttcaggcccctggatggaacatgtgggtgccagtggcagcaagagggatgggttgatttccaggttcttggattatgtgcacagataccagcagcagggaaagtgagcctgtcctcaggccccctgatagtgtggggaggtacgagcaacagcaggtggagcagattgatttaagagttagctcagtgttggccagacttggtggctcacgcctgtctcccagcactttgggaggctgaggtgggtgtatcacgaggtctggagttcgagaccagcctggtcaacatggtaaaactccatctctactaaaaaaaaaaatacaaaaattagccaggcatggtggcgcttgcctgtagtcctagctacttgggaggctgaggcaggagaatcacttgaacctgggaggcggaggttgcagtgagctgagctcgtgccactgcattccagcctggggtgatagagtgaaactccatctcaaaaacaaacaaacaacaaaaaaacaaaaaacaacaaaaaaacaaaaaacaaaaaaacagagttagctcagtgttttatgatttataaatattttcttaattttctaggcatttgtgttttgattttttgttatgaaatactttttatttctatttttattagtcaaatttatcaattttaatgggttctgagttttttgacagaattagaaaatctttattgctctgagatcttttttataaaccatctcattttttaatggtactttaagggttcttatgtttaaatctttaatctgtctcagatttattttggtgtaaggtgtgttatatatatctagcttaatttttcttcrattagttatcaakrtttttttgtttttatatcactttttgaagttcattttttccgatgggattcaaatatacttatsacattaaaattttctaactatatttgtgtctatttctgggttctctgttctgtttcattgatctatttttctgtttacaaaccagcaactcaccattttaaataatagctttacaayaggtttttatatcttgcattgctaatcccgatcatttgtgttctttttcagaatgtttcttgttattcttatttttcctgtgaacttcagaatcaaatcaatttcttttgtttcaaatagtgttaattgtgtgtgtgtgaatatgtgtgaacatattaaatttatagaataagtcaggtagaactgacatctttaacatttagagttttcttatccatcaatatccctcacttttccatttrtttaattcttgtgggtccatcagtaacattaaaagttttattcacatatttcttgttatacatttttctagttactctataattttggttgctacttttaatgcaatctattcttactttggatctcctatttgcrttgttygtatgtatgaaaagtagtggtgtcacaatattatttttgtattcattcacttaactgaattctgtcattatttatagttttccagttgattctcttgtgctgtccaggtaaataatcatatagtttccaaataatgatattttagttttatctyttawaattttacctgcattttactgtctagttatgttattcaggacctccaaaaaattaatggtggtcatagtagacactcttgtcttcaacttattgttaataagaatactaataatagagttttcattaagcatgacatgctggcttttgagatgcaacagagatattttgtcatattaagagaggaaacccttttttcttrgtatagtacatgataaggrtttttgtcaaaaataacgttgaattttatcaaaagccttttcataatttattgagatggtattttagttttctctttttattattaacatggtaaattatattaatagatttattgttatacattattcttttatttggtgcataaacaccacttagtaatggtatattatactttaatgtgatcctggattctatttgcaaatactcacttagggtcttttttcatgatattcacaagtgagtttaggctatatttttattttttttctgtgctttttattgtggatttatatgttataaatatacatttgaagattttctttttttttcctatgctctacaacactttgaatggcattaaagttaggtgtttcttaaaaatttgtcagtattccgctagtgaaaccaactatgtgttgaactattttgttgggagtaaattgacaatttgtcctccttttaaaacmgatagtgatatgttagattttcaaatttatctgggatgtgatttcttagaaaagcatcttaattctcaaatttactcacactgaattgatcaaactggtgttataggagtcttttaattttttttgtttctgggatcttcctcattgtttcttgttctttgtatttgtattttctatccttataattaaaaatgttytggcgagttaaaggttttgtttcgtgttatttctcctcctccacccatgaaacatctgttgggtttacttattctttcacattccatttttcttttcttttcttttcttttctttctcttctcttctcttctcttcttttctttttttctttttctttttctttttttgagacagagtcttgctttgtcacccaggctggagtgcaatggtgcaatcttagctcatcacaacctccgcctcatagattaaagtgattctcctgcctcagtctcctgagtagctgggattacagacgcacaccaccactcctggctaatttttgtatttttagtagagatggggtttcaccatattgaccaggctggtcttgaacttcgcctcatgatctgcctgcctcggcctcccaaagtgctgggattacaggtgtgagccactgcacctggccacatgccatttttctaattcattatttcactttttatgtttattaatttctttttttctattttcctgtttttcattttattctaacttcttgartgcttatattatctctttcattctttcttgkttattaatatttcagctatatcacctagataattgtatattgttctttcttcgattgttatttcccagatatcctataatttcagttttgattttatatttgatgcaaaacttaacagaattttaaaatatcctgatagtagattattttcattttctgggtttgttatttttaagttttattacattatgagcacagatgtatacattgtttttcctttttgaaaactgtcaaagtttttttttgtttgcaaatgggcagttttgtgaatgttccatggaaacttggaaagaaggtgtagtctctatttttagagtaatgtatatcacttaattttatttaggttttccatattctgaaaaaaatttttttttgcttattctgtcatgtcctgagagaaaagaaagtttcctattgctgagattttattttctaatttaagacttctgttttctgtaggtttttctttattgatattgcttctgtattactgggtaattagatagtcataacatttaatctacattttgtattgtgccctttagcattacaaggtgtttatcttttttcattgaacatatactatgctgcattaaaacccatctgatattaataccatgaacgttattttctttttacttgctcttgcctgttgtaatctttgcctttccttttattttcaacccttcttggttacttattgatttgtcgtattcttgtgtgcagcagatatttggattttgctttgaggcccacctcatttttcttttaatgagtatgtttaggccatgtgtagttgtagaaataagtgtttacttttaattctgtcattatatcttatcacactttgttcacagtatggactatttctgctttgtggggcgtgtgtgtattttctgatttggaagatttgtaattttatgctaccagttactttataattatatctttatgtgactctctatttcctactattagcatagatgaacttggcaatttccattttcttccttctactcctactgcaaaattgacggtactatatttcttcatgtatgcctctttatatttcaatgtactgtaattctgttgcttgacttaccagttttaaatgatctcttttgattgctagtatatcaattagaatattttcattgataagtaactgaaaagccatctagtggttgcttaatcaattaagacaattgctaccttaataataatgttaataagtccagaagtaggatagttctagtatctcaacaatgtttttagaatccagtttttccatatttttcttgaccattctcagcatgtaggctcttaacctcattgttgtttcttcttggttacatttataggcatgaatttatcctatagcagcataagagacagagaaaaatgctgtttatcttctcaaatttcttcataagaactgagaaacaaatgtctgctcatgactcattggacagaattgaatcacatgttcatgctaaaaccagccaacgttaagagaaatagatttcccaagactagcttatgctaatcacaaatcattctgtggagctggggagaacctcctagttctacaatacagaagcagaaaaggataaatttgtgtaggtctccagtggtgtctgctacctctgtctctataaaatgaagaaatcagcagaaatatactgccaccaattttcttgcccccttgctgtgtcaagttttgttaattacacattgttacatgtcaaggcttctaacctattcattctatcctgtaaccataatgtatttgttttggtcttcgttmtagagaattcagtacaactattagtcattttgccagagatttatcatgcatttcttgattgactgaagttaatgcactagcaatttcttccagaaatggaaaaagggaagaagggaaccaaattctgtggattattgcatgttaaaaaaagtttgtcagcagtcattgtacttcagcaacagttcgattggatataaaattttttcttatttccttgaggacttttctctagatgggaaaaattatgtattgaaacctgttccttccattgttttgattacactttttggggacactagttgtacatatgcttgatttccattttctctctcttcctggccttttggctaacatcaagtgtaattgatttccattttctgtatatatccttttttctataatcattaaaaaattttacttttgctataatcctttttaacttggttattyacattttattctgatcactttttaaatttgtgtccttcataattcttactttgttttcagcagcatttactctgtttggattgtctccaatatgaccttcatttctctgatggttttatttttctctcctgtttatgagctctgccagtccaatcatcatctccttgtattgcctygccttattttacttgggctcttgtatacttagtttgcatttttaatttatagaggtatgtgcttatttttttgtttatatcattatatttggtcacaatttttatctgttctgtggcaatattttttggatgccactttcctctgttccctattttctccttttgtggctcttatgcaagttattccttttaaaaaataatcatctctaactgaggcacattttttctggatcagctacctgtaaaaggtttgtgtgagaggggcaccccattgtgttctaggctaataacaattgtccttatgatttaatgagtatttttttwaatttagcttttactctcttccccattgccttgccttcagacagatttctgaaaatatagcttatacatgtgatttgttattcagtctcagttacttgctttctttagtgccaagttgtgtccaggaaatctattgccaagttatgcaactactatcattattcctaacaagggattgttagtttttctgttaggatgtgatgcttactttggaagattgttttctgctgtagccatatgtagtttcttttgacatcttcttgcaactccgtttgagctgtgatacaaagtttacatgcccagtgcaggggaaatgatgtgtgtctgccrcttttgagtgctatgattgttcacttctttagattctcatagtctgtcctgataattgcaggaattagaaaaggctggcctagagtcctttcctcacctatgactttagggccacattatggcttccttttcccatttcatgaaaatatgactacatctatggtcttttatgaaaaacaaagtaaaatgccctgctagcaactggcaacccaaatccaagaggtaaccagattttctttaggaatataagtttttccaaggcaatatccatgtgtgagacatctttggaagaataaatgtacagaarttggttgtattagtttcctagggctgctttaacaatttaccataaaaccagtggcttaaaagaacagatatttattctttcacagttctgaaaagctgaagttctaaatgaaggtaacagcagggatgctgttccttcagaggttctaggggaagaattcttccttgcctcttccaggttctagtggctccagatgtttcttggcttgttgctgcataactctaatctctgcctcagtctttatatggctttcttccttatgttctgtcttctcttctgtctcttataaggatacttatcattgaatttagggcccatccaggatgatctcatctcaagatctttaacttaattatatctgtaaagtccctttttttgaataaggttatactcatcaaaagtactaggggttaggacatggatgtatattttgggggaccattactcaacccactccactagtgtttctgtgtcatctctcttcatacatttaacagttatatatatagcaatgtctttgtgagtaacactgttctgggggtttcagagtattgactatcttttccttaaaatgtttataatttacttgaggactcaagatctacatttggacaataatataagttaaaacaaaaaataaagcggagtcattttggtaactggtgtgagaattccattgctgggaaatatgttcttgatatgatactttgataagcttgggtagaagttagcctccaaagcccagctagtcctcaggtttctttgatgctggtatgagaagtggcttttcggtagaggcaagcctaatggggatttccatgtaaaatgctgttctgtgcactctgacccttccttattactccaaaatatgtccaaaaccatataaataacagtgaaaataggttgagtgtatttcttttggaaatcactgaacaccctgggcattatcaaaacatacaattacatataattaaataagacaataatactattaataagtcatacagttctggaaaacagtaaggtctctctggttggagttgtctctggaaaatgaatcttgagttgaatgttaaaattgggtggaatatgattgagaaagggtattctagaaaggagaatgatattggtaagtgcaggagtgtacctaagacaagcttgagacaccaagtgagtggtctgatcctgctgaattacagtaggctttcagtagaagtgcaagattgtaccttgcttgtaggtgtgtaatagaactattgtgaataaagttgtggttcataataattattgaaccctagggcattaagcaaacataggcagtggtcaggtagttacagcaggccttgggtgagacccagtgctatgctggcttcaggtctgacccagcacagtcccagtgttggtgactgcagggttgcttgtgccacccctctcccagctccaggcagctcagcatagacagactctgtttgtttgagagaaagtaaggaaacagagcaagagtcttcctggtaatccagagaattcttccggatcttatccaagaccatgaaggcgataactctacaagtccacaggagccacagttttactaagctttaggtgtcccctaatgcagatacagctgcaatgaccaaaaacttagaccacaacacccaagtcctttcaaatatttgaaaagccttcctaagaaggacaggtacaaataagtccaggctgcaaagacaacaataaatattcaattcttcaacagccagagaccaatgaacattcacaaggatcaagaccgtccagaaaacataatctcaccaaatgaactcaataaggtgccagggaccaattctggagatacagagataggtgacctttcagaaaattcaaaatagctgtgttgaggaaactcaaagaaattcattgataaggaattcagaatcctatcagataaacttaacaaagagattgaaataattaaaaagaatcaagcagaaattctggagtccaaaaaggcaattgacactctgaagaatgcattagagtatcttaacagcaagaatagatcaagcagaagaaagaattagtgagcttgaagacaggcattttgaaaatacgcaaagtagacaaaagaagaaagaataaaaaagattgaagcatgcctacaggatctagaaaatggcctcagaagtgcaaatccaagagttattagccttagaaaggaggaagggtagggaggggggagagagggagagagagagagtagggtagaaagttcattgaaagagataataacagagaactttccaaacctagagaaagatatcaatattcaagtacaagaaggttatagaacaccaagatttaacccaaagaagactacctcaaggcatttaatagtcaatctcccaaaggtcaagtataaagaaaggatcctaaaagcaagaaaaaagaaacaaataacatacaatggatctccaatacatctggcagcagacttcagtgaaaactttacaggccaggagagagtggcatgacatattaaaagtgccaaaagaaaaaatcttttaccatggaatagtatatccagcaaaaatattctttgatcatgaaggagacataaagacttttccagaccaaaaaaaaggctgagggatttcatcaacatcagacctgtcctacaagaaatgttaaagggaattcttcaatcagaaagaaaaggatgttaatgaggaataagaaatcatctgaaggcaaaggactcagtggttatagtaagtacacagaaaaaaatggaatattataacactgtaattgtggtttgtaaattacccatatcttaagtagaaagatgaaaacatgaggtgatgaaaaataataaactgcaactcttcaagatgtaggcaatacaataagatataaatagaacaataaaaagttaagaagcagggagacgaagtaaaagtgtagagttctctttttgcttgcttgttagtttgttaatgcagtgttaagtcaccagtttaaaataatgggttataagatggtatttgcaagcctcatggtaacctcaaatcaagaaacataaacaaatacactaaaattaaaaagcaaaaaattaaaacatagcaccagataaaatgaccttcacaaaaaggaagacagaaaggaaagaagggaggaaggaagagaagaccacaaaacaaccagaaaacaaataataaaatggcaggcataagaccttacttatcagtaataacgtttaatgtaaatggacagaactctccaatcaaaggacatggagtaactgaatggtttaaaaaaaaaaaagacccaattatctgttacctgctggaaacacaataaagaaatatcagacttaatctgcacagtagatcaaatggacctaatagaaatttacagaacattttatccaatggctggataagacacattcttctcctcagcatatggctcattcataaggatagactatatgttaggccacaagacaagtcttaaaacctttgaaagaacagaaattatgtcaaatatcttctctgactacagtggaataaaactagaagtcaataacaagaggaactttggaaacaacaaacacacagaagttaaacaatgtgctcctgaatgaccagtgggtcattgaaaaaattaggaaattaaaaaaaaattgaagcaaataataatggaaacacaacataccaaaacctataggatacagtgaaagcagtactaagaggaaatttatgtgtataagcagctacataaaaaagaggaaaaacttcaaataaacaaactaatggtgtatcttaaagaactagaaaagcagttttttccaattctgtgaagaaagtcattggtagcttgatgaggatggcattgaatctgtaaattactactttacagtgcatatggaaccaaaaaagagcccgcattgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaatatatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgagagaaaattttcgcaacctactcttctgacaaagggctaacatccagaatctacaatgaactcaaacaaatttacaagaaaaaaacaaacaaccccatcaaaaagtgggcaaaggacatgaacagacacttctcaaaggaagacatttatgcagccaaaaaacacatgaaaaaatgctcatcatcactggccatcagagaaatgcaaattaaaaccacaatgagataccatttcacaccagttagaatggcgatcattaaaaagtcagggaacaacaggtgctggagaggatgtggagaaataggaacacttttacactgttgatgggactgtaaactagttcaaccattgtggaagtcagtgtggcgattcctcagggatctagaactagaaatatcatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacatcatggaatactatgcagccataaaaaatgatgagtttatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagtggggagggatagcattgggagatatacctaatggtagatgacgagttagtgggtgcagtgcaccagcatggcacatgtgtacgtatgtaactaacctgcacattgtgcacatgtaccctaaaacttgaagtataataataataaattaaaaaaaaagaactagaaaagcaagagcaaactgaacccaaaattagtagaagaaaataaataataaagatcagagcagaaataaataaaattaaaattaaaaaatagtacaaaagatcaatgaagtgaaaagttggttttgtgaaaagataaacaaaatttacaaactttagtcaggctaagaaaaaaagagagactacccaaataaataaaataagagatgaaaaggagacattacaaccaataccacagaaattcaaaggatcattagaggctgtgatgagcaaatatgtgccaataaacttgaaaacctaggagaaatggatctcattctagatacaaacaaccacaagattgaactatggaggaatccaaaacttaatcagatcaataacaagtaacgagatggaagccataatggaaagtctcccagcaaaccaaagcctgggacttgatggttccatggctgaattctaacaaatgtttaaggaaaaactaataccagtgctactcaaactagtccaaaaaatagaggaggaaagaatacttccaaactggccttctatgagaccaatattaccctgatacaaaaaccaaacaatgacacattgaaagacaaaaacaaaaaattacaggccaatctccctaatgaacactgatgccaaaattcttaacaaaacattagcaaactaaattcaatgatacactaaaaagattcatcatgaccaaggggaatttatcccagggatgcaagtatcctcaacatatgcaaaccaattcatgtgatacatcatataaacagattgaaaaacaaaaaatcatatggttatttcaactgatgctgaaaatgtatttgataaaattcagcatcccttcatgataaaaactctgaaaaactggatatagaatgaacatagttcaatgtaataaaagccatatatgacagatctatagctagtatcttactgatgaggaaaatctgaaagccttttctctaagatctagaacatgacaaggatgcccaccttcactactgttattcaacagtcctagcaagagcaattagacaagagaaagaaataaagggcatccagattggaatggaagaagtcaaattatctttgtttggaaatgatgtgatcttatatttggaaaaacctgaagactccaccaaaaaagtatgagaactgttcaacaaattcagtaaggtggcaggatacaaaatcaacatataaaaatgagtagtatttctatatgccaacaacaaacaatctaaaaagaaatttaaaaagtaatcccacttacagtagctacaaataaaattaaatacctaggaattaaccaaacaagtgaaagatctctacaatgaaaatgataaaatgctgatgaaggaaattgaagaggacacaaaaaatggaaagatattccatgtccatggattggaagaatcaatactgttaaaatttccatactgtccaaagcaatctgcagaattaatgcaatccctatcatgataccaatgactttcttcacagaaatagaaaaaacaatcctaaaattaatatggaaccactaaaggcccagaatagccaaagctatcctgaacaaaaggaaaaaaatgaggaatcacattatctgacttcaaattatactactgagccatagtaaccaaaacagtatggcactggcataaaaacagttagaccaatggaacaaaatagagaacctagaaataaatctatacatctatggtgaatttatttttagcagaggaaccaagaacatatattggggaaagaacagtctcttcaataagtggtgctgggaaaactggatgtccatatgcaaaagaatgaaactagacccccatctttcatgatatacaaaaatcaaatcaaaatggattaaagacttaaatctaagacctaaaaccatgaaactactataagaaaatattgggtgaaactctctaggacattggactgggcaaatatttcttcagtaataccccacaagcacaggcaaccaccgcaaaaattgacagatggaatcacagtaagtcaaaatgcttgtgcatagcaaaggatacaacaaagtgaagagacaatccacagaatgggagaaaatatttggaaactatccatctgacaagggattaatagccataatatgtaagcagctcaaacagctctataggaaaaaatataataatattatgaaaaatgggcaaaagatgaatagatatttctcaaaagaaggcaaacaagtgttgcaaaggtgctcaacatcactgatcatcacaatatgcaaataaaaactacagtgagatatcatctcaccccagttacaatggcttttatccaaatgacaggcaataacaaatgctggcaaggatgtggagaaaagggaacccttgtacactattggtgggaatgtaaattagtacaaccactatggacaacagtttggagttttctcaaaaacctaaaaatagagctaccataagatccagcaatcccactgccagctatatacccaaaaggaaggaactcagtatattgaagagatatctatgctcccatgtttgttgcagcagtttttcacaataagcaatatttgggagcaaactaagtgtccatcaacagatgaatggataaagaaaatgtggtacatgtacacaatggagtactattcaaccacaaaaagaatgagatcctctcatttgcaacatggatggaagtggaggtcatttatgttgagtgaaacaagccaggtacagaaagacaaacatcacatatttccacttatttgtgggagttaaaaagtaagacaattgaattcatggacatagagagtgggatgaaggttaccagaggctgagaaaggtagtagggggctggtgggaagtgagaatggttaattgctacaaaaatatgtttagaaagcatgaataagacctagcatttgatcgtacaacagggtgactatagtcaataataatttaattatacatttaaaaataactaaaagagtataattggattacttgttacacaaaggataaatgcttgaggtgatagatactccacttaccctgaagtgattatacacattgtatgcctttatcaaaatattttatgtaacgcatatatatatatacctactatgtacccacaaaaattaaaactaaaatcccaaaataatataaaccacagtgtcatatttgtgcttcactgcattcaaacaaattttgaaacatatggtactgagggcccaagctgaggacaaagagacatcaagcacacctattctaaagtgaactataaataactggggtcagacacctcccccagagatcagtgagaggtggccaaactgtccttatcactctaaactgtcacccaaggcctttcctatcatttcccaattgataaaagaagatgtggggtagagaggagaaagaagatgacattgttacatttgtgagtttcttgccaaatgttgtgtttccctccctttcccgtgggggcttcctgcctacttcaaagccctgtgaaaagtggactactagacaagagcctgggagtgtcaacaggagactggcttctcactcctggctagatgttgcatgaggtgaggcagcagaggcttagcttggtgaggttgttagcatgaagtgaagtatggtgaaggaagaaaaggacctaccatgggtccttgatgtgtgggggcatgtatgtacttggaaattgatgccttctgcttgcgtggctgcactactctgccaaggctgatagacaatggaccgcaggtaagatgtctaagaagaagacagagaaaatcccccagctcacttagaaggtctggaggaggattttcatggttcctatggcttgtcagaataagtctagcaggtagaatgcaaggcatgagtttgggaactgatcaagtggcatctagttatgagataccccatttggtgagagggttgagtgcgtggaccagtgactgagacacaaaatggagatgcagttgtctcttgttttgagggcattctcagtcatgtatagtgctggcttgaagcagaacatctctccaagtaaactgcatgcaccttctgggtagatagcaccacattggtaaagaccaccagcatcagaaagaaccagacctagctagaagggaactcgaaacagctgcccacttcttccagacagccagtctcatatgtcaacctctgccacatctgaaatttctctcccactgctctaatgcgtgggtggacttacagcctgraagctggaggagggaggaggtacagaggacacagagaacatctctttccttcctgaaggatggagggagaaraactttccccctgtctgctccaggcctgacctgaagcttggctggccccagggagagcaaagaagagctttatactagctatgaaactggaatttaaaatatatttgagtcttaaatactggaattagactcttctaataactgaaagtgattggaattttgtggaatattcccagatgttactaagggatagtgaaatatgattcaatgtaggacagctgtcagcagggattgggaaaatgaaaccattttaagtttattttacatcaaatacagactgtacaataacctggttatatacaatatagtggaaagaaaatagattaagtcagactgacttgggtttgaatccttgctcagcaacttactttccacatgatttttggcaaattactttcaatagttttcttaactgtgaaatggggataggcagtaacatcattcttccaaggatttgggagaagattaaatgaaataaattctaggaagcgtctagtgtgatgcctgagacatatagacctctgaaatggggattgattattacagctggagacaaatctggtaaatcaaggactaatggctgatgtagctatcaaatgtaatttgaagtagttagatgggtgggatctgatgagtatttgatgttttctaaatcccaaactatctttttcaatgaagtcaatgcattttcaaagcatttttctgcttaatttggaakattaaatgtatctaactggaagcgcatactagaaaagcatgagaaagggcttcttgtcctgatcagaaagatgaggaggctccgaagagatctgaggtaggacttctgccagcctcaaaatgtgccacacacatttaactgggaagatgctctgaataacatactcttggccatgtgaatgcgttccttggcagccctggccctgcaaagtttggcaggaggggattttcgggttgccagctaaagccctgacactcagagcaggcctcagtgtctctgttcccaaccctgtccccatccctaactgaaggaacttttgtttgtgcaatagctgttgtatctcactcatcccttctactaattggctctgaccctaactttccatattctccagcttggagatgcctgtgggaggtttgctttgagaaggccccagctttggcattgtcagtttttcatctggctcctmatctatttcactttgtctcaagcttcccttctttggtgacccactaaaaactgaagttgtgctggcaagatggtgctttgttgtcatggaaagaggctgtttgcagaactgcggggttaacaagaaggcttctttggcctgtggacggttggtttgtctttggcagtagccagttggagtacagcagggaggcatgttcattccagaagccgtctagtcttcagttgaaggaagtgccatcttaattttgaagtgagagcaacttacatctagagcaaactctttgaaggagggggatcttccaatatcccgtgtgggcctcccgaaggcccgaggcatagacaacaaggaagcaaggaagatgaggaagaaaaggggtgggtagagaaagggagaataagagagagaaaggtgaacgaaagctacagctgctgaatcctcttctgtatccatcacatgtttttactgaaagtttaagataatatcccattgccttatgtttatttgtttattttgatagctaacacttaaatagtgcttactacctaccaggtgctgcattaacactatatatattaagtcttttaagcttcaccacaaactcatgaggtaggcgatggtactatgtttatttcaagatggtaaactgagacatggagccattaagtaacttttctaagatcacacagctagtaagtggtagagccaggtttcaaatgcaggatttatattttctcttccctttccttcctgtccctccctcccctttctccttctgtaaacaagtgtcttctttgaggtgtatttagtgtcacatattttgcatttttgtgctttttttgggggggttgtgattttgctgtttaaaatggcccccaagtgtagtgctgaagtgttgtctagtgcttctacatgcaggaagattgtgatgtgccttatagaaaaaatgtgtgtgttagataaccttcattcaggctttagttgcagttctgttggttgtgagtacaatgttaatgaatcaatagatagatattaaatatgatatttaaaagaagcatacataaaacaaggttatgtcttcataagttgatgaaagtgttatgaccagaggctcacaagaacctaactctgtatttcccaagaagccatgattcaataatctctaattcagtgtttgtgacaactttatagaacataactccatgaataatgagactttgccatattttttttggcaaagattataataaatatgtcttgccacctaagtttagcttgatgcacagtcttctaagctatgtggccatttgctaagaaataccactatatatgttttgtttcttcagttcataaaatctcatgcacaatatcttatgtggtgcctgagaaatagtcagtgctccataaatgcttattgaatgaatgattaaatgaatgaaaaaagtaacactcaaaatttacaagataatctagtctagtactttacattttaagaaatacatgaatggacctggaactaatgtgtgtgtgtktttttctttttaagtaagccatataacctatgaggcaagcaagttgttctaattgccttctggttgattacatactatttgttgagtactagctactgggattttcaaaatggaattttgcatagtttatttccctcaatcctacctaataagattaaggtccatctgttttgtataagagtccactgtttacttatcaagagtgctttgataaacgaagaggttatcagccacttgtatgggtatcctatactctgtttggctatagtgaggttaaaaggtcaagaatctgtaaggggattcttatccatgaggatattatgtatgcctagggaccatggaagtgaagttttgtttcatttattcatctattcaacaaatattttgaagacgtgctggtgatataatttggaatacaaaaatatgatgtccctgagattgttctttggcatcttggaaaatagtcctatgtagaaagcaacatccttcatactttcagttcttaagtattcatcaagcacctattatgtcccaggcactggggatatagcagtaagacaaagcccctaccctttgaaacttatattccttcaggaagaccaagcactgaacaacccatttgaggtaatactctcccctttggcccggattctgattcagctgctctttatttattatctccatattatgtgaaattatcttgcctttttgctcatttgcttattgtctgtctcccctcatgacaaatgtagctctaaaagagcagaaacttcgtctttcctattgctgaatgtccatcactgagaatagtgtttgatccaacagtagatgcttaataaatgttcgttcttatttaattatagttatggtaatgctaggaagtgtatttctggagattttgaattagtatggacaatcaggaatactcctttaaggaaatatggattgagttgaactttgaaggagtaagcagcaactaaatggagcaaagagtatatattctaggcagagggatcaggtcaaagaatggaacattagaatgtgtgatataaaattgatatatctggagttcaagagtaggagagtatattaggtgagtctagagaggtaggagagggcaggatagtcagggattaggaggctatatagggatttggagttttatcctaagagcattgggaagttattaaagaactacaaacaggaaatcaatctgttgttctgtggatgggagagagactactgagtggatagtgcaaccattcatggtcttgaagattaggtgttcagtctgggaaatctttgattcaaagtacctgtgaaacatccatttggaggtattaagtagacaattggctatacatatttttgggttcagagaaggaggtctgaaatgaatacactcatttgagtgacaacactgtgaatggtgtttgaagtcaagaggactgatgaaattgtctagggggagagtgtagagtaacaaaaacagagggcttcattcaggctaatctttgaggaacttcctcttttaaagatgataaagaagggtgaacaggaaagaatcttaaaagcagaaaagtttaaactaaactatctatgcttatttatatggcctttctgagtggttttattgtcaattgcccaagcatatctctctaataagactctatttaatttaccatattttaatcacttattttcttgtctttttcttctattgtccttgagagtagagattttgttctttaaaatcatgcttgaaaccctagtgcctagcatgcttccagcttaataggcatgaaatatatctgttattgagtgggaatacagagctttcttaggaaagatgagcaagagcggaaagcagatttttcctcacagcctcttctatgtgggacaccataaacattttattttaagccttttgtctataactgtgaaatggtgatttaggtatcaggaagcagatgggaaactttttgaggggtagaggcatttaaattctgcatctgtggtttctttgcatggatttgctcctacccctagacctgtggctgctaaaagttatttccagaagctgttgcagccaagagtctggtgtctacttcatcactttggaggttggcctgcctaggtctcccaatagtccctttccttctattccctctctcttgactatctgtttcccatttcctctaactttatcccaattcctctttgtccaaagaatcccagggcatgtttcataattataggcattattttactcaggatttattaacattttgtacagttatcacctttccccatttttccattatgaaatacatttttttatctcatataatttttacctttgataatgaagtgtgtatattctctttgataatggatctaatgataatgtgaccagtgtgtgaagatcagtgggccttcctctcctcccagttactccacattctggctaggtgcctctgctactaatagcttagcctgctgttcccatgtttgaggattgattctttttcctaggctgaggcaaacagttgtaatgttaaaggcttgctgacagcctgtctttgttgcctggaccgtgttttaatacgtgatctttgctgcctgaattttcttttttctagactacttgatttttcttgacctgtggaattttatgattacttgatttgtgaatttatctcaagcccctggttttgaaccaatgactctattattttaagccaggtgtattgtttttttagcctgtgtctattatactgtgtgttgcttcttatattccctatatctaagtaacttggctgactgggcattttgttaactttggggaggaaaagcatcaacatgacctgcatagggctggagaagagtgcagttagcccttgagggttgggggtgaatgtgttaagggtattaagggtggggagatactgctaagttggaraaaaactttcagcgaatttcactgatttcaaatcaagctgaatttgaagttcttgtctacatgagtgaacaatttttaaaacatttgaaggcatgcatttaaagtgacagcttaatgttaaaatgggaagttatgattcataagcagtagtaaaattttgaataacatgactttattcattgacagtaactgctttacattttccggtttcattatatcagtactgtgaataaaatccagaaaagttatagaggaggaaatgactttgagtttttattcaatagtcattacttacgtctttccacatttttttgcaaattttaagtttcagtaatgatcttgctattcaaattttctatttcttacaaccataatcttctagaatagccacaaaggtaggagtaagctgaagtaaaaagcctgtaggtcagtgtaaatgcctttcataaagcccacagcttgattcagtaaaacccagattgacgtctcttttcttatgataggcccagaatttatttgatttagttatatctatgacattttatttattttctcctggcaacatatagtttccacttttgatctaggggaaaaaaaggaggcttatagctgtaaaaatagccctgtacaaagtaatagaccctaaagtataactgtgcagagacaatgaagaaacagatcactgttgcttagtaggaatttctgcaatgacagaagtttttctatgcactgcccaatacagtggtcactagccacaaggagctgatgagcactggaaatgtggctattgaacctaagatactgaaatttaattttaatttcaatttaactaacttagtcacatgtggataggagctactacactggcctagtgcaagtatctacttcaagcttgtccaacctgtggcccaggacagctttgaatgcccacacaaattcgttaactttcttaaaacattatgagattttttttttcctaactcatcagctatccttagtgttagcatattttatgtgtggcccaagacaattcttcttccagtgtggcccagggaagccgaaagttgaggcacccctgatctagatcattgtattaactttctactggtattacaaaaaaattaccatggacttactggcttaaacaacacaatttcattttaatgaatgaatgaatgaatgaatgaatgatttttttttttggcttaggacaacacagatttattattttgtagttctgggagtcagaagtccaaaatgggttttacttggcaaaaaataaagtgccagtagagctgcattccttctggaggctctaggggagaatctgtgtccttgccccttccagcttctgaatgctgtctatgtttttggcttgtggctctttcctccatatttaaaggcagcaatgaccagtcaagtattgtcatattgtgtcactctkacactcaagttagaaatctagcactgttctcactgggctaaaatcaaggtgccctcagggctgctttattttctggaggatttaggagagagtccattttcttttcctttctagcatttaatggctgcccatattccttagttcatggcccccttcctccatcttccaagccatcaatgttgcatctctctgtccccttcttctatagttccatcttcctttgcctctcttcttctgcctctcccttacacttataaggattcttgtgattacactgagcacaccttgataatccaagatagtctccttattttaaagtcagctgactagcaatcttaaatcccttttgctatagaacctaatatatccgtaggttccaagaattaagactggatatttttgtgtgggccattattctgcctaccacagcttctaaatttggagccatttaatgaaaagacaaggtaagccatatgtgtgtgtgtgtgtgrrtatatatatatatatatatacattgtttgttgggcctatacctatatttcatccaacacagtatagggtctcaaaataatttaagaacaatagaaacttaattttaaaagaggactgatatgatatctgctccaatcttctatcccttgtagttttattctcttctataatagaatctctagtttattaattttctgtcattagtttcctgtgaaggatactccctacttaacaacaaaatcagctgcattgttgtatagctatggttgttctagatcatcctatcacctagcctttacaatcaccacagagtagcacgttggtttctgacttttggaacaatgttaacctgctttttcrcagagttacgtatctcaataaatggaattactacctacatagttgtctcggcaaaatcttgggaattcttctttatcacccaccattcaccactgttgaatattcttaatatataactcctaaaatatctttcagatctgtctacttcttttaagtattttacttttcagttttagaatttaatttttttatagtttcaatttatttgctgagattctcatttgtttatgaatcaagaccatgttttctttttctgtcattgttctttatgtatgttcattttttagtttttaaatttatctatatttaactcatttccatagcttttgaggtacaagtggttttgtttacatgaataaattgtacagtagtaaagcctacgattctagtgtacctgtccctggacattgtacccaatatgtggtttttttaatccctcacccctctcccaccctctccgcttctgagtctccaaaatccattataccaagctgtatgcctttgcatacctacagcttagctcccacttataagtgagatcatacagtatttggttttctattcctgagttactttacttggaataatggcctccagctctgtccatgttgcttcaaagtacattagttcattcctttttatggctgagttgtattccatggtgtataaataccacattttctttatccgcttatctgttgatgaacacttaggttggttttatacctttacaattttgaaccgtgctgcgataaacatatgcatgcaagtgtctttttgatataatgacttcttttcctttgggtagatacctagtagtgggattgctgggtatctactttactgcatactcatttattctgagtacacataaatgtggttgtgtattaacttgtgaatgcaaaaccatctctgcatccttgggataaaacccacttgatcatggtgaattatctttttgatgtgctgttggattcgatttgctagtactttgttgaggatttttgcattaatgttcatcaggaatattggtctgtagttttctttttttgttctgttctttcccggtttgggtatcatggtgacactggcttcatagaatgagttagggaggattccttctttctcaatcttttggaatagtttcagtagaattggtaccaatttttcttagaatgtctgatggatttcccctatgaatctctctggccctgggctttttcttttgttgttggcaatttttaaaaattactgattcgatgttactgcttgttatttgtttattcagggtttctatttcttacttattcaagctaggagggttgtatatttctaagaacttatccatttcctctagattttctagtttatgtgcatagaagtgttcatagtagtctcgaaattttttttgtatttccgtgctattggttgtaatgtctccatttttatttctaattgagcttatttgaatcttctctcttctgttttgtttatatttttaaagaaccaactttttggtttattggttttttggtttcaatttcatttagttatgttctgatctttgttatttcttttcttctgctagctttgggtttggtttgttcttgtttctctagttccttcagatgtgacattaggttattaatttgtaatctttcaggctatttgatgcaagcatttagacctataattttcctcttagcactgctcttgctgtattctgaggttttgaaaccttgtgtcactattattattcattttgaatcatttttatatttccattttgatttcattgctaccgcaaaaatcattcaggagctgattgcttaatttccatgtatttgtgtagttttgagggttccatttgaagttgatttctagttttattccattgtggtctgagaagatacttgatttgatttcagttttaaaaaacttaatgagatttgttttgtggcatgtcatatggtctatcttggagaatgttccatgtgttaatgagaagaatgtatattctgcaattcttgggtagaatattctgtaaatattattaggtcaattttttttatagtgtagattaagtccgrtgtttctttgttgactttctgcctctatgatctgtctagtgctgtcagtggagcattgaagttccccactattattgtgttgctatctatctgttttcttaggtctagtggtaactgttttatgaatgtgggagckccagagttaggtgcacatatatttaggattataatgtcttcttgtgaccttttttgccccccctttttttcttactattattgctttagtctgttttatctgacatcagaatagctactcctgcttgcatttagcttccatttgcatggattaactttttccacccctttaccttgagtttattagaacccttacatttaaggtgatctcttgaagacagcagatatttggctgtgatttttttaaaatccattctgccaatctgtatcttttaagtggagcgtttagacaatttacattcaatgttaatactgagatgtgtgtactgttcagtcatcatgttgatgttgcccagatgctttgctttctccactgtgcggttgttttataggtctgtattagtctgttctcacactgctaataaagacatacctgtgactgggtagtttataaaggaaagaggtttaattgactcacagttcagcatggctggggaggcctcaggaagcttacagtcatgggagaaggaaaagaaaacatgtccttcctcacatggtggcaacaaggagaagtgctgaggataatagggaaaaacaccttataaaaccatcagatctggtaagaactgactcactatcataagaacagcagcatgggggtaactgcccccatgattcaattacttcccactgggtccctcccatgacacatagggattatgggaactataactcgggatttgtgtggagacacagccaaaccatatcattctgcctctagcccctcccaaatctcatgtccacatatttcaaaacacaatcatgccatcctaacagtcccccaaagtcttaactcattccaacattaacccaaaagtccaagtccaaagtctcatctgacaaggcaagtcccttctgcctattagcctgtaaaattgaaagcaagttaattacttactagatacaatggggatacagacattgggtaaatacaactattccagatgggagaaattgaccaaaacaaaggggatacaacccctttcaagtctgaaatctaatagggcagtcattaaaccttaaagttacaaaatgatctcctttgactccatgtctcacatccaggtcatgctgatgcagaaggtggacatccatggtcttgggcatctccacccctgtgactttgcagggtacagcccctctcccagctgctttcacagctggtgatgagtgtctgtggttttctaggcgcatggtgtaagctgttggtgaatctagcattctggtatctggaggacagtggccctcttctcacagctccactaggcagtgctccagtggggcctctgtgtgggggctatgacaccacatttcccttccacatcaccctagcagaggttctccatgagggctccattcaagcagcaaacgtctgcctggatatccaggtgtttccatacatcctctgaaatctaggcagagcttcccaaaccccagttcttgacttctgtgcacccgcaggcccaacaccacatgtaagccaccagggctttgtgcttgcactctctgaagcaacagcctgagctgtacttagcctccttttagccatagctggagctgaagcagctgggatgcagggcatcatgtcttgaggctgcatagagcatgggggccctgtacatggcccacagaatcatttttccctcctaggcctctgggcttgtaatagtaggggctgccatgaaggtctctgacatgccctggagacatttttcccgttgtcttgatggttgacatttggccccttgttacttttgcaagtttctgcagctggcttgaatttctcccacaaatttttttttctattgcatcattaggctgtaaattttccaaacttttatgctctgcttcctcttgatcgctttgccccttaggagttttttctgccaagtacgctagatcatctctctcaagttcaaagttacacagatctctggggcaggggcaaaatgccaccagtctctttgtgtaccaagagccaccattactccagttcccaacaagttcttcatctccatstgagaccacctcagcctgcacttcattgtttatatcagcattttggtcaaagccattcaacaagtcctaaaatattccaaacttctccacatcttcctgtcttctaagccctccaaatctctaggaagttttaaacttttccacattttcctgtcttcttctgagctctcaaaactgttccaacctctgcctgttacctagttccaaagtcgcttccacattttcaggtatctttacagcagcgccccattcccgttaccaatttactgtattagtccattcttgtgctgctaataaagacatacccaagactgggtaatttataaaggaaagagatttaattgagtcacagttcagtgtggctggggaggcctcaggaaactgacagtaagcaaacacatccttcttcacatggtgccagcaagaagtgcagagtgaagtggggaaaacctccctagaaaaccatcagatcttgtgagaactcactcactatcatgagaatagaagcatgggggtaactgcccccatgattcaaatacctcccactgggttccttccacagtgcatggggattatgggaactacaactcaagatgagatttggatggggacacagccaaaccataccaaggtccttgagttttatgctttcaagaggtctattatggagcatattgacctattgtttcaagatttagaactccttttatcatttgttgtagggctggtgtggtagtgacaaactccttcagaatttggttgtttgaaaaagactatttctccttaatttatgaaacttagttttgctggatacaaaattcttggttgatagttattctttttaagaggctaaagcggacaccaactccttctggcttgtaaggtttctgctgagaagtctcctattagtctgataggttttcctttataagttttctgatactgttgtctcactgctcttagaattctttccttcatgtctacttctgaagcctgttggccatatgccttggtcatgcccttttttcagtgactctcttaggagttctttgagattcttgtatttggatacctaaatctctagcaaggccaaggaacttttccgcaattattccatcaaataagttttccaaactttttgctttctcttctccctcaggaacaccagtgattcttaggtttggccattttacataatcccatatttcctagagactttgttcatttcttttaattcttttttatttctatttttgtctgattgggttaattcaaaagccttgtcttcaagctctaaaattcttctacttggtctattctactttttaaactttcctctgcattttgtaattccccaaatgtgtctttaatttccagaagttttgattggttttcctttaaaatatctatttctttagagaatttttcattcacatcctgattttttaaataaaaaaattatgttggtttttatctttctcttatatctcctcaagtagcttaataatcaaccttttgattttttttatctggtatttcaaagattacttcttggtttggattcattgctggagagctactgtgaccttttgggggttgttatakaaccctgtttcgtatttccagaatcattttctggtttcttctcttttggatagataattttttctaattattcttgaatktatttttgattctactgtgttttcttttttttccctcttgatgatgcgactttagtatttacagtttattctagcctaatgaagctcttggtgctttcaggggtgaagactctgtatgaaattcgttgattatagatagtctttgtattatggctttctcagatgttgattgtagtagcaatgtgttcagtgtgtgagcaggttcatagtctcttgtggggttgaaatggcagaggtctcttgaagcttatcttattccccagtgatgtgcacattttaatttatttttttccccagtattttacttactgggttgaagaattcaggcttcaggccagtaggggaggtgtctgtgggtaaaaaaccagtgtggccaaagcaggtgggtaaatgcaatacccagtggtgggcagaggtcctagccttgatagaggaggctgggggagctctcagtgaaacacagtgagttctctgcaggggaaatttaggcagccacattagcttcccagccaggccagcaggaaagcaatctacctcccagtcatactcctgacccagtgttctagctattcacatcagacaggtgcctctttccatctccaagaatgttgattctctaagtagatagggattgtgactctactccttgtgcaagcctgaacctggagggcactcctcctgtgaggaaggagttactctgaaccatttcagaaaggctgtctataggtgtacccacacgaagctcccatgaaagaatccccagctgtatctgcaatggtggatgagggggagaagaagtccccttctccaagacccttcatgagtaccagggctgcccaagtattggatagagctgcagactttccctgtggagtgcagcacttcacttttgcctctgctgaaagaaacttcccacaagcagaaagttctgggactcaagacctgccatctggattcttttgtcccatggggtgctcccttgatgtggtgcagtccccctttctgcaggaataggagtccctgagggccagattactgtgaatgatgctgctcctcttagtttagccacccagtggggctgtcacactccaagctggtgctagggaatgtctgcaagggttccagtgatgtgaactgtcctcaagtctctgagcagcaggtaccagcactagctctgatgcaggtggcaggggagtgacatagactctgtgagatcctttgggtatacatagccttagtgtgttggctttctcaaatgttggctgtagtagtaatgaactggtcatgtggacagaccaggaccttctcattagctagggtgatgcaggcaatggtgaaagctgaggtcatgcacaagttttctctggcctgggcgctgtgtcattttaactgcagatggtgtaatggactgtgttggttggcttctagtaggtggtggcacttgcaaaagagtgccagctgtggtggtagcagtggattttttgttgttgttgtttccatgagcaaatatacagatttattttttatttatttttaaattttaaatttttattttaatagattttaagggaacaggtggtgttttgttacatggatatgttctttagtggtgatatctgagattttggtgcatccatcacccaagcagtatacactactacactgaatgtgtattcttatttctcatcccacttccaccctttccttggagttcccaaagtccactatatcactcttaggcctttgcatcctcatagctttgctcccacttatgagtgagaacgtacgatgtttgcttttttattcctgagttacttaacttagaataatgatctccagctaggtgcagtggctcatgcttgtaatcctagcactttgggaggctgagatgggcagatcacctgaggtcaggagtttgagaccagcctggccaacatggtgaaaccccgtctctactaaaaatacaacattagctgggtgtgttggcgtgggcctgtaatcccagctacttgggaggctgagggaaaagaattgcttgaacctgggaggcagaagttgcagtgagctgagatcacaccattgtagtccagcctgggcaaaaaagagcaaaactccgtcacacacacacacatacacacacacacacgcaagaataataatcttcaattccatccatgttgctgtgaatgtcattattccgttcctttttatggctgagcagtattccatgatataaatatatatatatatatatatatatatatatatatatatatatatatatatatacgtatatatacacacacacacacaccacattttctttatccactcattgattaatgggcgttggggctgttacatatttttgcaattgtgagttgtgctgccataaacatgtgtgtgcatgtatctttttcatataatgacttctttttctttgggtagatagccagtaatgggattgctagatcaaatggtagatctacttttagttctttaaggaatctccacactgttttccatagtggttttactagtttacattcccaccagcagtgtaaaattgctcctttttcaccacatccatgccaacatctattattggcacatagccactggtctatgtgcctatttttataccagtaccgtgctgttttggtgactatggccttatagtatagtctgaagctgggtaatttgatgcctcaagaacaatatgatttattcttttcgcttagccttgctttggctatgtaggctcttttttggtcccatataaattttaggatttttttttctagttttgtgaagaatgatgatagtatttttctttgctttatgttacccaggggaggtactcagacaatggattgggacatagagctccccaaaagttccatcatttgtgttaagctactaggacacatggaggggcaaagccaagtcgtgggcgctgggtcaggcaagtatgtgttctggctctccacgtgtgggcacaagcagtggctccagaggggattgtagggcagttctctagctgctggggtaatgttccagggaggagcacaactgcctctgttgtacagaagagtcttcatggggagtggggagtagcaggtgacagtaagccctacttagctcctatgcacttggcaaggctgttttcacacttgcagtgttccactagcagcagctagctagtttccaggcagtctgcatcaggactcaaaacttccccaggccataagctttctccatggagacagaaaccactgtgcccaggccatgcccctcccagcctgccctagaagcaggggcacactgcttctgtgcttgtggcttcagcccacttcccactcacccctcagttctggccaagggagttcatccgtacttgagattatattgtgaatcttaactgggggcttctcccaacctgttgtgtccggaattggtgggttcttggtctcactgacttcaagaatgaagccgcggaccctcrcagtgagtgttacagctcttaaggtggtgtgtctggagttttttccttctgatgttcggagtttcttccttctggtgggttcgtggtctcactggctcaggagtgaagctgcagaccttcgcggtgagtgttacagctcttaaggcagcgcgtctggagttgttcgttccccccagtgggcttgtggtctcgctggcttcaggagtgaagctgcagaccttcgtggtgagtgttacagctcataaaagcagtgtggacccaaagagtgagcagtggcaagatttattgcaaagagcgaaagaacaaagcttccacagcgtggaaggggacccaagtgggttgccactgctggctcgggcagcctgcttttattctcttatctggccccacccacatcctgctgattggtagagccgagtggtctgttttgacagggcgctgattggtgcgtttacaatccctgagctagacacaaaggttctccatgtccccactagattaactagatacagagtgtcaatacaaaggttctccaaggccccaccagagtagctagatacagagtgtcaattggtgcattcacaaaccctgagctagacacgggtgctgattggtgtgtttacaaaccttgagctagatacagagtgccgattgctgtatttacaatccctgagctagacataaaggttctccatgtccccaccagactcagaagcccagctggcttcacccagtagatcccgcaccggggctgcaggtggagctgcctgccagtcctgtgctgtgcgctcgcactcctcagcccttgggtggtcgataggactgggtgccgtggagcaaggggtggcactcattggggaggctcaggccacacaggagcccatggagggggtgggaggctcaggcatggcrggctgcaggtcccgagccctgccccgcaggaaggcagctaaggcttggtgagaaatcgagcgcagcgctggtgggctggcacttttgggggaccaagtacaccctccgcagccactggcctgggtgctaagttcctcattgcccagggctggcagggctggccggctgctccaagtgcgggcccgccaagcccacgcccacccggaactccagctgttccgcaagcaccgcacgcagtcccggttgccactcgcgcctctccctccacacctccctgcaagctgagggagtgggctctggccttggccagcccagaaaggggctcccacagtgcagcggtgggctgaagggctcctcaagtgccgccaaagtgggagcccaggcagaggaggcactgagagcgagtgagggctgtgaagactgccaacatgctgtcacctctcactgtgaccactgcctgtgtcagctggcagacttctgtgaggtccctcccctgtgaggtaggatcaggaatggcttccctctatctctcctggagactgggaatgcacacaaagcatgtctcaatgttactctttctcatatactccctactgctccctataacagctccagtgctgtatagggttaaggccttcccctgtgcttgggttgccaggttccccagtaggagtgtatatcctggaggtagtttatccctctctcacattcaggggacttacggttttctgcctggctcatggtgtaggctgaagcctgccacttcattcaaagggtctgtggtttcttttagttttcctgttaagttcctgtattgcttcttggagaaaagttcacagtgtgaatctctgtgcactattttgtctttccaaatggaagaagcatgccaccaataactccaatctgccatcttggaaaaaaatgtacatatatcaagacgatattttcatttcattctttgaacatattttctcttaattccttgaacatatttaaaatagctgtctgaaagtcttctgtaaatccaacacttgcggcatcttgggattggtttctattgattacttttttaaaaaaaactgtggatcacgtgttccttttttctttgtggatctagtcatttttttattgtatgagggacattgtagacaatatattgcagacactcaaatctgttatttttctctgaagagtttcatgtgtgtgtgttttgtttgtttagaaggcagtagaattattggctgatcacattgaacttagataggcatggttttatgctttgctggaatggttctgtggaaagctctaggtgctgcctaagcccctataaattactaggacttaacttacaaattacttcctctgaagatcttgtcaagacttagttytaggcttttcttggactagtttagtctgtattcatagggcagtgtttctctatcttttttttcattactataaaagagatttttaagacatttttttcccagttttgctcccccctcctccatgaagttttaataccacagatataactctatatctgtttatgtactgtggttctttgaagaggtacaaagcattgtaatatctaagattctttttgctccccgcctccctgccaagaactaattttcatccgttggggatgatattccccttgttgcgaatgcattttctatggtgtggtcctaaggtaaagcctttctgatatctctgctggatgctccaaagattaataaggtgttcatgggttttttttttttcttccctggctgtgccagaatgccagtatcttccaacaatgctcaaaatctcatacatcttttatgtttttaatcctatagcagccactctataagctttgggtagtgctgtcctgcccacgtacagcccatctctcagcaatgtacttgcagggggctcctacacggactttgaggaccccatgttgcatggtttcttcctctctggtgccctgccctgcatgttttaacttttagcactttgaattctgccttcttatctcagtaagactgctgtcctctgcttggactctagctcactttactgtggttgggagttgtcctggcacaaagagatgggaaattgggattactttgtgagtttttattctctcagagattgcagtcttacactgcccccttcccaatgcctgaaaatagttgcctgttttgcccagttttatggttctgtggtcatttatggagggacagtacacctataccaataactacagtttctctgacttcttttggaagcagaagtcctccttctactactttcaattctcatctgcacctagtacaggtgataagcattctatcagaattaggacaataattttctaacaggtcttctgatctccttactttcagcctccatactacctccagagtgaactttttgaaacacaaaaacacaaatctcctgtcattctcctgtttggaacccttattaggcactcctttatccttaggataaagttcagtcctttaaagtagctcacaggtccccctctatgatctttcttccagctctctctccagccttggctttcactctcgaccttgaacctttgtgcatgtcatactacttttttcagtttgtcatatgtgcagtggttttacttgcctccttgcctttgcacatttatttttctttttccggaattcctactctgtctccccactttacttggctaactcttgctaatcctttaggttgcagcacagatttaacttcttctggtagtcctataccaggatagaggccctgttttatgtttcatacactaccctggtgtcattattaacagttctttttttcttttccttacttccacaagaaataagctctataaaggcagggattttatttgtcttgtccagtgctatatccatagtgcttagtacaatgcatggttcacaagtaggtattccattaatatttatttattgaatgaataaatagagatagtgtttattccctttttcatatgattgctctttaaatatataggataactcttgtgggttccttatgtctttactttttgaggctacatattcagagatcataaaggaaaggtttaaatatctatagcaggagttggcaaactatggccctgggaccagatctggcctgctctctgcttttgtaaataaggttttattgaaatataaccataccagttttttttttcacatattatctatctatggctgcttttgaactaccatggcagaattgcgtagttaggatagagacatatgacctaaaatatttactttctagtcctttacagagaaagtttgctgaccactggtctacatgaagtttcctatgcatcctcaatttatttaaatgaagaagcataggaaagtatgctagagtatatgttgtaagtgatatactaggctagtctgaggtcagcaactaaccttaaaatcttagtggcttaacacaacacagatttatttctctctcatgcaaatttctttgatgcttggacaattttccagtgtactcctctccgtatagtgacttagagatccaggcagcttccattttgtgttccatcaaatcatctattttcttgatttccctggcgcaggaagaggaagctagagggcctgcaattcttgggactgaaagtgacacatagagcttcttctcatagctcattggccagaagtagtcatatggccctgcttagtgaaagttggttggaaagtaaggaaagacatataaatatttaatgagcgatgagcatctctgccatagaaagattgccttaaaatgattaaatgcttgttttttggggaaagttttcaacttaacattttcagcttcagttatcttgaacatgcaatccttccaagtaacacattataattatgtttttattttacagataccataccccgaatagtaaaatattatcaaaagtaaataggacaaggatttttttcttaaaaaattgggtctactggtttttaaaaattggattttatttaaaaaaattcactgacayaattttctaagaatatatcaattaagcaaattaaataaaatacagtaatggttgaaatggcctgaaggatctccctgacacaaggggatccttttataaacacttacatggagactgaaaatttatcctgctaatggagtattgttatttagagtggtggtttttcactactccctccacccctttggtttgttttatgtgatagaaccctcttaggagagagcccaatttataaaacatacaaaaaggagctattgtgtctgaagaaggcttgcgttggattctgtctactcaatctctcttttattacccccatctctccctccctaaatgagtacctttttagtatccttgaggactgaaaaacactgctttaagcatctataggacataatttcgagctgtagaaccacagattttagaactcaaagggaatttagagaccatgtactctaatttwactatgatttagtagatgttggttagcaactgtggagctgcaggacaacaaccaacttgtgtgcctgattttctaaaaaactaggggcatctcaaacaaaactaactctaaagtgattatttattcccaagagacctcttatattaggggaagactaccaatttacatcaaactagattccgaagggcattttcaggatctgtacttttcattttaatataatataatttttaatatataagtacccaagaacctaccctaaacaaaatctgggatcttgacagtaatctgtctttatacctcaccaacctatctctctgcctacccctatttgaactaatcatcattctggaccctatgtttctatttgcttgcttttctttttatatagttttattgcatctgtatgcattctctctctctctctccctgcccccttgctgtttttaactaaaaaataggggattgtgttgtttataatcttttgaagtacatttttaaaattcagtattatactgctcagaatcatccatattgttgcatattatagtcattcataccttytgactgctctgtaatattcaatgtgtgaatataacagcttgctatggcttgaatatttgttctttccaaaactcatattgaaatttaatccccaatgtggtggtatttagaggtggggcctttaggaggtgatttgcagtagtatttctgtgcataacattcaagctgagagccaagtcaagaatgcagtcccatttagagtagacacacacacacacacacacacacacacacacccctaggaatacatctaacaaaggaggtgaaagatctctataaggagaaccacaaaacactgctgaaagaaatcatagataacataagcatatgaaaaagcattccatgctcatgaattggaagaatcaatatctttaaaatgtccacactggccccaagaaacttatggattcaacattattcctatcaaactaccagtgtcatttctcacagaattagataaaaacaattctaaaattcatatggaaccagaaaggagcctgaataaacaaagcaatcttaagtaaaaagaatgaagctagargcatcacattatccaacttgtttatactataargtagtggtacaaaaacagacacatacaccaatgaaacagaatagagatcccagaaataaagctgcacaactacaaccatctgatctttgagaaagtcaacagaaataaacaacggggaaagaacttcctattcgataagtggtgctgagataactggttagccatatgcagagaatgaaactggatccctgcctttcaccacatacaaaaattaaccaaaaatggattaaagacttaaatataaggcctcaaactgtaaaagtcttagaagaaaacctaggatgtaccattctggacattggctttggcaaataatttttggctaagtcctcaaaaacaattgcaacaaaaacaaaaattgacaagtggtacctagttaaactaaagagcttctgcatagccaaagaaactatcaacagattaaatagacaacctacagaaagggagaaagtattcataaactatgtatccaacaaaagtctaatatccagactctataaggaacttaagcaattcaacaaaccaaaaactaataacctcattaaaacgtgggcaaaggacrtgaacagacacttatcaaaagaagacagacaagtagccaataaacatatgaaagaaatgctcaacatcattaatcatcagagaaatgcaaatcaaaagcacgatgaaataccatctcacactagtcagaattgccattattaaaagacaaaaaataacagatgctggtgaggctgaggagaaaagggaatgcttatatgctggtggtggaaatgtaaattggttcagccactgtggaaagcagtttggaaatttcccaagaaacttaaaacagaactgccattcaacccarcaatcccattatttggtatatacccaaaagaaaataaatcattttaccaaaaaagacacatgcactcatatgtttaccatagcactattcacaatagcaaagacatggaatcaacctaggtgcccatcattggtggattgtataaagaaaatgtggtacataaacatcatggaatactacacagccataaaaaataaataatgaaattgtgttatttggagcaacatggatgcagctggaggccattatcctaagtgaattgacacaggaacagaaaaccaaataccacatgttctcacttataagtaggaactaaccatttggtacacatggacataaagatgggaaaaatagacactggggactagtaaagtgggtagagaggcagggggtcaaggggtgaaaaattacctgttgggtactctgctcactacctggataatgggatcattcgtaccccaaacccatgtaacaaacccacacatatgccctctgaatctaaaataaaagaagaaattatagaaaaagaagtgattgggtcatgagggttctgtgctcattatggattaattcattcatgaattaatggattaatggtataacagattgattgcttatcatgcatattagtctattcttgcattgctataaagaaataactgaaactgggtaatttataaagaaaagaggtttaatttgctcatggttctgaaggctctacaggaggcatgatgctaatatctgcttggcttctgaggaggcctcaggaaacatacaatcatagtggaaggcaaacagcgagcaggcatcttacatggcaggaacaggagcaagagggcgaggggtaggtgctacacactcttaaatgacccrtgagaactcactcactatcttaaggacagtgccaagagggatagtgctaaaccattcacgagaaatccacctccataatccaatcacctcccaccaggccccacctccaacaatagcgattacaactgaacatgagattgggtgtggacatagatccaaaccacatcatcatgggagtgggactggtggctttttgagaagagaaagggagacctgagcaaacacttttgacctccttaccaagtgatgccctttgctgccttgggactatgcagagagtccacaccagatgtgacctcttgactttggacttctcagcctccagaactataagaaatacatttattttctttataaattacccagtttcaggttttctgttataagcatcagcaaatggactagtacatagtttattcatcctcttttctgttgatgggaaattgggttatttctaggttattgctgttgagtacagtgatggctatgaacattcttgtgcatatctctttttgtacatgtgcaagaggttcttttgggtatacacttagtgactaaattactgggtcatagagtatgtgagttttccactttagggagtaataccaaatcattttctagccctttagccaatatataatggaagcaacagcattttttttcttttcttatgaaagagcaagcagctatttagtcctgtccctacagttcccatttcgttttcactgggacctgcattaaaacacatctgagggtgtctcactttgaaaacaggtgtgttcaatcatctactttcaccttaggtcatcctcagtctagttagcagtccttgctcctgacataaggtataaaaacactctcaggaccacttcaggttttatctcatctcactgctatgttctgtggcagtaccaccttgattttcctagctgctttagtccttatggttcttttacatctcacctagctttctggctttaaaatccctagcttgcacctacatgttgaggaaagataactcttaggcctccctgacttccagattccggattttttttctcacctttgacagctgagagctccttaaacgatgggtgacacattcaaatgcttatataggccagggtgggagcactaatgagtgactcaggattccaggattaatataacactatcaggagcagtgggactgtggtggcctgatgatgggggtagcttctccttatggggttgctcccaggacttctgatttttccagagaaaaatagttatctagatttttaactgaaatctcttgacctttgagtgtcaacaatagatttaatatttagaaacactatgcaggccaaatgaaatatttctgacctggattcaacccataggtcgcccgttggtgaactttgcctcaaactttggcttatctgccttttgctttggccattgcctcacctgcctgttcctgccaaggtgtgcccctctctctggaggagacctcattgtgacatctctcaggtttaccttgacttccaagtgacctgatactgacagcaggcagggcaatgtctgattacttaccctttcctttctctcactgcttgccttaaatgcttctatcaaattctggttcttggaggcctgacttgttttgataatttttagaagagaaatgttatatggaatgatatttttttaacttgaaaaaagtatgacaagaggccaggattttattatttaatggctctcaaacttatttgcagttttagggcttctctgcttgatcttgctctggtgttgatcaggtggccctgacttcactggatgctggatttgtccctactcttgtcctaatggattggtgaactaaaacagcagttttttgatttaggaaaataaggtctttgactttcccccgtcttagaaacggtcacaatattttgatttgagattctaggcttttgagcatttgagaatatccttctcaaaacagaaaacctttgctttctttgcaattatttggcacattctaagggtggatatggtcagtatccagttgggaaataaagaaagtgcttcataaatcacacaactttttctgttgctgagtcagtatcagacacagatattttctgagtcaagcctgctgttctgtcaggtgggagattatgggtaaggtctgagattgagtggagttcgttagagcaagatgctaatgagcacagggtcatgggtttgatccccatacaagtcgattagcttaaaccataaagggactcctggctcatccatcctggcaaatatgtggtcacaggcctaaggaagactaggttagagagtgagaaaaatccttcatcatcaagaggaaaaaaaacaaacaaacctcaaagcccatgtcctattggatgtagtaagtgatatcatctgtggttgtagtcagtgcctatattacttatatgtagggagaagatttgcatcccattaaatctcccaaaatatgtaatatagcatgcatgaggttaaataaccaatgggaactatagtgacatccaaaaactctcgcaagagaagtcttatagctaactgagatggggtggaacctccatggccatggtggaactctgtgactgtgctgaagacctcttgtgcaattaattccttgttgggcatgaagccatgcacatataccctaagacaatgctgtcttctcctggaggatggataaaagggcagagaggattgtgtgagggcctaggattgtagccacttgtcctatggctgtcttattcactctgtatatttgcacaccctggtttcacattatctgagtgttttcctatggaaagaggttttcctatcttcattataagaaggacagtattttctagccatacccatttttcaaggatgatctatttaaaaattatttttcccaatgaaaaatttcaaatgaagtaatcagaatagaataatgaatgtccatatacacatcatctggatttaacaattgtcaacattttgccatatttgcttcattattttgtgtttttttgctagtgttatctcacctttacatatttttcttaaaaatgacaattttctgcataactgtaatactattatcactcccattaaaattaactatataatttcttaatrtcctgtagtactgcaaattcaaattgctcaattgtccccaaattgtcttttgcagccagtttgttcagtcaggatctaatcaaggatagtgaatttcttatgtgtgtgtgtttgtgtgtgtgtgtatgggcatgtgacatggagctgtggaagagacaagccagttggtctgtacaatgtctcatcttttggatttgtctgagttttcaggatgagttttgaagatttgtatttagtgttgaaaatgggcttgggtctggagattggcagtggccaggacaccctgtacagggaggaccttcgaaaatgagggaggtaaacacaaaggcagtaggaatgttccatatttttgtgtcttgcttcccagcagggctgacagacacaaactcatgtgaacacacagggacatagacctttataaaagaactgggtaatgtttttctctttgccaggccatagatagcacagaacttgaggatatgataatcctattggctgtatattttgaatagtgtatcctgaataaacaagataaaaccaagaggcagaaaaatgaatagaaattaaagctatgagaaagtcatagaaaattcttagtggtctgacattttgagtttgttcttctttggttaagttcactcatctctcttgggagtagagagaacccatatttgggataaacaactgcagaggaccaagagtcttgggagaagctgatgacaggcattcagaggtaagacttgggaagaaaatagccacagaaggaaagtacagggaggcaaacagtgggaggggccagctcatctcttttctccttccccccaaagactgctggttgtcagtgggcctataaaatcttttatgatcttaaaggtattttggaagactaagtcaatctttagcattcttaacctggagcaggggttctgaaacttgaactggcacattggcatcacctgggaactctaaaacacactgatgtctgggtaccaccctcagaaattctgatagaatttgtctcaggtgtggccagggcaacgggctttttaaaagactttccaagtaattctaatgagtatctaagtttgaggaccactgatctagatcaattaacchtacatacatayatatatatatatatatatatatryatttttttttaaaaagatacatttaacacctccccccacccaataaaccttatggaaacccaatgcataaaaaagattaaagtggaggtgctttacataaggtgctcttgaaacctggctgagtaggcaccatttgctacacccactccccgtttctttcaaaccctctcatcttcctacagcagtgtcttcaaagaattagggtctgaagagtaggactatttgaaaaataactggtccagagtttaaagggttttaaccatctacatctagaactctggctctttcaattaacttattaactgtatgactttgkacaactataaactctctgaacctcagttctcttatatcttaattagagatgatacctatctcacaggttgtaatgaagactaaagttggatatatgctagtgtactgtcagtagagattagttccttcagtagttcaggctttcctccaggctactgcaagctttcaggtctgtcctgggatgggactgatggtttggtttaatctgggaacttcagttaccttcatattatactcatatggtagggtgtacacagattccctttactcatgaggggtctaaaattcctgattgacttgcagcatcataggaataaatggaggtgggatgggggtggagtttgttcactgctgaatgctaagggagaagccaggagcttccatgaaatgactcaggaaatgctctataattcagataaactgttaatcaatggggagggaaccaggcaaagtccattttaaaatgaaaaaggtattaagatccataataggcatagtggaagggctgggggtgttgaggtgggaaggagttctctatggaccagaggagcaggttcatgactgagggaggagttattgattttttttgtaaacaatagatttttaagcaggaatgaagaaacatgaacatattcttccctatttttttgttccaatatggttaaacaaaactcccagataatatagaaaccttgcttattccccttatgaatatyttaccagtattgctaagaagtgaaattgattgatattaatttaacttcctcctcttcccacccagacattagtaaatagtgaaatggttgtaagtgttcagggagatgacaaaagagaagtctgaggcttgaggaattacgaagtcagatgatctgtaattgaataatattgagtagaatacacaaatcaaaagtggtgtaaaatctattacaggaaaaactcatttgagtctggccctgtcacagtcattgaactagtgattcaagtctgaacatggccagcagtggtatttcctgtttatctttcacaaagctggcaacaatttccacattatgttctctgcacatctccaacctctacggaatgaaaaatgcattttagtttcctcagcattcacaatgtagaaccttccagagaagctttcttttctttctggcatctggataaatggaggaatagcacgaagcggtaggtgcttaggccaattaagatgtttggtgggctcagtggggatgacccttagtctttaaaacatttttttgtaattatcttattcacatattattatccaaaataccatgactgtggttttggttgctactgcactttaatatagtagatgtatttttactttctatttttctttttttttctttaaagatttccattcttaatagatgagaaaaaaaattcctaagaagtaaaatgttaaagatgcttatttgggatcataggatctcttttagcaatttgcaatctgaagcggagaccacacaatttctggccacattgggatactgtctatactgctgcctctttctcacattatcttcctgctatctgacatacctatgctcacatccaggtactgaacaggggccctacatggctctgaggtaatcagagttcacttgtccacaacttgccattgaaaggctatgccctttagaatttcgtattctgaagaaaatttctattttttttaaatgtttcaatgttagtgagttgcctgaggaaagaatgtgataaaggtagttctaatcaaggtatatgtgagagactaattaatggtaggactcaatgttttatcctgatatgagtatactcatttcaaaaggagtctcctgtaaactccagctaaacaaacacaaaggcattttcaggatttcaggtatacatttgatggctggggcagagtggtgtatagagtttttcatgtagaccctcctcaaatctcaacacatgacttctatttcaaatctattttaaagaccagaactatttaaattttaccctaacatgactaaatttactttcctttatacctccacattgccaggacatttaaaagcctcttccaatcctaccaaagataagacactgatgacatctcatctcctgcctaacttgtgactattctcagtattggtgaagaggtgaaatttgtagatgagggattttaatccttcactttgtatttgatacatgactttatgtattatggtgctgatttttcagcacatctttattttcccttttccagttttaacaatgaacttttccaatctatcgttacttagtgaagacggttaatagtgaatacatggttcaggtatttcttttaacagccctgcaaatagaaatacagtgtaagtcccatatatgattatatattttcctataatcacattaagaaaagaaacaggtaaagtaaaattttaataatacatttaatccaatatgtcagaaacattatcattttaacatgtaatcgtgtaaataatgaggtatctcatttttttcctgaaaaaaaatctttgaaatctgggatttctttgaaatctaggaggtattttacaattacagcctatctcaatttgcaggccatattgaagtgctcaatagctgagtgtggctaccatattcacagccttagaaaattttgagtaagatgaatataagctgtgaacccgtacttagtttcagttagactatcttctttatgaaaatgtttaaatctaaactaatttttctccccacatatgcttctctgctagtgttctccaattcagtagttggccctgacatgcctgtcatatgtggttttaaaggcagaacatggtagacctctaagaggcattaattacagtgcgcacagctgtatgtagcagtatgggctcaataacactacttagttgtccatgccagaaaaagagttatttgagacacatcatcttcctcatttctacactccatcttccaaaattgtctttcactaagtcctttcagttccacctccagagtacatctgggaccggatcacattactccatctctacaatcttctctttaagtaggctgctacctcctagatggctgcaatagcctctaacaggcttcccacatcctctttggatattctccagtccattctccatgttgcaacctgttttgtgaaaggcaaatctgagcatgccacactcccacttaaaatcctctgacaggctgggcgcggtgggtcacgcctgtaatcccagcactttgggaggcccaggcggacggatcacaaggtcaggagatcgagaccatcctggctaaaacggtgaaactccrtctctactaaaaatacaaaaaattagctgggcgtggtggcaggcgcatggagtcccagctactcgggaggctgaggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtccaaaatcctatggtgacctacaaggtctttgtgatctggctctatttatctactactccttccttctttattttgctatgctactckctcttcctgtgtgaggattttcacatactctcttacttttatctgcagtgcttgtttgcatgctctctctctttctctctctttctgtttctctctctctgcctggctaacctctttttgctgttctgcttaaatgtgactttttcaggaacaccttctctaacttccttgacttttgggccccatcctgtatgtttttatatcaaacaggaccactatgtttttttcaggacacttatcacaattttatctatatgattatttgtgtaattttagtatattatctgtctccactgatgtaagcttcatacaaatagagaaccaaatctcccttgtttattccttttatgtctgtagtactagcctagggcctggcatatattaagccttcaataacttccagctgaatctgcgaatgcatgtgctcagcccattgtctgtagcagcttggtagttttaagaggcttctcaagcttgcagaaacccttgtgggtatgactaagtgttccagcttctgtttcattgtgaagattttagaagtgtagcctttaagaggcatactacaatccttccaaaaacaaagaaagtctgaaaataaatttgggagaggatgtggaacaaagtaatttctacactaataggaaaaatgcaaattggtgtaacttctttggactgtgtccccaaacaaaagctgggtcatgtcaactggctgttattctgtcttcttggttattgggtgtttctttgtgggggtattccttctagtgggtcataacatatgccataaaaatccacattgtggccacttccatagacccatctgcagacaggcctttaytcagatcttcttgtcccagatctttcaatctttcttctttcaggtgcctgcccaattagccagggtattcttcactgtttattaatccttatatcttctaacagcaagtcacttcttgtccacacaaagaggatgatttagtatactgccttcgtccattgggaagattttcccctcttcgctgtctttcgaggccatccctaagggagggttgttatgcaacagcagtccatttttgggtcacaccgagatactgagctgattcatttatgagctagttttccctctttcagctggccattagggactcaacacagggctacaggtatcgtttgaagagaaatggatgatatgggtttgacagtcatgcaatttgcttgtgccccctggccctgcctttgtccaatcctggaagtatcatttccatcttatgatggagtactaccagacctgcctaatcatatgaattattgcatttgttagaactcagcttaatgtggttatttcttattgtagggtaacttgaggttctatggtcagatgctcagtctctactagggctcagtagtattccaagagctgctgtttgaatgttatatagttcctggctgaagatggcatgctttgttttagaatcctggggaactgcttatgttatgattctactatttctttctataaaatccacatggtgtcttttcaaaccacagaaaccccaagaaccaaaagttttgccgtatcatattgcataagtcatagggtcacttttatgacaacctgaacctgctggagagccctttggtgttttgagctccactcacagctggtaaatgtgtattgttgcctaacctatgtaaatgggtactgcttctgatcttcttactgatagggatggaaaagaatgcatttgccagataaatggctgcatactacatgtcatatattgtgttaatctgctgtaatgaagctatcatatctggcccagcaattgcaactgtggctactacttggttattatagaatgttgtagattttatttctttaataattaatggacattagagattttctaaatctttaatttctaaattagagattttctgaatctctctgagcccatattggtagttcatactttcctaggaatatgtctatttcacctaaggaatttagtaaatttctcttattacctttttaatatctgctacatctgtagttgtgtccctttttgattcataatattatttgtgccstctttctgtatttctcattcacttttgccagaggtatgccaattttattagtttttgcaaagaaccaatatttggctctgttgtttccttctagtctatctttgctttctgttttattaatttcttcctcttgtctttatcttctcaatttttatattattcctatttgctcttttcttaacttttctaagttgaaggttgtattagtcagggttctcttagagggacagaactaataagatacacacacacacacacacacacamaaaaaaaaactaataggatatatatatgtatatatacacatacaaaactaataggatatatatatatatatatacacacacwcacacagaactaataggagatatatatatatatgagtttattaagtattaacttacatgattacaaggtcccacaataggctgtctgcaaggggaggagaaaggagaccctgtccaagtcccaaaactgaagaacttgtagtccattgtttgagggcaggaagcatccagctcgagaaaaagatgtaggctgggagactaggcatgtctcacctttttcacgtttttctgcctgctttatatttgctggaagctcattagatagtgcccaccagattaagggtggatctgccttccccagcccactgactcaaatgttaatcacttttggcaacacccacacagacacactcaggattaatactttgtatccctcagtccaatcaagttgacactcattattaaccatcacagaggtttagcacattaatttttcaccctttcttgtttcttattataagtatttaaggctataaatcttcttttactttggatttaaaaattatgtatatttaagttgtaaatggctctaaatctgtctctatctgcatctcacaattcttgatttgtagttcttttgttatctttcagttgtatgtattttctattttttagtattttctaatttttattcttctatagcccatgagtaatttagaagtatgtttttgaattttctaatgtgtaattttgtttgatagttcgttttgctgctgattgttaatttaacttttttgtcagatattgcaatgtatgagatatagattctctgaaatttgtcaatatctattttatggcctgaaatgtggttaatttttataaaccgtgtgtgcttgaaaagaatgtgtattctcaagttgttggatgcattgtttcatagacacacattaaattaaccttgtgctgttcaaatttttatatcattattgatttgttgctgtttgacatatcagttagtgaggaggtatgttaaaatcttccatttatgtggatttgtccatttctctgtagtccagatattttttgccttatactttgaaatgtgttattaagtgcatatatatgtaaattgtttttttttccaggtagttattcatttttattttttatttttttattttttatttatttatttttattatactttaagttttagggtacatgtgcacaatgtgcaggttagttacatatgtatacatgtgccatgctggtgcactgcacccacaaacttgtcatctagcattaggtatatctcccaatgctatccctccccactccccccaacccacaacagtccccagagtgtgatgttccccttcctgtgtccatgtgttcttattgttcaattcccacctatgagtgagaatatgcagtgtttggttttttgttcttgtgatagtttactgagaatgatgatttccaatttcatccgtgtccctacaaaggacatgaactcaccattttttatggctgcatagtattccatggtgtatatgtgccacattttcttaatccagtctatcattgttggacatttgggttggttccaagtctttgctattgtgaataatgccgcaataaacataggtgtgcatgtgtctttatagcagcatgatttatagtcctttgggtatatacccagtaatgggatggctgggtcaaatggtatttctagttctagatccctgaggaatcgccacactgacttccacaatggttgaactagtctacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcctttgagaagtgtctgttcatgtcctttgcccactttttgatggggttgtttgtttttttcttgtaaatttgtttgagttcattgtagattctggatattagccctttgtcagatgagtaggtygtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatgtattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagcctagtagtatagtttgaagtcaggtagtgtgatgcctccagctttgttcttttggctcaggattgacttgatgatgcgggctcttttttggttccatatgaactttaaagtagttttttccaattctgtgaagaaagtcattggtagcttcatggggatggcattgaatctataaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctttttaaagcaattgtgaatgggagttcactcatgatttggctctctgtttgtctgttgttggtgtataagaatgcttgtgatttttgtaccttgattttttatcctgagactttgctgaagttgcttatcagcttaaggaggttttgggctgagaagatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttatgcatctattgagataatcatgtggtttttgtctttggttctgtttatatgctggattacatttatagatttatgtatattgaaccagtcttgcatcccagggatgaagcccacttgatcatggtggataagctttttgaggtgctgctggattcggtttgctagtattttattgaggatttttgcatcaatgttcatcaaggatattggtctaaaattctcttttttggttgtgtctctgcccatctttggtatcaggatgatgtcaggatgatgctggcctcataaaatgagttaggaaggattccctctttttctattgattggaatagtttcagaaggaatggtaccagttcctccttgtacctctggtagaattcggctgtgaatccatctggtcctggactctttttcgttggtaagctattgattattgccacaatttcagctcctgttattggtctattcagagattcagcttcttcctggtttagtcttgggaaggtgtatgtgtcaaggaatttatacatttcttctagattttctagtttatttgcatagaggtgtttgtagtattctctgatggtagtttgcatttctgtgggatgggtggtgatatcccctttaacattttttattgcgtctgtttgattcttctctctttttttctttattagtcttgctagcggtctatcaattttgttgatcctttcaaaaaactagctcccggattcgttaattttttgaagggttttttgtgtctctatttccttcagttctgctctgattttagttatttcttgccttctgctagcttttgaatgtgtttgttgttgcttttctaattcttttaattgtgatgttagggtgtcaattttggatctttcctgctttctcttgtgggcgtttagtgctataaatttccctctacacactgctttggatgcgtcccagagattctggtatgttgtgtctttgttctcgttggtttcaaacaacatctttatttctgccttcatttcgttatgtacccagtagtcattcaggagcaggttgttcagttttcatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattaagtaatgtccttctttgtctcttttgatctttgttggtttaaagtctgttttattagagactaggattgcaacccctgcctttttttgttttccatttgcttggtagatctttctccatccttttattttgagcctatgtgtgtctctgtccatgagatgggtttcctgaatacagcacactgatgggtcttgactctttatccaatttgccagtctgtgtcttttaattggagcatttagtgcatttacatttaaagttaatattgttatgtgtgagtttgatcctgtcattatgatgttagctggttattttgctccttagttgatgcagtttcttcctagtctcgatggtctttacattttggcatgattttgcagtggctggtaccggttgttcctttccatatttagcacttccttcaggagctcttttagggcaggcctggtggtgacaaaatctctcagcatttgcttgtctgtaaagtattttatttctccttaacttatgaagcttagtttggctggatatgaaattctgggttgaaaattcttttctttaagaatgttgaatattggccctcactctcttctggcttgtagagtttctgccgagagatctgctgttagtctgatgggcttccctttgagggtaacccgacctttctctctggctgcccttaacattttttccttcatttcaactttggtgaatttgacaattatgtgtcttggtgttgctcttctcgaggagtatctttgtggtgttctctgtatttcctgattctgaatgttggcctgccttgctagattggggaagttctcctggataatatcctgcagagtgttttccaacttggttccattctcccggtcactttcaggcacaccaatcagacgtagatttggtcttttcacrtagtcccatatttcttggaggctttgctcgtttctttttattcttttttctctaaacttcccttctcgcttcatttcattcatttcatcttccatcgttgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagcttggagtaatttgatcatctgaagccttcttctctcagctcgtcaaagtcattctccatccagctttgttccgttgctggtgaggaactgcattcctttggaggaggagaggcactctgctttttagagtttccagtttttctgttctgttttttccccatctttgtggttttatctacttttggtctttgatgatggtgatgtacagatgggtttttggtgtggatgtcctttctgtttcttagttttctttctaacggacaggaccctcagctgcaggtctgttggaataccctgccatgtgaggtgtcagtgtgcccctgctggggggtgcctcccagttaggctgctcaggggtcaggggtcagggacccacttgcggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctcctttgtttacccaagcaagcctgggcaatggcgggcgcccctcccccagcctcactgccaccttgcagtttgatctcagactgctgtgctagcaatcagcaagactctgtgggtgtaggaccctctgagccaggtgcgggatataatctcctggttcgccgttttttaagccagtcggaaaagcgcagtattagggtgggagtgacccgattttccagatgccgtctgtcaccactttctttgactaggaaagggaactccctgaccccttgtgcttcccgagtgaggcaatgcctcgccctgcttctgctctcgcacagtgcgcgcacccactgacctgtgcccactgtctggcactccctaatgagatgaacccggtacctgagatggaaatgcagaaatcacctgtcttctgcgtcggtcatgctgggagctgtagaccggaggtgttcctattcggccatcttggctcctcctcctagttattccatatgtaaattgttatatcttcttgatgaattgagatttttatgtagtcatctttttttatcaataatccttttgccttgaagtctattttgtctcatactaataaaactgtaccagtttttaaattagtgttttcttgatttttctataaatttgacattaaatttttgttttattttaaatttttgtatgttaagctttagatggtgtctcttgcaataacttagagttgtattttctttttaatccagtctgacaatatttgtcttttaaccaggtaatctaggcagtttacattgatcatgattaatattatatttggattcatttctatcatcttataatggtttggactgaagtgttgatctggattgttgcacatcccttggttgaaagatgttacagccactgaatcacccaatcactgatccacatcctattattttgaactatccctatggcccccaatagcatagtgacttagggttaaatggcagtgtaaaaggatacaggaggctgggtgcagtggctcacgcctgtaatcccagcactttgggaagccaacgtgggtagatcacaaggtcaggagttcgagactagcctgaccaacatggtgaaatcccgtctctactaaaaatacaaaaattagctgggcatggtggctcatgcctgtaatcccagctactcaggaggctgagacaggagaatcacttgaacccaggaggtggaggttgccgtgagctgagatcacaccattgcactccagcctgggcgacagagcaagactccatctcaaaaaaaaaaatgtatacgggaactggagatggtaagtgggctgaagagcagtttcaggaaagaagttcatcatcatcctatatttaaaggactatgatatgtgtataaaagagggattaaaacatgagcagcaaatgacagaactagagcaaatgagtggaataataccttattccttgagcagctgttatgtgccaggaaaattgctaaatacttttcacatatagcttaattcatacaacaaaccactgagggaagggctcatcatccttatttcataggtgagaaaaatgaggctcagagagattaaagaagatacttgaagtcaaacaactagtaactggcagaattgggaatcatactcaattttgtatgactctaaaacccttgttctttttactgaattacatcacagagaggtgaactggtaaataccaaatgaaggaagaatactttttataattaaaattcataaaaaagtaatgaactatcatttgaaatggtaagcatccsatcactgggcatttctaaacagaggtaatgtggtcatgtgtcaggactgttatagtgagagttttactttgagtgggaagttgtactttagaacagacgcttggattagatggtcattaattatggtctatttcagtttccatgaggttattgaaactgtgccagagcttaacaaatgcatgattttcaaaactctccctaccttctgaaactagccgcaatgtgaacttgtcctttcttcacttagcctccttaactcactgcagtgttatgtgatgtgtacaggtggggactttaataaaaccctatttgatgatgacttgatgaaagtctatttggcctgtttagataggagaaaaacaagtcatgtgtataagtgcagtgtaaggttctttaatttgaaatactggagccaagcaatgcaaaagctgagagactccatttaatagcatgttaatatattaaaacccttaataataaattcatagcacttaaaatacawatatttctacaatgtaatattattttacagatggtatttagtaaatagccagtatttactgggaagtggggaattcattgtcctttgtgccttgctttgttgacacattctaccatgtgaaggccaagagcccgtaagaatagaaaaacctttctgtcagcagcagcctcatcaagctggtccctctgtagactctgctctgtccacttattttctttatccttactgctaatccatcaagtaaccatttcgccttcttttaaagcccagccacaagcattatttcttcccggagctttcattgacctgtgcctctccctgcactgtacctctcgaggtatccagtagtggcagttgaagtatatgaagaaggattttatacattatttacttttgttctgagtagttcttttaaaccttgtgaaagcaatttcacaagtgtttcctatagtattgctctgatgtggataggaaagacctcattatagcctttggacatgaagaaactgagacatcaggaggctgagaattgccaaatagtggtagagttttagcatctttcagctccacagctctactagccaaatgtgcgttccaaaatatttcccacaggtttctgactcttggattttaagtagtatgttatggctggtacctgggatttggtgtatttaaaatttgtttgggccagtcgcagtggctcacgcctgtaatcccagcactttgggaggctgaggcgggtggatcacctgaggttgggagttcgagaccagcctggccaacatgttgaaacsctgtctctactaaaaatacaaaaattagccaggcatggtggtgcacacctgtaattccagctactctggaggccaaggcaggagaatcgcttgaacccaggaggtggaggttgcagtgagcagagatcctctcactgcactccagcctgggtgacagagcgaatctttgtctcaaaaaaaaaaaaaaaaaacactgtttgactcattatttgaatgggccaagcaagggctgaccaatgcatagagagaagtatggttattgaatccctactagaatgtgaacaaattttgagaaaggcctaccattgaggtgagtgtgctgtaacctgagcacgtgagaccaaaaaaacacctgagaaaaatttttgctttcaaaattcatccatgtgactctatagattggatattctggtttcatccatttagccccaaactgacagagggttgtcttgggcagtcagagatgtgtagtgtaaagattattgggcactacttaggagccaaaggttctaattatggagcgtcttaagattagattcatcttttttactttcctggcctcagctctctcttatggcaagtgaggggtttgcaatgaggtcagtggttctcagaccatagcctttggagtacatggaccagaatcgccaggttatttgttaaaagttgagatgctggactccatctaggcctactgaattggaatctctggagtggcacttgtttatctgccttttgacaagctgaccaaatatgcacactaaagtttgagtacctctggatgatgtagattytaaggttccttccagctctatgatactttgaatgagaaagacaaagacagacagcaattacggatttcatttcaggtttctttactattctttaatgtcagagcctttagtgattttaaatttgccagaaatcacctaattagcatgtgatgacaatatactattttcattttttatgtctgcctcccccagcttattatcagcattgtttctatttcttttgtgcattactacagtaatcatcaatctcttcttattcacttccatcctttgtatcatcatcagagatttttggtgttgtttttgtccataaaacaacaaacacaaaaaatgtccctcacatgattaataagttgcttttttttctggcaataaaaacccttaatttctcagcatggcttactagacctttccaagtattatttatctttgtagttttatctcccaaatttttacccacatccagccaggaatcctttaattctcaaactagtttaggtagctgattacctagagtcatcttgtttctttctttcttattaaatatgaaatagctttatagttaacttcattgtacgatctggtacaattttattcatagaaaatattactatatgataacattttagaccgtaagcatttattaataataaaaaaaaaccaagcactggatttagtttggctctctctgagttttttacctaatatattttctatcttttttaactgtttgctacctctttctgttagaaaagtgaagaaaaataccaaagaaatatttttgtaagaataacttaaaattaagastattccacatatcaatttaaaaacaaaatttcaacagattgctacagattgcttttatatggtttaaataataaattactttgattccatttatggagcactggtgttttttgtgaacgctgttaggtaacaggacctgtgtccctgtggttctctttctggaatgcctttctgaagcttctcctcttaaagaattcctgctcatttttcaagacccagtagatttgtcaccaattgcaaagccttttctgaccctcatagaaataactatcaactctctcctctatattttccagatttcttggtatgttcatctctacttaaaaaactaatatctaacatcattataataataatgattattctgtttatctcctctcttcctctcttgcctctatgggtcctggcacaaagtttatgttccataattgatgttaaatgaatgtcttgttttgactaaratatttgttccttaagaaccttatccgtcttacctttattctgtaggaccaagaacacaagatcttatgtgtacccatttagcgatgacagactgaccaagtgatctggcttttctccacgctctgggaaatagtttaactctgtcaaagagcagtcaagaaaagttcatatattgagagtgatgtgatgatggctgtttgaaaagcttggaactacctttttagatcaaataggcttggttctgtctcaaatctggattagggccaatactttgataacccagtcagcaaagatcagaagtcaagaattcacaatctttcatcgtgctctgaaatcatttgtcaataaacaacaaagaccttctagggctggatattagagagggaagtagccgagagcttggaaggggagcttttctatcagctgaggactctggatgggaaaaaggcttagttcaggtctggtaaagaatttgagaataagcgaaattcaaggacacagtagtcaagaaagtgtttagtactgggtgttggctcggatgtgaggaaaaaggcactttacactgttagtgaggacagaagtagaaattggtacagcctttctggagtgcagttctgcaaggtgtattaaaaatgttaaaggtgtttatactttttttcccaccaattctacttctaagaatttttcctaatgacatactctaataagtataccaggatttttgtataaagaaatttatttagaacaactataaaggtcccaaaatagggaactgattaaacaaattgattaatctatacaaggtaatatcacacaggcattcaaataatgatgtagagatatatttatagaaaaggaaaggggtatatgatgtattatcagatttaagaatctatttatgaaataataggtagattatgattattttttgtaaaacagatatatacatgtatatatatattttatatatacacacacatatgctacacaatttatggaagttgtcaatgagagattttttttagtttaccttgatgttacaaattttctacagataatatataatactcaaattataaagaaataattttttcaaactatatttttcaaaatatttcaaaaatttcaaaaataattatttttcaaaataattttgaaaaagttatttcttatagaagggataattctttcagattggtattctccaggttgactgaatagtgcttggaacagagtacatgtgtgatatgtattagcaaatttaatgactgagtgaataggcaaatgactttactccaaacttggtagtgtaggttttattggtgagaattttctaaattttatccattcatcttccactggaactgcatctgtaggatagctgatttttgattcctgagatcttttctttttttttttttcctggttttcacttttttttttctctcttcaacttttattttaagttctgggttactagtgcaggatgtacagatttgttacgtaggtaaacatgtgccatggtggtttgctgcacagatcaacccatcacctaggtataaagctcagcatccattagcttttcttcctgatgctcttcctcccctgaaccgctctcccaataggccccaatatgtgttgtttcccccagtgtgtccatgtgctctcatcattcagctcccacttataagtgagaacatgtggtgtttggttttctgttcctggattagtttgctgaggataatggcttccagctccatccatgtccctgcacaggacatgatcttattcctttttatggttgcatagtattccattatgtatatgtaccacattttctttatccagtctatcctggatggtcatttgggttgattccatgtctttgctgttgtgaatagtgctgcaatgaacatatatgtgcatgtatctttataatggaatgatttatattcctttggttatatacccagtaatgggattgccggatcaaatggcatttctgcttctagatctttgaggaatttccacactgtcttccacaattgttgaactaatttacactcccaccaacagtgtaacagcattcctttttcttcacaaacttgccagcatcagttgtttcttgacttttcaatgaaccaccattctgattgcataagatggtatttcactgtggttttgatttgcatttctctaatgaccagtgatgaaaagctttttttaatatacttgttggttgcatgaatgtcttcttttgagaagtgtctgttcatgtcccttgcccactttttaatggggttgtttaattttttcttgtaaatttgtttaagttctttgtagattctagatattagacctctctcagattattagattgcaaacattttctcccattctgtaggttgtctgttcactctgatgatagtttcttttgctgtgcagaagctctttagtttaattagatcccatttgtcaagttttgcttttgttgcaattgcttttggtgttttcataattaaatctttgcccatgcctctgtcctgaatggtattgcctagattttgttctaggttttttatagttttgggttttacatttacatctttaatccatcttgagttaatttttgtataaggtataagtaaggggtccagtttcaattttctgcatatggctagccagttctcccagcaccatttattataaagagaatcctttccacattgtttgtttttgtcaggtttgttgaagatgagatgtttgtaggtgtgtggtcttatttttgagttctctattctgttccattctatgtgtctgttttttgtaccactaccatgctgttttggttactttagacttgtagtatagttttaaggtgggtagcatgatggctccaactttgttctttttgcttaggattgtcttgactattcagcctctttgttccatacaagctttaaaattttttgttctaattctgtgaagaatgtcggtagtttaatggaaatagcattgaatctttaaattagtttgggcagtatgaccattttgatgatattgattcctcctatccatgagcatggaatgtttctccatttgtttgtgtcctctctgatttatttgatcagtggtttgtaattctccttggaggggtccttcacttcccttgttagctgtattcctaggcattttattctttttgtaggaattgtgaatgggagttcattcatgatttggctctgcttgcctgttgttggtgtatagtaatgctagtgatttttgcatattgattttgtatcctgagcctttgctgaagtttcttatcagcttaagatgcttttgggctgagacgatggggttttctagatataagatcatgtcatctgcaaacaaagataatttgacttcctctcctcctatttcagtaatctttatttctttctcttgcctgattgccctggccagaacttccaacactatgttgaacaggagtggtgagagagggcatccttgtcttgtaccagttttcaaggggaatgctttcagcttttgcccactcagtgtgatattgcctgtrggtttgtcatatatggctctgattatatcatgatatgaggttacatcccttccttggtatgagtttgtgccccttcctgtgtctgagtgttgacgatatatttctgactggtcattagttgtttttgttcatttcattaagggttttgagagtcaggttccattaaccagtgtcattccaccattttattctgtgacttcttttggtgctattacatttaraaaattcttcctctctaaaatgtggtaaatatttacctacttagcttttaaaatatattttcatttaattctaaaatgtatttgaaattaatttttatatgatgtgaagtgagaccacaagttgatatttttcttttgaaatacataaccagttttacacaaaccgtttatagagtagtccattttttccatattggtttatgatgtatgttctgtcacatattaagttataatgtgtacaaggctctatttcaggcctgtttgttttgttgtgttaattcgtctgttgattcttataccaccattacactattttgtatgtgttataaaaggcagtttaatattgagtttgggtacatttccactgattttacttttttaaacagttgaactattttcacacacaatatttgccaaatgcaatgcttgacattatatcaaaaatataaattaattttggaataattaacatgttttattatgtagtctacctctccgggagcatattttatctttccatttgtttaagttttcttctatcttgcatccctcaaggttttacttaagaaatttatagtttgtaagtattatgtattgacctttccctcattacattttctaattattgttagtatatagaaaattgaatcttgaatatgtattttataattagtgattttcttgagtattattattgattttggttctttttgtatcttttagaaaagcaatcataccttctgcaaataattataacttctattctcttttgaaatagttgtatcttgtttcttttcttgcatgttagtatgatcttggacatccttaccttcctcctgattttaatgagagcagctttaataatttgcagctaagaggtaactggcctaaaagaaattaggaaatacacttagcttcctagtgaggcttaaaaatcagaaaaaaaaacagtgttgaattttatcaaatgatcttttgttctttttttaaaataattatgtcctcttatttgacctagtgatgcaatgtgttatattaatatatttctaatattaaacaatccttgcatttctgaggtaatccctacttgattatgctgggttattgttttaatatactttgacttaattttccagatttgttatttagaattttcacaactgtattcataaataaaacttgtttggaagaacatttcttgaaatgcattctaagaaggaatgttatgaggaagaaatggttccgtggtcaaatacacttgagaaaggcagattaaaacattttaacaaatttctttgctttaggtttctcagagactttaatatgctaatacatgctgtaatctctgagggagtgcttttcaagcacactcacaatagattccattcccccctcagaaagtgacactaatttccacagaaccctctttggaatattaatcattgtcatattttgttatgagggttatgtcaacgtcataaagtgagttaggatagcttttcctactttaacctaccctggaatggattatataatgcgggtctcataagtttcttgaaaacgtgaaaggcctaraaccagttttgcaaattatcccttaataacatttgctaaattttccatggctattcagctttcttataatattgaatcaatgttattaattcatatttctagaaaatggttcactttattgaaatttttaaatttgttaaaacgtgattgtgagtggaattctcttttaattcttaaaatatgtttcatttacctgttggtaaatacaatgaaatgaaatgatctgtgccaaatacttgaaacagtgcatggcacatggtaaatggtaaatgttttatttcctccccctttttcttattctgtwtctttctttttcaaaaaatttagatttgtcagaactttgttgatttaaaaactttgtttcccagataataacctcttctgcttatcttttaatctacttatctcttccatctatttatttgattgtttaaaaattcatcactgttcaccctagatttatattttattcttcctgcttttttatagtttttttctttcttttctagctagcttcttgaattgattgaataattcttttaaaacaaaattcttgattagtaatgaaaatattcaagtctatcaatttgatttaaaaatagttctgtattttgtggtcctttatgcacattgtacaaaactcaaagcatacaaaagggcttacagataatagtgaattttcttcattctcctgccttagtcttcttgttcctcaccaggaggtaaccacaattatgatgttcttgtgtttccttccagaggtattctaagtggatttggctattgagtacagctttgtcagaactatatatatttttatttaattattactttcattattttaaaatagaatttgctattaatttaaatttctcacttgatacaataattaggagggtcaaattaaaatacttattcataggacattttttgttattaatttctagttttgctgcattgtgattaaagaatgtagtctataatttctgctactttgaaagtcctgaggttaatcatgtgaacaattacaaggtcaaatcttataaatattttatgaaatattttaaaatttataatcttcaaagggcacaaagtatataattaattcaaaataatttttatttattgtggtttacttgatctattacagacagcaataaatttatttccttctcaaatcgaaattttgttgttttatttatccttataataacttaaaaatttgtatgccataatattttgcataaattatgattatgataaattatgatgctatgagaataaacacaagcataaaagcaaactctggcttgtaaattttattaaataaataagtcctgaaagtaacacctatgccaggatataaacattcaattagtgcagcaggatatcaaattagaagtaaaatttttgttcagactccccatttctaatctcacatttcagtcataattacttttgaatgctttgtatttcttctaatagttacctccataactctaaataatgtgtttagatctttcattcttaattagtaactatagactttatctattgattcttcgatatgaaagagtaaggctcaagttatttatactaccctaagctttccttttcaaattcttcccaattgtaatttttttcttagatgaataacttttgtaatttttaaaaatacttaagcttcaacttcttgattcatcaactttaaacattttttggactcttggttattttttgactcttggggaatgaatttcccaatttagcattctctatgtcttcctttctctactgtctgactcctgttagctatgttatcactttatgtggggaatgtttagagcattctgttctctaattctaattaaattttctatactttgtaggttaattctgaaagtcaaatactggtggaattttaatataatagttatataaatattcatttcatgtttgaggaatattgggtatgtagagaaagcaatgcaactcaacacctacgcccctttaaggagaattttctaaaggtcaagattaaatggattttctctttctattttaatatttcatccattattcagactattgtcatgatttaacttgtttcatatttggaccattcttgggaaatgttttgggtttaattgccttttttcttgaraaaagaaacacatatctttttaccatattgccaatatcttgcaattgtttaatgctttagtaagtatcactctatttctaggtctgtttcaaagctgtcaccctgatatttctctttattccacttctagattagtttcactatttcttagatyctgtgtactcccttttaagaacatttctttttcctccccttcaggacatttattcaagtgattttttttccataaagggtgcatgggaggtaaacttcctgggtccttgtttttctgaaaatgtatttatttttccctaatccttgactgatagttttggtaggtacagaattctagatttaaaatgatttccagctgagcgtggtgactcatggcgtaataccagcactttgggaggctgaggtggtagatcacttgagatcaggagtttgagaccagactggccaccatggtgaaaccccgtctgtgctagaaatacaaaaatacttagctgggcgtcgtggcgcatgcctctaatccaagctacttgggaggctgaggcacaagaatcacttgaacctgggaggcagaggttgcagtgagccgagatcacgccactgtactccagcatgggcaacagagcaagactccatctcaatgataataataataataataataataataataataataataataatttcttattagtaatttgaaggcattgcttctttgtctttcagcattgactgttcctaataaaaagcctgaggccaagtttattctctttactttctaggtaacctgaagtgctctatcacaaattatattttcttcagtttcattctgttcttcattattgtcaatatgcttttaaactcttgattttgttttgggtttccttatattttcatattttagccaattatttttttcagcttgttctctatttattgtgttctgaccttgtttcatagagatgatgaccttttacatatttatgaagacagcaaaactggtttaaattttcactgagaaaactctttttagaagtttctctttctttgaggttttagagagttatctattttttctgttgttgaagtatctttttttccataatcccattgttggctctttttctactttttcattcttgaattgtgtgagatttatccaggctttgtctttattaacaaaaataataggtgaattattttttgcttcacttgccgttcacacattttgcccagatttaaactaaaattttaatttgatggttttttcaaatgtctaacgggctttcatctgtcatggatttaggtgaattaatacaactcttgcattttttaaactgtaaggttacatgtaatttgaagttgtttgaatagtgtaaaacattaattagttttttctaaataactgtgcttccactcatgctgattattttgctaagttaagagatctgaggtcttttagcaaaagtaaaataagtagagctcatagaatgggaagactggtttgtgtaggagcccatgactgcagtaaagaaagttcccataagactgattgctgctcactatatttctcaccactgtagcccctgtcttctgaaacatggtgtaaactctatgggtaatcaacatcttttcttatatttttttgagaccagaatggaaggaagcacccattttatgtggttgtaaaaataaaatatgtgatgtatggtctaaaactacacctgccaacctattactgatgatacattaaatggaatttttatactcatagtaattctgatctttggctttctgtactttgccagtcaatgaaggtgtgtgcatgtgtgcatgtacatatgcgtgcatgattttttcataatgggagatgggggaggccctatcatacataatagcctgctgcctgctgccatgttaagaagtccaaccattagtctgttttgataagctaggcatctcaagtagccctattgatttttctttagttcttcttcttttttgttttctgttcatttttgtgtttttaatttatcctaggcagttgaattaaattgtcttccacttaattcatctcagcttccctcccagtctttttatgtccaaagtccttcaccagtcttcctattgcctccagattgtgagccaatttcttgaaggtggagccaagtctcactctttatatctccgtataatacatgtttcatacatacctactgataagctgatcagcttaatgatggggatagaagtgagctcctactcctgttttttccgtcaaaggtaaaccctggaaaaggacaaagttcgagtaatattttctacggagagcttggaactcagacgtcttctatggagttctcatcttcttgctcccttgccttttggtgagggaaagaatatgccacctgtcttgtctcctgggaccatgccaataagtgtgctgccccaggggctctgcaggatgggtttgttctcctgctcaccttgctccatccctgccctacctttcatctgctttcaggaggctcaaattgttttcttgtttccttctttccctttcccccaaacctccagtaaagaagagattttggtattaagaaaatgggctgttgaattccaaaatcagaaatagaccacataaatatgtatgaagcattaaaacccttcttcgaagtgtgatttcctggctaatggatgcttctgggatgattattatatatatttttgtactcaattaagccctattcagaccaacttatkttttggtgaacttaaggaccttatgattagcatccattagcatttccattacatctatattgtaataataccatctaaaatttctatgctgtatctctcacagagtgcttttatgccattattttatttgatactcccaacaacaccatgaagaatgttgagattctcttaacatttttgttttatagatgaggagactgaggtgcagaacatttaagcgacttgtccaaagtcatgcagtgagtaagggagtggaatgctgactaggagccatgtcctcagctagtatggcaagggcatgctccctatcactgctagtaatagcaaatgatcactaccactgagtatttgcatcatgccagctactatattargctctctgtatatattttctcatttaatactcctcataaccctgcaaagtaggaattgttattattccccccgttacatagaggggaactgcaatttagagaggttacgtaacttggtccaagtcacacagctagtcctagtatacctaggactatactgcagttggaacccaggtttccctgatttcaggcctcagccctagccacgtgggtccctcatggttttactggactgagctatgaagatattcaacatagcatagctcataaaggctgttccagttctcatgattccctgagctgtgattacgagctctccttgtgactcctatggctctggggcatattgccagaggtaaaattgggagctgtatggatcagaaaggcagagaaagtgaagggactaatatttactgaatgcttactatatgcccagtggccattaaaacccatatcacaggaaccttgtaagtctggtattatcatttccactttatggaggaggaaacacaggttcagagaggtaaagaaacgtatgcaagattgtaagtggaagagtcaggatttttagtcaggtctgtcagacyttatagcccatgttttctcctctatgcctaagtaggagtgggctcagtggtgatgttttaagggctaatgttgatgttttaagggctaatgagaaggagcagtatttctaaagggcttaaggaggattataaggaacagagatgaatttagaccctggtggttataatgcattataatcagtactctggagccctataaaggaactcataagagaacccaaagagaagaaaaactgtggcaagttttaggctacattgcctagcttatatcacaatgccagcagccttcaactgcaatacrtaggaactgggacttaaaaaccagcagaaacacattggtaaacatcataatgacacgcatatttaggaaaatgatgtttttaatttcaaaatctatgcagccttgccttatatagtcagtgctaggaagttgtggtgtaccaggaaatgatttacattttagccttaggcaaaaatatggaacttgtaattatgtcagagagaggcaaaaccttccagattttacagctttaaagctgtaaaagtctcagttaggatgtgtgttgattaaactgtggtgtggctgagcattttgcctgaaacttcatagggaataagcatctgttaatgactttcaggtaaaaaccttccttctaaacctttaatgcagtattgtcaaaatgtggaagtggtgggtgacaagcattttcttgttccttctaaggccttcctgatccaaggtagttttgagcacaaacggctgtgctggttaagcttttggcttgtgggaagaaagccgcacatcaactcctgatacgcacgagctagcctgaactctgtgatgaccatcagatgcagataaactgccagacagagaagctgtcttgtagatgtgactttgctgccttcaagagcagggctttctgcacctatgctctaagcgcccttagtgttcctctcccagtggtcctggattgatttctctaatggggagcctcctctgtagggtctacaaggtgactggtggattgattgccctactccacgtaatgtgagtaggcgattgtaaaggggaggctgaagagcttgcctgttttctttgttattcttcttactgagagaggtggactagagtggtagttcaaagatctggctctgcagtcacagatctgggtaccaatcaaggttctgtccctgattttctgtgtgaccttgagcacatcatttatcatctctaagcctctttctcatcttttaatgctttattcacaatacctggttcacaggattgttgtgggaattaaatgagataatgtgatattaagtccttaggacttttaaagttgacatagtattataactgttacctccgctaatagcgtcaaaccttgggtctaatcagggctcaktctctttactatttgtgtgaccttcctaaccattttgccattctgtctcccttctgaacatagcaaatataactagcttgctttggccttcaaattaatagaattcatcagccacagatctctgtgagccacttgctctgtaacagggaaggagtatgtgtgtctggcatgggagcttgccaagaatatttgctcaatagctatgctattataccatcacgtgctgctgtggctttataggaagtatatcctggatggttattacatatttagctggaatttagtttcctagggaaataaaagtttcatattttaagaatagacaattattttgaacaagtggtttatgtccacagaaagttcatgttcttatcttttatgtttgaatgaaggcactgtgtatgaggtgtccctgaacattggaagtctaaagagcatggatttggatgtcaaaactgggtccagattgaagttatgayatggaccacctgtgagagccttaatttcttcctgtgtgaatgtaaataatacctacctcatgggattaaaagagaaaataatataagaaagcatatatcatattatgtaacacatagtagcctctcaataaaagttactggttactattttgggcagatccaaacattatgttaataaatttcaatggctcccacattttattctttggggtggcacattctgtagagatatcttaggggctacagagggacagtgatggagggactaaggaaatagtatccaggctctctgccccacttcccaagaagctctgcttatgtctgttttatatctagggcatctgagattgttttacgggggagaaagaaggctttataagtgctttcagttcaatttattaatttttccctcaatgaaccgtagttttagtgttgtatctaagaaatctttgtatatcccaaggtcacaaaggttttcttctagaagtttttatgatttagagttttaaatttaggcgtatgatcaattttttagtccatttttgtttatggtaagaggtgtggtgtattagtttgctaggactgccataaagcatcacagattaagtggcttaaaaaatagaaatatattttttcacaattcttgaggctggaagtctgagatctaggtgtaagcagggttggtttcttctgaggcctctcttcttgccttatagatggccatcttctccttatgtcttcatgtggtctcttctctctgcctgtccctgtccaactttcctcttcttataaagacatcagccatattgggttaggacctacccaaatgaactcattttaacttaattacttctttaaagactatttccaaatgcagtcatattctgaggtactggaagtcaggactttaacatatgaatttggggggtacataactgagcttataattcatggatgaaagtgtttttttcccatatggatattcaattgtactagtgtggtttgctgcaaagaacctcctttttcactgaattgcctttgtacctttctcaagaaacagctgtccatataaatatgggttgatttctgcactccctgtttcgttccactgaactatttgtctatctttgctctaatatcatactgtctggattacttccattttataatatgttttagaattgacaaactggacttcctcaaaatgaaacatttctgctcttcaaaagacactgttaagggaatgaaaggacaagtcacagacagggagaatatatatatatacacatacacatctgcaaaaagtagagctgatatgggactactcatatccagaatatataaaaaactctaagatataaataataagaaggtaacctaataaaaaaggacaaaagatttgaacagatacttcaccaaaaaagatatgtgactagcaaataagcacatgaaaatatactcaacattattagtcattagagaaatgtaaaataaaaccacaatgagacaccaatacacacatattaggaatataaaaagactgaccatatcaagtgttggtgaacatacagaggaactagaactctcatatacttttggtgggaatgtaaactggtacaaccactttgaaaaacaacttggcagtttaaaaaagttaaacatacacttacatggtccagccattctattactagaaatgaaagcatatgcccatataaagagtacaaataaatgttttacttgttatagccctccttgttataggagttttacttgttatagccccaaactggaagcaacccaaatctccatcaataagtgattggataaatgaactgtgttatatctatattattcagcaataaaaaagaatgaactattagtgaatgctaccacatgagtgattgcaaaataaatatgctggatgatagaagccaggtataagacgcaaacatgctaaatgattccatttgtatcaaactctaaaacatgcaaactaatgtacaataacagaaaacagatcagtgccagtggtagaagggtaggaggaaaggaacaccaaggagcctgaagaaccttctgggagtgttccttataatacgttcattatcttaacatatattcattcagttaaggaacacatgttcattattttaactgtgataatggtcttatggatgtaaacatatgtcaaaacttattaaattatatatgttaaatatgtgcagtctattatatgttaattatatttcagtacagctgctaaaaaagtgataaaaaacatttgggccaaatatgaaaaacccaagactaaagtgaaaaattacaagactgttactgatcaatgttcaggcctattaaaatttcccctatcccaatggcacttgggcaactacttttcttgtatactttaggaagtawctaattcagacaggggactaagaagagactcttcacagtgcttgctgatagccccaaaatgcagcatgaaaccacccaaatgccaagacaaattgagaaaggttgacctttaaaatatgtagagttcagtacctttgaattaaattgcatgttcagctttggttctagttgctagaggctacttttttcaagtccacaattggctcccccaactgcgtttgaaattcagtaaaaccagcctttgcacctgcctttgttaaaatctgtacctaaattgtttggaacaagaaagaatagtaactagaagcagatttactgcagtctggacttagttgtttgggtgacctctttttgctggttttctgggttgattagactttgctaattgacagagtgtttggcgcaatagcccaggcagagccattctgctctggacttggatttggtacaagtattcctggtggtcaagtcatgtattttctagtttggaaacagacgttggaacaggactgctggagcaggtttgcaggattctatggtggagaaactataatgactttcaaaaacatgggccaaggtaatttggctgtcttttcattcccatctctaaaagaaagaacccaccaaagttcagagcatcttaaacattttgaagttgtgacagtgaatgtgaataattggtgtctgtgggactctaagggtagaaagcagggcttactagtgcttcttcttatttaacagagaagagcctggaaaaaaaaaaacctatagtcagacataaacatttcagccttatttattttcaaccagggaatagctaataccacgatgctgtaaagttcttgcatttaaatgtcctatttcacaggtccaaacccatgttccacatagtagtattataatagcaccatggagactatccagtaggatcctgaaagtcttcttacccactcttttccattttgctaagcacctggttaaattaaaattccaaacagtattattcagagacagcatggaacagcggattcttaattctggcccccccattcatcaagcacacataggccaggcaatgcatttagcactggagatactgaagtaagggattgcctctgccttcaatgaacctttggtctagagatggagactgagaaataaacaggaaattctaagcagagtgctgtgtacgatggagaaagtcctaaacagagtaatattgggacctgtaggaggccctcccactccaaaccatgagggtcaggcaaggcttcccaaaaggtaagagttacctcctcaaagaagcgggggaaattgtctcttactactctatgacaatgagcaaatcactcaaattctctgactctstcttttggaaraaataacatttactggttgcttttgaggattgaatcagatgagatatagaaaagcccttagcccagtgcttgmtaggggaaagatcaatattggttttcatctttcctttcttttttcctcccctcctacctccatcaggtggggagtgtgacttccggagcacactacacagaggagacttttggagggtttttagttgtcatctctgtcacttggtgtttatcttcctgcttctagttcattagggcctttttcttctgatgctggcttgggctgtgtttatgtctttcatgtgcttctgtgacacttcatcaggggaagtggctggccctctgagcaactgctggaggcgttgggaagatgggaatcaaatgcagcctctgtaggtgggtgtggaacagaacagcagtgtggccctgtgcatgtgtcaggggcaggcagcagccatcatctgtcctcatgtcctgcctgtggggtctgatgagaaaagaatgagttagtaatgaagtagagaggagagagagctgagtgctaagtggagaataaaatcatcttcaagtataactcaggtttactctggagctgtgtatcctgcaaatagtacagtattcccactcttggccaggcactaacagctgtggaagcaaatggtgtaactgcctttagggggcgttctgactggccagcaggcattactgatgcagggaagcaatgcagaaaactccacggcaagctgggcacactttgctctctgttgctctgtgtgtcctttggtttatttttctgtgtactctcccctcctaagaagactgtgctctttccaaacccaaatcaccttcttatgttgcaaatccacctaaccgtcagaattttttcctgcacagctgtcacaacaaacttcccctcatctgctactaaatgtatcagacactgttgtgcagtctgtgagctgccgactcattatccgagggctttccaatagaatctgatgttatccaaagcttctcatctgtttcaaagggaacaatttcctgcgttctctggagggaaatcaaacgcactacgtttaggaagtaggacggtccttcacagatttagtagatcgcaaggcaattatgggctgattattcccaacttagtgtttcctcacctcatttcccataacagcgactagagtgacctgaagatgggctttttgtctttccagtgagacatcgggaaataaatcacaaaaatcaagataagttgtggtacctttgatttccctctgtcctcttcccaagccgtttttggcactccctagaggaaaccagttctcctctcctcttttacttctgcagtgggcacttgggctccaagtatcttttttttttttttaagttcatcttcatcatcctttaaattaaacacctactcccctgataaatatgatgctctttttaacaattagtctttggatatagaagttgctgatgaggaaaaatccctttcagctggttacctatgcttttttttttttttttttttttttttgagacggactctcactccgttgcccaggctggagtgcaatggtgcgatatcagctcactgctgccgatgcttcccagattcaagcgattctcctgcctcagcttcccaagtagctgggattacaggcatgcgccaccatgctcggctaatttatggtatttttagtagagacagggtttcacatgttggccaggctggtctcgaacccctaacctcagatgatccacccacctcggccttccaaagtcctgggatttcaggtgtgagccaccgtgcccggccccatgcttctttatactagttctttcctcccttctcacctccagcctgggatgtrgtctccactatggtctttattccatactccaaatttgtctctttccaagtatcttcctaattcctttttttaaagttacctttttaatttcctgccgtgaaacatctgctgtatcatcttgcttccgccacttcctagaaaacttgttttatgaatgttctttctcctcagtataattttcctggctgtgccctgatgtagtgctacaatagttttattttacattgactgattaagcactttgaataattgttttagctccattatggcaaatctatttggcttaacacttttttttttttttgcaacctttgattaatgcctgaccattgggacagaaaggaattggcgcattaatttccccttgacgccacggagagctgctctttttcctgtgcaagagcctgaagcaacagatgctctgtgttcgtattgcaggggagagcacacactgttgcaaataagtatgtgtgtgttcccggtcagtgtttgctaatggtgctgtgtggcagccatttcatagcagagagcaaatgttaggatttagggaaaattgtaccagcatatcagattttaaaacggaatggtgaatttttgttgagttaacagtgtgtagctagacgatgttttctttctaagctcatgaaacttaacagctgtttagtgaagcagtattttcatatatgcctgtttgacaggtttaatagcaaattttgcagtaagtgacttgctgaacaggacttctggcttgggctgtaacaagaactgtatttgcagcaagattcattgagggtctttgtgctttagtgtttacgggaaggggaagcctggctaaagtgaggaaaactgaaaggcataatccaaaggaaattactaatatctctaccagagtattcctcagaacttgttattaactagtttagaggaagataacatggggaaaacatgctgtttagcaataaaaacacatgagtacaatcagcttactgtaacccattattgctgcatagtaattaaatctatatatctccaactttatagttttctgcagcagaatctctgaaagacttctgcacttcatctgattcaaggaagcctatattctctcccctgtctctggaaaggctactgtgccttgtaatagctttttaatattgccagatcgaagacaaatgcttcactggttttactgggagaaataaagcacttcctattacacttataggggggatccaagtcttgggaaactagcactttatgaggttagaatcccttttcctttcttcccatttttgagttctctcagatcgtaggacctcagaatcactcattcctagggctacccactttgtatttggctcctaagtgcatttttcaggatttatctgtgcttttattgattgcatgtgcttagttatacctgctgattgtgggtgtgtgcatgtatgacagaatcacagatcatagacccctgttctccagggcagccaccctcatggtcagcccagcatcctcagctaacaaaaggaccaagagctgtcttacatcctctttggatttccgcatagattttgcaagccgtaaatacaaaatttgtctagagttcatagttggttctgtttactggatttttttttttytttttttttttgagacagggtctggctctgttgcccatggtggaatgcagtggtgcaatattgactctgtgcagccttcgcctcctgggctcaaacaattctcacacctcagcctccagagtagtggggactacagacacgtgccaccatgcctgcctaatttttgcatttttgtggggggtgggtagagatggggtttcaccactgtttcttaagcagcatgtaagggagcttcatatttgtttgtctcagtcccatcatgatgtaggtcaaaagcaagttacattcagctagctgtatgacaaagatgcctccttttgaacagtaagaatttaggctttgttgttttatacactcaggcaacttgaaaaggataaaagaaaggtggagaaaagaatagtaaagtgagctcaattaattttctaagaaggcaawctaaaaacttctcacatgtaaacagtaagatgtcagggacacaaaatgagttagcccgtgttgctgggatgaggagggatagcagagaaatggccatatgatgtctgagagtgtggccagtgggaggagaggggtctactggtggacttctctcagcaggttgtcacctccacactttctcatccagagctcctgggattccctctaggaaggaatcattataccatttgccctgctcccatcatctcactaacctgctatcactgtagtaactccaagaaccagtgagacaagaaagagggatgtcatgagctgcctctgcacaactgttgaattcaattttctttcttcaagactccttcccccatgtttctctaatgcccacactttattcaggatgttgtgttcagtagcagagacatttgaaatgaagcttccttatcatggcttttaggaaaaataatggcaaaactattggatacaggtgaattctagtccaatatggtaggagaggtgagcctggaattgccctttttacatatcctgcagtctgattctaataaaagtagacacagttctggtacactactatgtggttatttccagaaatataaatgagtgttattttatatatatatattatatatatatawaatatataatatgtacatatatagtattgaaccgacagtaggtacttatgccttctaaaaatgtagtagtaagtgaacataggcaggcaatataggaggtgatacctgaattagttttgaaaggctctagcacagccaccaggcatacaattagggaggagaagtggatgtacattctataccgaagaatagttccctccttataacccaaagaacagtgctgaatacatcttacatgctttgtaaataggtactgtcttgagctgttgtaacaaagagaacatattggagaagaggaggctggaggcagggagatcagttaggagattattgtggtagttcaggttgaagcaatatatatatattatatatatataaatatatatatttatatattttaatgtttataaatatataaatatataaaacattatattttaatgtttaaacttttaaaaaatcagataggtaggacttcctttttcttttttaaataataactatggaagtgcagaaataatagagattctattgtgctctttacctggcttccccattggaacatctctacaactctagtagaatgtcaaaaccaggaaattgccattggtacaatctatagactttatttaggtttcaggagctgtttctaggtgggactttctaaggattgcaaaccccatggctttttctttttaagcaggtagaattgagggtgcagtggaagcaaaggctcatgtctggtctcttcctttctttctgtattgccctcctatcccccatcatgtgaaaaatagatactagaaaactcatatcaaaaagtacagtctggatgcttactttgcagggtagtatgttaggtgcccaggaggacatgaatgactataagaagaaatggttctgtaatttggaatcgtttgtttatacagaaagattcagctcaagacagtacctatttacaaagcatgtaagatgtattcagcactgttctttgggttataaagagggaactattattcggtgtagaatgtacatccacttctcctccctaattttatgcctggtggctgtgctagagcctttcaaaactaattcaggtatcacctcctatattgcctgcctatgttcacttactactacatttttagcaggcatgagtacctactaactgtcggttcaatactagatcccaggggttcaaacatggattctacacattctctacccacaatgagttcacagtttagtggaagagagagacatttaaggaggaaaatgcagtagagtgttatcagaggtataagtagaggtatgagtagggtatatcttgaatgctgtggggtttgaacaaaggaggaaaaaatgaatttctttagaagagagataactgttgtaacaaagagaacatattggagaagaggaggctggaggcagggagatcagttaggagattattgtggtagttcaggttgaagaaagataactgaaaccaaggtggagaggaagacctaggggaagggatgggtttgggggctacttaggagctaaatttaagagcacttactgattaactgactatagagttgaaaagagtgaggtgtccaaaatggtcccagatgatggggtggtggaagtgccatgcaccaagagggagagtctgggagaagatcagactctggaagaaaactcttgacggggtatggatgtattgagtttggggtgtctgtgggatgtccaaactgagagagctcactcagttatagatgagctcaaatgatatatggtgccttgatgtgaatgactttgccagttaaagtatgtagtaggacaagaagatcaaggagaagccttaggaatcactaaaatttaaaggacagatgggggaagggaccctgcaggagagattaagaaggagagcagagtgagaggaagaagagtgtttggaaaacgagaggcagtcaacaatataaaatgttttagatgtcagatatgatagaaattgaaatgttttcattggagttagggacaaaggacattcttattgacctgtgtgagttcaatttcagctggctggttgcaggagacagcaaaacagtagatcaagtagtgatttttaactatgaaacaattaagagtttggtataaggcaatttagttaagtgctaacatggagtgtaaagaaaagtgtaattgatattaattatttaagaaaatccataatagaatgttagagcagaaatgccaccccatttttaaatataaagagagatttcaagtaaattgttcaaggtcatgcatctaaagaggaacagccaggaccaggtcccaggtctgtttactccctttataaaagaaaattctggatagactagtttaaaggagcaaatgaatgtctgttgcaggaaaagtgattgttaaaatgatgaatcagagctgtatacttctattgtgaaatataactacttgtttgatgaatttattcatgtattctataaatattaatagatattgtgctatttgtttaatatgcaaagacaaataaacaattagttgtagagaacatgcttggtgaattttataaaagtaaaatattatcgccattaagtgatatagtctagcagggtgacagacacaaaaatggtatcatacaatgtgcaattgaaaaggcaggaaatagttttgcctaggagttggagactagtgagctgaatcttgcatcatgattgtgatttctccaaatggagaaaggattaaagggaactttcaacaaagggaacagtatgaacaaaatcagaccagtataaagaaagtctataacttcacagactgttaaacagcctggtggggatacgatataaaggtagggaaataacaaagaattattttgaagactagaaaagtattagtttgtttgtgctgctataacaaaatacctgagactgagtaatttacaaagaacagaaatttgttttctcacagttctgcagtctgggaagtttaagatcaaggcaccagcattcggtgtctgatgagggctgctttcagcctctaggatggcaccctgtggctgcatcctttggaggggatgaatcctacatcctcacacatggaagggacagaagagcaagagagtgcttccttcaacttctagcctttttataaggctgttaatcccaggcatgaggacaaagccctcatgacttaattatctcccaaaggccacacctcttaatactgttgcaggggattacatttcaacatgggccaggtatgatggctcagacctctaatcacagcactttgggaggccgaggtgggcagatcacctgaggtcaggagttcaagaccagccttgccaacatggtaaaatcccatctctactaaaaatagaaaaattagccgggcacagtggtgcatgcctgtaatcccagctactcaggagactgagacaggggaattgcttgaacccaggaggcagagattgcagtgacccaagactgtgccattgcactccagcctgggtgacagagcgagactcagtctcaaaaaaaaaaaaaaagtttcaacatgaattttggaggggacaccatctcaaaccatagcaaaattcataaccataatactgaacagtaaatagtggggaaacagatgttttaagccaaggtgtcctttgatctgggcttaagataaatctggtggcaatgtggaagatgagttggaaagggacctctgtttaaggcagtgagatgtgtgcagaaatgtgtcacatgagtgataatgaggttgtgagctagggaagtgatggtaagagtgaagaggagggaagttagtcaagaaagaatttgaaggcagaattacaggcagggtttggcaagtgttcacctgttcttcctgagggaaaaagaagaatccgaaaaaaccccacagtcatttctaacttattgactagggtggggaataaagggagagcaagtttggaaaggaagattctgagtttggtgttggatatttagaatttcaagtactttgggaaatctaggttaaccatacatgagatcctaaacacagcatagtcataggtcttgcttatggtgttaagtagtgtaaacaatatatttaattatggatccccaagaagcacttaaaagtagtttataagttggaaatgtattcagatacacggcacagaaaatctgactaagtggctaaaagaaatagagtttatttttctcatatacaggaaagttggtgatgctggtattggttcaactgctcagtgatggcaagaccagttctctgggacttgccatcatggttataaatagctgatgcagctctagaaacataaccactttcttgtcaggtgcttctgtttgggtctgtttgggtagaactgggtcacgaggcctcctctggctggaaggttggctggaagagcgggaagaaaattgttgaattcacttaaatacatactttcccatcctattagacacaattcctctyttttaaaaacaaataatttgtaatgccttctttattatcctgaaataaacatcatagacaatctgcttgtgtacatttttaaataaatatattatcctaactgtaatataaaggaacaattaaaggaaaataatttataattatttcaaaatgtgaattctaaggcatgactgcactagaagacataatgaagaagtcagattcttgcacggtgaatgtgacagcaacatatgcaagtgatacaagggtatggtaatggtgtttccagtaccacaggcagcatattcatttgtgttttacttaaaagatgaccaattttgggtcaagttctgcacaaaacacagcatagtcttctcttgatatacaagatagttgtttcttgaaagagtcaacttgcatgaaaactgtgcaacaacaattttgtattcgtatacacaatagagttacattcaaggccaaggtaataggtttttcacatttggaaagctatttggaatgtaggagagttcttagtacacagattgtcccccacatagctgtctgtctagtgtcyccggcctctgccaactagttaccagtagaatctccataccatggtgacaagtaaaagtgctccccccacatattcaaaatggcccctaggggcagcatcatccatattaaaaacaactggcttagattaatgggactggacactttgtactccaaacaaaatggaggttggttagcaaggaaaagggggaatggatattgaatagggaattaagtgtctaccaatagtaggaactgggttttccttatgtttgtatcttttcccaaattcttgcagaattccttgcatatagtgagttctcaataagctttcttgaatgactgaataaataactggaatgtaagctatgggaaatggaaacccagtattatatgagctttgaataaaggcaaaaatcttccttaagatacttaaagggctaactaccgtaaatccaggaatattgtcagaagttgggaagtgaactttggtgtgccagtgtctgtgctaggatttagcacttctggactttctgtctgttacacattctagactgaagactgagggttaaatttatatcagtgaatcctgttcaggaatggagggtttaggggaaatatttaagttttcatgtaagtagtatagaagaaaaagtaactgtcacaataaaagatcaataaatctcaggctttaaatcttagtctctctatcttttagcacattctctttccactgtgttcttttccacttctgtttgtctrttcgctctggcatttttatcatagcctgagacattttcgaatgataatttttaggagaaatatttagaaacagaatcaaagggctttgttttgtttcctcgaaatataaacctattattagaatataattcmcagtatgagaaatgtaggttttgcttgagtttgcttccagatttaagtagaaaagaaagaaaatgacattataaagaattttatctctttttttgtgaaaaagataatctgtaactatggattgtgaagacaatatatgaaaagcaaatctttttcaaacagtgctccaaagttgcctttgaatatataacttctgaattcaaaagcatgatacagcatgggtttttaaaaaaatagttgtttaacattttgaagggtataacatttgataactccatactttgaattcaagtgaaggaacaataacttcaaccttttgtttataagaataaggaacactaaaaaatgttgtgtagtttaagtttagacatttcaaatagtcctataattgcttgagagagcagtagagtttttttttcaattagtttattagtatttcagggattttaaatggaagaaaatcttgagtgtctttgtaaatgaattgcatcttttataggcacagatgtttttcgcagcattattttcatccccatggctgctttacaatatgtggcctatggagaaaatgacaagtaggtagatgatgagtaggggaaaatggtggaaggtacagcagcaataggaaggaagtattccccaaggtttgcctgaaaacatctactttgtgaagctccaacatttatggagcaaaatgccctagagtgctgcaacaggagacacaacttaccacccctcatacggaaggatgggagggagaaatggaaggggaaagggaaggagggagaattcctgtgatcttcactacccgctgtctccttagcacagagaattcatccattgccacatcagcacaaggacaacatatgaagttcctcaaaatttccaaataagccattacttattacctatacggttattccctaaaagtttcacactgaagtaaacaagtgtttttggtcatttcatgccaacaaactgatggcccttgatcatcatcctttgaactgactccaggtctagaatgaattttcctatgtatggtgaccctaagtctgtgtcttagaaaatatatatatatatatatatatatatatatatatatattttttttttttttttttttttttttttttttttctggactcactgcaaactctgcctccctggttcacaccattctcctgcctcagccttccgagtagctgggactacaggcgccctccaccacgcccagctaattttttgtatttttagtagagacagggtttcaccgtgttagccaggatggtctcgatatcctgactttgtgatccgcatgccttggactcccaaagtgctgggattacaggagtgagccaccgtgcccggccaggaaagaactttttaaggttgcccttgaataccggtcttgattaagttttattctgtctatatatttcattattttaattttataatacatttctatttcttgcttagaatttataaattatatatcagattatgatttctgtgttttaaaaatacctattatatcttatgctggttttcttaagtggaatgtgatatattaatatcttgttccatttttgttacttctccaaatatagacgattagtaatattctactatttattaatgaaaaactaccttagttggcctaatgtaactatctaaaaacaataataataaaattctgtagtgctgttagagagatatatgattatgcattccagccaggaattacatcagtaatttttagattatattccagggaaaaccaggttttgggtcaactaacacctatttattgttcacttatgttgaaggttctaggtgatttctcatatagctcattgttttgtgccttcaatcttagtaaatcttctaaagtgctaccgatatactcagggaaaactaactttgttaaaagaatatcttttaaattaacctacttttaaaaataagcattattatgtttgtggaatttgaaaatacagtctagttaaggtatttagaataacactcagtttctgtttcaaagtgattatatcattttagtatcaaaattaatttaattgaccatataaggagacattaagtattattataaaaatggcatgttatggcaaagtgtggtggctcacgcctgtaatcccagcactttgggaggctgatgggggtggatcacaaggtcaggagatcgagatcagcctggccaatatggtgaaaagctgtctctactgaaaatacaaaaattagctgagcatggtgacaggcacctgtaatctcagcttctcgggaggcataggcaggagaattgcttgaaaccagaaggtggagattgcagtgagctgagattgtgccattgcactccagcctgaacaagagtaaaactccatctccaaaaaaaaaaaaaaaaaggcatgttatttattaatacgagtgacatacatgcaaaaggatgtctgacttaggcaatgttattttctggacatattttttaaatagactgtgacctaagttctggtggtccctctagaaagggtaccattccctcttctctgcctgctgagccatttcctaagactgtcttcagatgttatgtcttctctagagcttttcagcattccttttattcttttttttgttctcatggtactctatgcatgagaatgtttgagtatatatatattattacagttatttgcctcttagactgcatttgggtattcctctttgagtttctatttcgtgtaaatgcatatggtttcctataaaaaacacaatttataatcctccaggaagtctgtgtaagtcagtcagtcaaattacctggttgattatagtttcaggtttatctgctgcctgggaatcaaaacacaggtcttgattaactttctataaagcaaggatatggactagggatcactaagctctcttwtatctctacaatggtgtcattatatgattctaatccatcactagaaatgtattgtgaaatagttaattaatgtttgcagaatgcttagagaacttttaatgagaagtagatatttgtggttagtgctaatgaatagatgtcttatgaaccttttttttgcaccaacaacacattggaaaaatgtactttcaagaataaattgcaatctggtgaaatttttytattagttaacaaaatttagcttttaaaaacaagtatcagtatagtggctttagtggctttagaaaccaggaccctatgcatataaatagttgtaataaaaagggaagcagcaacagtgtatagttttcataatttttcaaaatagtwtaaatatgatagcaactttttactcttacagcttagttgtgaaggaggcaaggccagtactcttatactctgggaagctaagacctagagagattaaatgctcatttatttcttaaataaaaatgtattgagtgcctgtatttgagtataacaattgaaggtgcagtggtgaataatttaccctacttgactttgatagtaagggagacaggtttataaacaaacakattagctgatagcatagttaattatggtagaaacacagaagatggtgcaaataactctggggtgttgtttagtgagcctttacagaaaaggtagtttttaaagcattttcattaaactgtaagtggaggcatttgccagatgaaggggaggaggtgaggagaagggtctttcaataaaagagaatgaacatatgtaaagacccagagttatgaaagagcctgtgcgtttgaagaacagcgtgaagttcaatgcagctagagcaatattgtccaatataaatatgaacacaaatgtgcaatttaaatttttctaatagccatagtacagagtaaaaagagacaggtaaaatcaataataacacattttatttaacccaatttatctgaaatatttatttatttttcaacttaagtcattaaaatcaaatcaggtgaatattttacacttacaaaacatttcaatttgtcttccttccttcctttcttttcttttctttctttctttttctttacttttttttttttttttagggactggatcttgctatattgcccaggctggtcttcctgcctcagtctcccaaagtgctgggattacaggcatgagccactgccctcagcctaagacatctcagtttggactcaacacatttcaagggctcaatatatagaagcttagcaatgcatgtatatgtatgtgtgtgtcggagagagaaagagagtgagaatgaaaatctgtgtgctctagagggggaggaggttagataaggttgaagtagttgttggagtcatatttttaaaggctctgcatgctggcttattttagaattttttcttataatttagtagtttatgattgtgcttctcatattatctgtggtgaaggaacaattttgaaaattttgcatttgttatagactaatgctttcgcaaaataataataaattagaaaggtgaaagtaaaaagacatacaaagagaagcaccattttttaatcattaaagttgacaagatgttgtcttagtctattttgtgctgctataacggaataccatggactggatagtttataactaacagaaattaattggtttacaattctasagcctagaaagtccaagattgaggggccacatctggtgagggccttttagctgcatcaaaactttgcaaaaggcatcacatagtggaagggcaagagagggagagagaaaaagcaagagggggtaaactcactcccatgataaataacccattccctcaataaaggcatttgtccattcacgagggcaaatccatcatgatctaaacatctcttaaaggtcctaccttccaagaccattacaaaggcaattaaatttcaacatgaatttggagggacaaaagttaaacccatagtattcctcctgtcatgtttttcttacatacaaaacacatttatttcatcccaatagctccaaagtcttaattccttccagcaccaactcaaaagtccgaagtcttgtctaaatcagatatgggtgagacataacacaattcattctgaggcaaattcccctctagctgtgagcctgtgaaattatacaagttatctatttccacaatacaatggtgggacaggtataggatagacattcccattccaaaatggataaataggcaaggaaggggtaactggttccaagtaagtccaaaacccaatggggacaacaacagtaaatcttaagcctcagaaataattttctttgactccatgctgccctgcttcctggacacactggggaaggggttgagcccccaaggacttggagagccctgcacctatggctttgctggaacgttggagtcttatgcttacagctctcctgggctggctttgtgtgctggtatctacagttcaggagtctcaggtgtggttctgcccctgcagcttcactagacattgctttagtggggactgtttgtggcagctctgctcctgcagcagatttctacctggatccccaggctgtctgatacattctttaaaatctaggtgaaggtagccatgcctccacagcttgtgaactctgtgtgcctgcagaattggcaccgtgtggataccaccaggacttactgcttgtgcactcaggagcagaggccttagctgcacatgtgcctgctcaagctatggctggagcagcttaagggcactgcaccagaatgtggggaacagacatttgggtaggtgaggtgcagggcagttaattctgaggtcccctgggtgcctctttggaaactttgccctcaagattctagcttgcctcagagatccctgaagtgcctttgcggtcattttcttattgtcttgatgaatagcacctggctctttactagccatacaaacctttctagcaaatggttgtgtggccacatcttttgtttgcactcctaagcacacatttttattctttacatggccaggctgtgaattttcataatttttatgttctatttccccttaaattatraatactgtctttaaattatttctttcccctcacattctattatatacatttaaaagaagccacacagctccttcagtattttgcttagaaatttcttccatcagatattctagtttatcactcttaaattctgccttctgttaaagccctcaggcatggacacactttagccaagttttttgccacttaataacamggatagcctttactacagtttccaatacgttgttcttcatttccatctgagacctcatcagaattgcctgtactgtccatatttctgtcagcattctggtcatgaatctctaagaagaatcactcaagtaatctctaagaagttcccgactttctctctggctcatctgctcttctgagccctttccagaacttcccttaatactgcattcattgtaatctaggcttttcctaggctgctcttccaaattcttccggcctctccccgttacccaatttcaaagctgcgttcacatttttcgggtatttgttataacaacccacctctctggtaccaatttttgtcttagttgtgtgagtgtgtgtgtgtgtgtgtgtgtgtgctgctttaacagaataccacagacggagtaatttataaagaatgaaaatttattagctcgtggttctgcaggctaaacagtccaagaatgaggggccacatctggtgagggtcttcttgccacatcataacatggcagaaggcatcgcacagaagaagggcaaagaggggatgagagagatcaaaggagacacaaaccccttcctrcaataaacattagtttattcataaaggtggagccctcatgtcctgaatacattttgaaagtccaaccttataataccgtcacaagcgcaattacatttcaacatgagttttgaaggggacaaacattcaaacaatagcagacatatagtttataaaaaagtgtctaaaccagtgctatccaatagaactttctgtcatgataggaatgttctgtctgtgctgcttaatataatagccactagccacacgtatctattgagtacttgaaatgtggctagtgtgactgagaaaataaatctttagtttaatttaattttagttaatttaaattgaagtgaccatatgagacaattgattactatattggacagcattgaatacatttactcataatctctgtatttacctattgtgcattagtaaaaaacagtttgtggactggtatggcccacaaacccatgctttgagtagcactgtttaaagcatggactctagagctagaaagcctttgtgtatctttggcaaactgcttaatckcttggtgcctcagtttcctcatttgtaaaataaaggtaataataaactaccttatagagttgttgtgaggattaaatgcattaatgagtgtagcatacttagtacaaggtctgacacacagcatgcactatataaatgcttcctgttattgttattattatttattatgtaggtggtggatatcaaacagttaattggtaacaaagcccagtctttttattaattctctgctttttgcagtagcttagactttttccttttaaaaacataccacagtttgtggcatctagtggcttccaataaataccttttgaacataagcataaagtacttttcaagcacagatgaagaagcaattattgttctgaggtggggggggggttggtaaaattatcaaaaacagatgacagctgagaaggcctcaatggaggagtctgacaggcaaagaggagagaacacacctggtggagggagmaaggacacccatttggattatactctatttaggagactatacagcaggtaacactgacttagccctatcactgctaccaccacttctttctctccttcccagctcttttcttgatttatccttttagcatattttaaacaggattaataggtaacacgtgattctacagttttaagggaggtcaatcgttgcctctttacttgttcattcctcagagtaacagtgcctgaatttgatggtggatgttgggcagtggttgggaagggaaggggaatgctgcttgaaaagcaatccctgggttatgggcagatagctgtgagattcttttcccctaaaacataatgtttcttatttatgtagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaartaaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaatmccccactgggagaggggagaagaatcagctgtgatgctggagccaagaattcataagatagccatcctgggtcttggcagcarcattgggactcctccagaaggtattgtttgtcttttcagtttgatttgtattttataaaactaatgtcccttggtgtaattgagtacaatatgcatgattcatattataatttggataatttcctattccattggcttaatgagttctctaccctttttygtcctcccattttttacttctgtttcttttgtgaaagggaactgatcatgttggatcgctttttaaatgtagaatctgtagctactggtccatgatacttaccagccctatcactttgtaattgctatctagttaaacattagcatggttctatagataattgaaatatacataaacaggatacaaaaacgatgacttcttccaagtggcctcagtgtgaataattttttagaattaatgaaatagagaatagaactttgcactctgaattgatttaattatttttatagaactgaggcttctcctgcaaggaattatccaaggttgagttctacctttacttataagcaccctggatcagctttatcagataatatacagtaaatgcccagatcagggatgtatagccagtcatcagggagctatcagttagccttgaatatatccatgggctaatttccggtggcagaagaacgagtttctattcttttgacttttttgaatgccaagagaaaggcctagtgaagtacattgtcagtttaaaacattatttattgagatataattcacatactatgatgttcatgcatttagaatgtacaagcgatttttaatatattcacagagttgtgcagccaccacaatctaattatagaacatcttcatcaccacaaaaagaaactctgtgactattagctgtcattctccagtctacctatatcccagccctaggaaaccactaatctgctttctgtctttatggatttgcttattctgggcattttacatgaatggaataataaattatgtgatctttcatgaattctttttttcatgtagcatactgttttccaggttcatctatgttgtcacatgtttcagtatttcattctttttattgctcaataatattccattttatggatgtaccacatttttatttatccatgcatcagttgatggacattgagattgttttcaccttttagatattatgaatagtgctgctatgaacattcatgcacaagtttttcatgtgaacatttgttttcatttctcttgggcatataccaagaagtagaattgctgggtcatataccagctctatgtttaactttatgaggtattgccaaactgttttctgaagtggctgcacagttttatgtacccactgacaatgtattataatttttccatatgcttgccaacacttgttattatctgtcttcttggttatagctattctagtgggtgtggagtggtatctcattgtggttttgatttgcatttccctaatgacaagtgatgttgagcatccttccatgttcttactcgccatttgtttatcttctttggagaaatgtgtatccaaattcattgcccagtttttaatcggactatgagatttttattatagagttttaaaagcttttttaatgtattgtatatacaagtcccttttcatatatttgatttactaatgttctctcccattctgaggactgtcttttctttttttttgatggcaatatttgctacagaaatatttaatttttgattagtccaactaatttattttatttcttttgttgcctgtgcttttggtatcatatcaaaccattgcctacaccatggtcacaaacatttactactactactgtaatgtatctaggtatgtatatctttactctcatctcatattttcttctaagaattttatggctgccattcttacatttatatctgtgaattaattgtgttaatttttgtatatggtataagataaggcttcagctttcttcttttgaatgtggtcattcagttgtctcagcttcatttgttgaaaagactattctttctcctttaattcggtgcattacattaattgattttcaaatgttaaacaaaccttgcattactgggataaaccccacttgattacaatacataatcttttttatatggtgctgaattcagtttggtggtattttgcttaatattttgcatttacatccatagggatattggcttgtagtttcattttcttataatgtcttttttttttttttttttttttttttttttgtatcagagtaagactggcctcatgaaatcagtggcaaagtgtcacctcaccttccattctttggaagagattacaactgactgctattaattctttaaatttctggtagaattcaccagtgaagcaatctcattcacgcttttctttgtgggaagatttttaattattaattcagtttctttacttgtctaatcagattttcagtttcttcttgagtcagttttagtagtttgtgtcttttgagaaatgtatctgttttatctaagtcatgtaatttgttggtatacagttatttatagtatcttattataatttttttatgtttgtaaggatggggtctaaatcactgctgtcacttgcttttgggcagaacaactgtttagatttttctagcaacaaattctctgagcctttattcatctttatctctttgcttaaccttcagttttgaaagatagttttactagacatgagattcttagttgaggggtttgtttttcttttctttttttcttttctttctttcttttttttttattttcagcactttgaatacattatcgatcccattgccttctggactccattgtttctttttctttcttccttttttttttttgagatggagtttcactcttgttgcctaggctggagtgcaatggcacaatctcagctcactgcaacctccatttccccagttcaagtgattctcctgcctcagcctcccaagtagctgggattacaggtgcacaccaccatgcccagctaattttttgtatttttagtagagatgcagtttcaccattttggacaggcttgtctcaaactcctggattcaggtgatccacctgcctaggcttcccaaagtgatgggattacaggcttgagccaccatgcccggcctggactccattgttttgatgagatgtcagctgttacagttttggaggtttccttgtatgtgctgagtcatgtcttctttattgctttcaaggttttctttttcttttgatttttattattttgactctaatgtatctaggtatatatatctttattctcatcttacttggaggttgttgattttcttgcatgtgtagattgaagtttttcatcaaatttgagaagttttcagctatcattttcacaaattctttttcttcctttttttctttttcctctccttctggtacttccatttacagtgtgttggtgatttaatgatgtcccatatttctcttatgctctgctcatttttctttattctttattttctttgttcttcagattgtatgacctctatcaatctgtcatcaagcttactgattctttcttctattagcttaaagctactattgagcctctatactgaatttgtctttttagttactatacatttaaactccagaacttctctttggtctttttaaaaaataatttctgtgtctttattgatattttttatttgatgagatgttgtcatcatatctgcctttagttctttaagtatggtttcttttagttccttgaatatttcaataatagcttctttgaagtgtttgctatatcctacatctgggccccctaaaagacagtttctactgcctacttcttttttttcatgtgtatgggttgtactttattgtatctttttatgccatagttttaaaaacagaaaacctgaatatttaaaataataatttaaaataatattttatggcaactctggatgctgacttgtcttcctccctttcccccatccatttacctggtcattcatttgtttaatcgcttgactgtactaactctgtgatgtctatttctcctacactgttcagcttctgatgttcctgtttagattgtttttctgttttattttttgtttttcttttggctgggttccctatgagtcacccgtaggtctgcataagccacttattggtcaaaggttatgcttaggttcctttagacagttatatttttactctttgccatttgatgtttttatggcttggagtctgttattacaacttaagaagtttgttttttcccccaactttggccaaggccaaatgccttggaagttccttttctaatcacttctgagagggtgcggccttgagcatgcacacagccttccagattaccagaatgcaaataattttatttttaagcgtggcttaatagtattttctccagggtcagaatagcttattttttagccagtgtttgctcagaggttgtccttaaacaccttgagtgagtgagatttctgccctttgttgacggatctgtgtgcagcttgggaaatgttttcaagtctgacccatgtgttgttttgattgttcctgagtaggtatgacctaggacatgtgtgtagcttttcaacccccagggtttactgggatcccaggaaggcccttcttggttgtttctttccttggttctttctgttaaagctatggttgttctgccattttgcttgttgctagcagtatcgtgaagctaccagcacccccttaattgttcttcaccaagctctccattattttcagcaacacccttaagtagggaattctccgttctctgcactaaatgaagtcactaacatcaataagaactatggagctcttcatccttatggcttctctcttcccccaggagaacattcgtgctactgcaagggagctagatgcagtgatagtggcacctcccagtgtcacccagaatgatatccctagtggatgataagaagggaggaggtagttctcagccttgttggcttgcagcttccagtrtgggaccacctcctatgagtgagctgagaaaggggtgatcagagtcttagtattcttgatggctacttagggtagagtttccaccctatgagtaggacttgggtagaggaatggcacctcagttctcttggcattgcttgactagaacagaggttctaccacaaggtaatggggttggggaatgagaaacactggtagtctgtccttccaaaggtgaaactgtagccctaaactgagaattgggtggagagaaagctcttacgttcttgtctgcacttggtcagaatacggtacctgtagtagagtttctgtaacatggggctgggggtgggagaggaaagcagatcatgacccagatgccacagactcttactgttctcatcaagacttggtaaattttcttggatgaatgttgtcctttgctgtatgcccttaggggagttttgagagacattaaattattttttawataatttttcccactaaatattttgtggggtgaagatctgctgagttactcatgctgccatgctggaagaatcactgggatagccagttttgatctctctaaggctgcatgaataggtggtagaattctccaaggtattagggagctccttagcttgggttctatagtgttagtcagttttcttcagttgccttctgttaaatgctaatctatgttagacaccaacttaaatcctcctttttaagctctctcaattgtccagttatctgaaaaggattagcactttttttcccagatgagagaaccagactccaagaggttatgtaatttaccaagggttgcacaactggtaagaggccttgtttgggcatgaacaactgtcaaactccagagtttgtgcttttagtcattagactatattgcctcacatacaaatattttaatgttgtttcatttataagattactatttttagccatctagctgaagcagatctgtttcaaaagccgttgatacctgtactgtgacagcagaatatattggtttttgtgtgtttttttaaagaaagttttcttattcccatttctttctcattgtcatttctgattctacaactgggcctcctctttcctggctacctgcctggtattgaaaactaagccaagttactgattgctcctgagaccttcaaaacccagaggatatgaattttactcaccggaatctattctgttttccaagactcactttcaccccactcctcgttccatggggctcaaagtagataaacagttgtctggcaactggactattttaagctctgaagagactggagagttaggctggaccaggtgtggaaaagtcccacaggagacagtgtaaagttggcgtaacaggatctctaatccaggcagagtggtgcagagcttatcttctagcctctctctcaggaaacctgtcttctcactttggcttaccactaactagttgtgtgaccttggttgccatttaatcatcatggccttgatttcgtgacctgtgaaatgagagatggttggaatgttgaatctgtaaggtctcctctagattggaaagggtaatttttatgagactccataagggatcactgaagctagaatttacaggagctggattctgccaactatatgtgatggagtagattctttgtttaaccagattttttaactttttaattctagacttgaatattacagtatgtatgttagtttatgcactcttctcaacttcagtattacagtaggtatgttagtttattcacatggcaggattgagagctctgcaagttatctgtggagagtttgaagaaggcagrtatacaagcaggccaagtccgaagagatgaaggacaaacttacaagacaggagaaagcacaatctccaatcagtcctgagataacatagcatacatcagatttgaatggaccaagtaaaagaatgagaatcaacagtcacatctgggacaggctgacatatgttcaagaaagaggaacttgggcagactatgcggttctttcccagcagacataactctgggtcttcatggtttatggtctctgagcccaacacagcaggtcattgagtatttattaatcctcattggagactgacatctctaccgaaatacagggctttcttaaaattttaggattgtatgtttttattatgtttggtgtatgttttattatgtttgtatgccatattatgttatgttttattgtatgttttatattagttagggggctcctggcggcctggactgagtcttatccatttctatattctcaacatctagcatcatactcagtaaatagttactcatttagtttactcatttatttgagaaacagtggatttttaaggtagttctttccttggggtattattcacttgtactaaaataaggccttcttctacattgtattagtctgttctcatgctgctatgaagtaatactaagacaggataatttatagacgaaagaggtttaattgaatcacagttccacatggctggggaggcctcaggaaagttacaatcatggcggaaggcactccttcacagggcggaaggagagaatgagtggcaagcgaaggggaaagatggttatacaaccatcagatcttgtgagaattcactcactatcacaagaacagcatgggggttactgccccccatgattcagttacatcccactgagtccctcaataagatttgggtgggacacagccaagccatatacataatgaatgatgatactgttgagccatcatcatttactcagaatttccctgattataaaattaatacttgcttattatagaaagcatgtacataaatataaaaataataaaaatcacctgtattggtccattttcacgctgcttataaagacatacccaagactgggcaatttacaaaagaaagaggtttattagacttacagttccacgtggcttgaraggcctcacaatcgtggcagaaagtgaaaggcatatctcacatggtggcagacaagagaagagagcttgtgcagggaactcccctttttaaaaccatgagatcttgtgagacttattcactatcatgagaacagcatgggaaggacctgcccccatgattcaattacctcccactgggtccttcccacaacatgtggaaattcaagatcagagttgggttgggacatagtcaaactatatcattctgacttggcccctccaaaatctatgtcctcacatttcaaaaccaatcatgctttcccaacagtttgccaaaatcttaactcatttcagcattaactcaaaagtccacagtccaaagtctcatccgagacaaggcaagtcctgtccacttataagcctgcaaaatcaaaagcaagctagttacttcctagatacaatgggggtacaggcattgggtaaatacagccattccttgtgggagaaattggccaaaacaaaggggctacaggtcccatgcaagtccaaaatccagcagggcagccaaatcttaaagcttcaaaatgatctcctttaactccatgtctcacatctaggtcatgccaatgcaaaatgtgggttgccacggtcttgggcagctccatccttccaggctgctttcatgggctggtcttgagtgtctgcagtttttccaggtgcacggtgcaagctgttggtggatctatcattctggggtcttgaggacagtggccctcttctcacagctccactacgtggtgccacagtagggactctgtgtgggggctctgatcctacttttcccttctgcactgccctaggggaggttctccatgagagcaatgcccctacagcaaacttctrcctggacatccagatgtttccatacatcctctgaaatctaggtggaggttcccaaaccccaattcttgactcctgtgcactggcaggctcaacatcatgtggaagatgccaaggcgtgaggcttgtgccctctgaagccgtggttcagattctacattggcccctttcagccacaactagagcgactggaacgcaggtcaccaattccctagatggcacacagtatgaggatcctgggcccagcccatgaaaccactttttcctcctaggccttcaggcctgtaatgggaggagctgcctgaagacctctgacatgccctggagacattttccccattgtcttggggattaacattcagctcctcattatttatgcaaatttcttcagccagcttggatttctcctcagaaaatgggattctctttactatcacattgtcaggctgcaaattttccgaacttttatgctctgcttcccttataaaactgaatgcctttaacagcacccaagtcacatcttgaatgctttgctgcttagaaatttcttctgccagataccctaaatcatctctctcaagttcaaagttccacaaattgctagggtgggggtaaaatgccaccactctctttgctaaaacacagcaagaatcacctttgctccatttcccaacaagttcctcatctccatctgagaacacctcagcctgcacttcattgtccatattattatgagcattttggtcaaagccatttcaacaagtctccagggagttccacactttcccacattttcctgtcttcttctgagcccttcatactattccaacctctgcctgttacccagttccaaagttgcttccacatttttgggtatcttttcagcagcgccccagtctactggtaccaatttactgtattagtccatttttgtgcttctgatgaagacatacccaaaactgggcaatttacaaaagaaagagatttactagacttacagttccacatggctggggaagtctcacaatcatggtggaaggtgaaaggcatttctcacacggtggcagacaagagaagagaacttgtgcaggaaattcccccttttaaaacgatgagatcttgtgagactttttcactaccaccagaagagcacaggaagccctgcccccatgattcaattacctctcaccagatccctcccacaacacatggaaattcaagatgaaatttgggtggggacacagccaaaccatataatcacctatgatattttcctctagagagtcattgctatcatttctatttttccttttgatatttctatatgcatatgtattttattttataaacttgtgttcacactgcatatagtttgtgtccttttatcttatatatcatgaacatttaccacatactagtaaatatctttttaaataagttttaatggctaccaaatttaaatatgcaataattaatataatgccttgttattggaaactagattattttcttatttttttctcttcttttaaatagcatgggtataaaatcttttaatgtagaaagaagtatagacttttaaaggaaattttatgtttttaataaatgacatataaaggaggaatcattggtatattctaggaagttgtaggagagtagaaacaattagttttgaaactgcttgtatagatgtaaaaaatgccaataaagttcttagaagctgttttattttttagtggttttagttgtttaaaaatgttaacacaatagatatgtaaacattatatataatgtacattttaatgatacaacgtaaatatatattttaattactttaaattattaatgtacatattgatacatttatattcttgatatattttgttaaattgttttccagattgtacacacctattctcttattagcagtgtatcttcaaaaccctgcaccttcacctgcatgggtattttttcctaatctttgccaatttgatgaaccaaaagtgatatttccctattattttactttgcatacctttgcttattgttcaagttaatattttcatatgtttactggaagcatatttttcttctttaaattatttgagcatatctcttgcctatttttctactggtgctttaatgatattctaattgatgaataataattcattattaatgaattattttaataaatcaattgtaattgattgtcctattttattcaaattgagtgttttaaaagatattaagatggtttgcattgatatatcaccttctttttcattttttcttaaaagcatatttctttctgtattttgaggatgacttagaatgtagttaatagactgcaaaatagcaaagttgactaatttccactccctctcccctatcaaagtgctctaaggaacagttctttaggttagcttacacatactttggaacatcagtgtcattattcgaagattggtgaatgccatgcttttgaatatgtaccagcaaacttaaggtctcagtgtagctagacttggatttttgagctgtgtatatggattggtacttctgctggtttatgtcaaactgtgtgtaccttatgacttttccttttgggaataatataggagtgagaggaaggacaggtaaagagcactagattgagctcaatgtgcagagttgactggatagttaatgttgagctgtggagattagcatctcctctaactggtttaaccagctatgaatatcttacaggattttaaatggtttacagaatcactgggtaagctaatgatgcagattttaaattgagcttctcaggaatgaatttgagaataattctgtagaaccaggctaccatgattcctgttgcctttcctagattaagcaatggcctttgtcagaaaactgccacagaaaatctagagattttcacaatggtgcttgtctctgaaacagcagaaaacagtctctgtctaattcctgctttccagatcttgttcaagtgcaaaaaattggtgacacttaaattacttctagaaccctaactgtagaaaatcccaggaatgtagttcttaggtgttcagtctttgtgactcagaaaagcacatttgaaggaccttgaatggatgttgaatgccaactctccatatctaacacaatactcctttcattatgtcccttaatcaacaatatgatatggacttttttgcataaataaacaagaacagattgccattggttatatagtacaagtaacactaccaatarcattgtggtcctctgtggttataggattagaatgaatttaataggacaaaaaggaatatagagcataatcatgaaaggaggtatctccaagggcattctgatggattgaagggaaattgctttaggctgtttgtcacatttgccatataagttaaagtaggtttggctgggtgcggtggctcacgcttttaatctcagtgctttgggaggccgaggcagatggatcacctgaggttaggagtttgagaccagcccgagcaacgtagtgaaactccctcactactaaaaactacaaaaattgccaggtgcggtggctcacacctgtaatcccagcactttgggaggccgaggcaggtggatcacgaggtcaggagatcaagaccatcctggctagtgtggtgaaacccagtctctactaaaaatacaaaaaattagccaggcgttgtggcaggtgcctgtagtcccagctactcaggaggctaaggcaggagaattgcttgaacctgggaggtggagtttgcagtgagcctagattgtgccactgcactccagcctgggcggcagagcaagactccatctcaaaaaaaaaaaaagttaaagtaggttctccttcattttttataccctttccctttatctgttttgtatgcttctctttcctaggccatatatatatatatttctggtcttactctgttgcccaggctggagtgcagcagcacaatcatggttcactgcagcctgagcctcccaggctcaagcagtcctcccatctccatctctcaagtacctgggcccacaggtgcatgccaccacacctggctaatttttcgattttttttaataaagatgaggtcttactatgttgcccaggctggtcttgaactcgaactcccagctcaagtgatcttcctgacttggcctctcaaagtgctgggattacaagcataagccaccatgcccagcccctagacctcatcttaaagactggcatttcaaaggtttctatcttttgtttataaacattctccttaagtgatatgatgcagttccatggccgtaagtaccaccttgtgcttcagccacatggggtctatttgcctttccctcaacatgtgagtaccccttgccttaaaagctgcttcttggacctctgtctaacctaaccctaaccctgaccttaacccaactcaacccctctctgcttggagaatttatactagtttttaaagactcatttttttctttgaagtctttctggaaccccaacctaaataaatttaattgttctttcatctctacttttgtagcactgtctgttttatacaatggtcagattttattgtagttgagtgttcacatggttatctcctctgaaaaactgaccttctccatggtaaaagccacaccttatttatctttccatctcctgtagcactaggcccagggcctggtatgtcatagatacatattagatatctgcatgttaaatcatgagtggattgtgaaaggtcacaaatttaaaaaggatatttgaaaactcattcatactaaaacaagcttcattttagcactgtgtgattctcataggtcttttgtgtccatgtcatatccaaataacaagaaattttggttggcatctcagtgaaagcagatgagaaagagaaggataaataaacatcaatcaaatggtgattaggttgttcaccatggcctattctttctggaaacttaagcagcacagataaagtctgggaagctacagcctaaacttatttccaaactcttgtctcataggaacctaaaatagccttcctgcatacttcaagcacatctagcaaaagaaggctttctatagccaataagttcagtccatttgttagtgagatgctaatttacctgcaaagtcccatcatcagataagtaattatttgcacatgacctcatctcctcttttgatctcatcaaggaaacagcattttcagtattttttttttagggcttaatctttgtctgatatctaattgcagaatgagcagaagtgctctagacagcctgtatccacagatgatactttaaaattggcggtatgggatcagttgacggatctgactacaaagtgtcagaggttgcaaattccttctctctgtatcaaattagggatggaaatgaggaagtagggggccaaggaatttacattgatcaagtgtttatcatattctagtctagtcattgtgcagattcttttatgtattttgtctgtgactataggggttgttcccactttacaaatgataagctctgggaggttcatcatcttgtccaaggtcacacagctaatacatggcagggtcttgccccaacatcatgccttcccagtagccttccctcttcaccttgcctcatggtagatctttttgcccatatcttttaagtatttccacttccctcttgactgtttctgtaagaataagcacacctatctcctatgcacacaaacatgacctaagaagcataaattaaaagacaaaaatattgctgaatttgattgcgtcagaacttagaatttctgttccgtgaaggataccatgaacaaagccattagaaggcaaaatgagagaagatattagcactgtctaaaatgttaaggaataaatatgtgggcctagagaatactggaaatcaacatgaagaaggcagtagtcctaatagaaaaatgggtaaaagttctgaattggcaacttaaagaagaggaagcctaaaagctagcaagtatgtaaagaaatgttcaactcattagtaataagtacaatgcaaattttaaaaacaatgagatcactttgtagcagggatgtattaataaaatgtgttggcagggctgtgaagacgtaggcaccctcatgcactgattggtgggtgtgaagcatggtgctgccattctggagaacaatctctagccaaattaaatatattttcatattctatgacccagtaattcacttttctggtatatttcccagagaaattattgtacagacccctaaaggtacatattcaaggatgattattatagcagtatttatgggggcaagatctatgtgggagagtggacatataaaatatgatggatggccccagggactatgacaaaacagttggaagcaatagactaatgtatgtattgcaacatgaatggctcttataaacataaagctgggctttaaaaaagtaaaaaatagaatgatatataatacaattgcatatgtatacatacaattttacatgcacacagaataatattttatattttgcaagaagatatacaatcaaaaaacatcttagaagagttttctacttaggacattgtgggagggagtgagaaatggggataaaagagaacaaatagttttttaaaagcaaataggacaaagagacttgcgatgaataggctaatgattttgtaccatgaattgaggcacataattaactgaacactctgaatttgatttttttttttttttttgagacagggtctcactctgtcaccctggctggagtgcagtggcatgatcttggctcactgcaacctctgactcatgggttaaaccaattctcatgcctcagcctcccgagtagctgggattacaggcgtacaccacaacgcccagctattttttgtattttttggtagagatggggttttgccatgttggccaggctggtctcgaactcccgacatcaggtgatccacccaccttgacctcccaaagtgctgggattaaatgtgtgagccaccatgctggcctgaatctgatcttaaaaacaaaaatccactcacctgtgaggcatgaggttaagatagatatatggataatttattacttacttcaagcataaaggaggccacttctcttttactctttcaatgcttatccagttcccttttcactcactattttatgacattcaattagatttttgcttttgattttatataatgtaaatacaatgtaaattattcactttttaaaaatatgtttttggtttttatgtcatacatctttgccattgttttcttcttcatttctaagcttttaagggcagggatgatatttcttttcacttgttattatatagtccctagcatggtgataatcccagtgttcaattttatgaaaaatcttctaggaggaggttttcctttttaaattctaaaagtgtggataatgttcctaggagagtagatgactaaataatgtaggctgatagcatcaggtatcctttttaataaacaccccattccatcttaacacctcctctctgcctcctctctgccttctctttagcaaatctgtctgccttttttcctgatagaaagtatcattggttaataactgtagattcttgataattgttattgtgaatgaattgcaaaatcgtggtcaataattaataggttataataagtattgagcttaatcaagtagaagtagtaaatttagatatttcttcttgatagttatgattccatctctttgtctttgtgtttattttttcagcttctctctgtgtgtctttttctatatctctctactaatcacctctttctttctctttatctccctctccctttctttctctttgtctctttctttatttttgactgtgtctctttgtttttatctctttttttcccctctcctagtttctggttcatggcctcaccaacagtgtagtccaaggctgatgcatttgcagctatgtcaggttagtgctctagaattaattagagcttctatcttttttttgagtctgtaaaagctttctttgacaggctcattgtagtcttggaattatagtcacttgaatcaagctggtgagtacatattttgtagcttcataacagtaaagaaacattttgtgatgcatttcacattgaaagtggctccaaaagagtcagtgccattttgatggcacttgggaaaatgcatcagtaatatcatttagctgaaggcactttgatttctccaggagagctgaatagaccaaggccttgtgagactctttacagtcctgattttcttttccttgaaaaatttcatggcaatttccaggaagtttcagaactttatgtcatcaaactgaaactttttttcttagaaaaacattaagatttttcttctttagtagtagatggcttaaaggttttaggtctgctattggtaaatgcattggatgttcaaagcttgattgacwaagtgggtaataaataaaccactgggaccagatgacatcaacccagtatttttgaagaaagtagaaggtaatattgtcaaaacttggttcaattatttttaacccttgttagttggcactgaacacaagaactatcagatttttttgagcttacccttcataagaattatcctacgaagacttaagcagtacattttgttggtgattattatctctttatttcatccttgtattaatcaaggttctcaaaagaaacagaagcatacacacacacacacacacacacacacacacatggcctctttggaggccaagaagtctcatgatttaccatctaccagatggagacccaggaaagccagtggtgtagtttgaaggactgagagctggagaaccaatagtatacattccagtctgggtgtgaggacctgagaaccaaaaaatgctgagggcaggacaagattgatgtcccagttcaaatgatcaggcagagttattccagccttcttttgcctttctgctctattcagcctcttaatggttggatgatgttaacccacattggggagggccatttgctttattcagtccaccaattcaaatgctggatggaataagagaaagactgaagacagagtccagatttgagggatgaatggtttgatttaatggcttcagaagtggagaagcaaaaatgttaaagatctattaataccttttgtatatgagagatgaaggaattggaggaatcaaagattataaagctttcaagtttggattggtgagaaaaccataatggtattagagagaaaaagaagagggttgtggaggtaagttagctgaagccagtaatgagtttggttttcaatacactgaaccttttgaggttgattccataaaaggtagtcatgtcctcatatgcaatgctcccaagtgtcacagagtgataacaatggaccagtgtagtcactgatcccacccatgtagcatttcttattttcttcagttaaattctacaaactcatcagtatctcctactaatactgccacaacagtgatctctgcttagttatctgtcaggtcaacatactgtgagcctgattatggcaagggctgcctgtaatctgtctcccaagtcctgaagatagcacctgccacttggtaggtgatcagtaattggttgttgcattggcatccacagtgtgcccaggtcaaggtgatgatgatacacagatgagtcaaatgaggagatagcactggtgtaatgtgggaacatggagaagaggaggagtgataattctgtttgggggttgaacaagccttcaaagagatgtgacattgaaggataaaggatttactggggctaaggagggaaaaaagatatttttaggacaggaaactagaagagcaaaggcatgcaggtgtgagagtataagatgtgtttgctcaatgactggaggagcaagttcacagagaggagaaataagtggatggtgctagaactggaaacgtatgcaggtggactatagaaaaccttgctaaggctcttatgtgctctcacacttcttaggacagaaattatttttagagtgaggaaagaaggggagggaggttgttagatggtaatttaatctggtatcttttagtagaagcacagagaactgggaatgaagagttttgagttttaatttttgttgctaactaatgtgattaggacaaagttataaaaattctctgaactatctagggttagtttctgttatttataaatactattattagtagtataatttttatttgatacaagaattcctaaaagttttttttttcaggaaaatatctagtttttttaattttaaaaaatctaataaaccaaacaacagttcatactcttttggtcacataggcatcaatgaaataatttctattctgactgtcatggagaatcattagcctgttacctgctaatgttccctttgtcttttacactgtggttttttgtaaactatgtcagtcttactatgattcaaaggacattaaagcaaatggggtgtttagtgacaaaagtatttacaaaaagcttttttttttttaagttcacactgccrtattgtactctcctcaaccttacttttaagtacattttctatacttaatttgggagaaattaccataaaacatttagtgctttgttttctgatatggtttggttttgtcccttagttcatggaattgaacatttgccttcagactgtatttatgtattactttcatctgaagaacatttattaagcacctgtttgtgggcattgccagtgatataactggtctgaacaaaaatatagctaatgatgtgcaagcagaaagtgtaagtttcctgcagccttttaaaataatattttactgatcataaaagcaatgtgcttagaatgtaatatatgtagaactttgaaaaataaagaaaagcacaattaggaaaataaaattccatgaaattctactgcctgaagataagagctgtgaatattttggtctgtttgcatgctctggtttttttccctatgcatttaaatatttatgtacatttacaatatcttgtgaatgcttcccctcttttaaatgagagtatagtgtgattgttcaggacttggctttcctcatccaattaataatgacagtgtgacctttatcaacttatttcgcctttcaaaggctctgttttattttctgcaaaaagggaataatactagtgtctacttcacaggtttggagtcagggcaaaatgagataatgcatttaccgcactcagagcctggctcattacaggagttctttattattggatattgcagttatttcatttttttcatgtatgtaatgtttgctaagctatgcacagtcagtgccatcagtttccttaccattcagttgttaatcacagagtttgattccattacaataataatcgctgagtcagactttcaccccactgtaacttgtccctagtggaaatttttccattagtttctgaaacttgggacctctctgttgtttccctcatgcagatttggtcacactagatgacctcatttggttgtcgtggggtttatttctgtagtgatgatagcctcttacattccctccaccatagaacttggtagggatgagaactagctggacggggccagtaacggggttgcatatgaccttctgggtggttctagagtctggatctgagtcacttctggcaatggatcagccataggatttcataagagtggccattagagcccttttaagcagaatactgaagtctggggatggaaccaacctaggattaagagttggggaatcagctatcaccagcatgaggtgggatggagaaggggatgaggctagcacaacattagggaattttgctgctgttttggtgggcaatataggtttggctgtgtgtttgtcttcttgtgtcttggtgacatcttagagcctcacactactcccttcctcaacttatttatttattggaaaatataataaaattgagataatttttacctttaacataaaagttyggctctaaaaaatgtttggcaaagcagaaactctaagtactaatgaggatatgagttgctcytacagccactttagagagctactaaatgcaaataagcatgacctgattctaggctcacaccctaaaaaatctctcccacagtactaagacagacttgtacaagcatatttatagcagtgttgtttgtaaaaatatgaaattattattaaggaagagtagtaaaccaggtcagatttatacaaggaaatactagaaagcagttaaaatggatgaactgtagttacatatgtcagcctgaattaaacaacgttgaatttaataggtgtgttgagaattacaggtacagtatcatacaatttaaatgatattaaagaacatgcaaatgatactgtatttatgcatttatgtatagtgaaagtataaatgcattcattcacatgttgaatactgtatttagataacaagtgctatgtctagagaaggaagagaatgagatgggggagataaagcatcagagatttgtattctatggatatgtatttaagttaaaaaatgacagcaaaaacaaatatttgagggggtggataccacgttttccatgatgtgattattatacattgcatgcctatatcaaatatctcatgtaccctataaatgtatatacctattatgtacccacaaaaattaaaagtaaaaaatttaaaaggacaaaatattaagttttaaggagactgaagtatgttttatattctctatttgttatctgattaacgtatttcaccattttcttaaatggggaaataaggacagaggaaattaacatataaccacaacaaattctagcagtgcaagggaaagtaagcctttatcacactgctgatccctgatcccttgttcctgtggccagagaaaactgctgttttttttttaatttttattttttattttttgagacggagtctcgctctgtctcccaggctggagtgcagtggtgcaatctcctcactgcaagctctgcctcccaggttcacgccattctcctgcctcagcctcctgaatagctgggactacaggcacccaccaccatgcccggctgattttttgtatttttagtagagacggggtttcaccgtgttagccaggatggtctcgatctcctgacctcgtgatccacccgcctggacctcccaaagtgctgggattacaggcttgagccaccgcgcccggctgaaaactactcttaatagttacccatgaatcctcatgacagccggtgatatagaagcatattgtatgcacattccttttacacctgcatggtaaatgctctttgctcctttcactacactatgtataccttggaggtcatttatcctgcaatatctgaccttttcttctaaagaaacttttgcttcatgaaggtaagtacaactacagtttctctaaagctcagttttgaaatcagtgatataaaatacatagggtcagttttacatagtaagttgtcaagacagattgcactcagactcaaaccaaccttgaaaacaaagtactgtatatctgtatttacatttgaaaggctcttttcccacttcagtttgtcaaacagttgaatatgttaagcttgagactagagacaatgtcagggtgaacatatgtgagggattcacacttctcaaagaaaagcacgctttttgtggccttggacaaagctgggattccgtgctgttgttattttcacaagtccctctactgagatcatgactgcatcttagagttgctgttgaatacagatgatgttaattttgttctcattcatattctatttagtttttaccaaactaaatgtttattagttggtgatatttaggaagtttgataggattgtgactatatagctatattttatgaaaaatggaggaaaagttccctttaaaatacctaaattttttttgagttaaagaaagaaaaataaaattcatgaaatagtgacgtgaagcttggtagtttagctgcagctgccaggtgtctaggctggctcttgggagagattattatgggatcacagtgagcctggctacacagagcatggaaagtcccctcgtccttgtcatcacagagtttggcttacagacctctcctctcaaagatggaggcttctggtctttctgatattgttttctcttcctgtccctccttatagagagaaatccaaaatatttttgctaaaattctctagagttgaatttgggaacaccaggggataaaacccctcatgttaaggcatgtaggaggaaaggtatcctcttatcaatcgaattgtagttcaaatatgctgtaaacccacctgtttactccttcgtggtggccgtaagatgtgaaaaggcaggggctccagaagttctaggtaggagtcctttgttcttatgtttttcaagggtctcatggtgaccaacattgttaacttcttttagcctctgtttcctcaccctcaaatgaggtcaatagtatctactttcagaagtgatattcaaaatatctgatatgggagtgggacttggctgttatcagacagatggcatatgcatcccgtaatgttgtgcctggtgctgtaaggttgtgcctggtgaatgtcaactaggactgttttacagggttgctataagggtaagataagatcatgcacatgaatgtgctttgaaaactgcaaggggatacataaatttgtactattaatgcaaaatacatgcaatgggcaggaagtttgagaagtgctttgagctgtttgaccagaagattctttaatgagaataaggaattattgccctgtgatgtcaatgtatttaaatatatgcttattatacatatattgaactatatatataatatacatatattacacatatattgaactcagcaattgaatgcttaggtatttacctaagaaaaatgaaaacacaattctactcaaaggcttataggtgaatattcaccgtagttttattcatcatagctaaaaactggcaacaatttcttatgttgatcacctgctgaatgagtaaacatgctgtgatgcctccatacaatggaacactacccagcaataaaatggaacacatgcctgatggacacagtaatgtagacaagtctcaagtgcattatgctaactgaaagaagacagacacaaaacattacgcaccatatgattctatttctatgaaattctatcaaaggcaaaactttagcaacagaaatcagatagtggttttcaggggccggggtcaggggagagattggctgtaagaggtatgaggaaactttctgaagtaatggaaatattctatctcttgattgtggtggtggttacatgattctatatgtatttgtcaaaatctatggaattgtatactgaaaaattgatcaatttcattatacataaattatacttcaaaaaaatggaactgggtaaaaatagttccctcatgaaaaaaatagaaaatgcaatgttgaaagagaaaggaggaacattctttacaaaacaaaatgtttcttctttataggctatatatttcagtttcagcttcgagtaatgaattttatggcttcgtctcttgcattgagcattacactctagtgaacacccaacttgctaagtcgtcccccatacacaccttactgtttctctctttgttatcatttccttatgctgagcacttgcctggagtagctccctcccccagccttccctggggctctcatttcctccctcactcatttggttaactcttatttaccattgaagattcagtttggaattcaccttctccaagagccttcccctggtttctccccatccctttcacattggggctcatttgggtatccctggccattagctttgtcagtatactcaccagatttcactataagtagctctttatgggtttgtcttccccaaaagaggttaaggactatatcttacacacttttataccctggtgcccagcatgttgctgatggtcaatagatgtttgtagaattagtgattgggagtgccaaagggagtggtgaggacatgtgagattgtggaaagaatgcaagggaaggaagattatttgaatcccagtctctcacttagtggttagagtaactttggacaagttggttaatgtgtctcagatagaagatggagatctagacccatctactggataggattaccataagatctacataaaactatgatgtgaaagcactctgtacctagtaaagcagttcacacacataagttattattatgtcattggaagagtgttgtttctcagctcttggatatagcaatgtaaaccaaaccaaacggataaaatatattcaccttcaactttaagggtagtgtctgcattgcattgatatgttcacctgactccttatagcatctagttagaacttcctctgctcataagagacagctatagtcttgtcagtcctttcactctgttatttctcattgaagcaattgctaaccagtgtatataatttttgaaaacatggatcttgttttatttagctttgggtcctctrtagcacttactagagttcattgcatctagaaatgttaaaatggcaagccaagtagaggttaacatagacatctagagaaatgttatccagttttccagagaaggctaaatatcaaaatagtgttgtaattaaatcttatttttagaatctgataaagtaattttgggttaccacagaaatctttcaagtttaagctaataaaatattaatgtcctggatctttggaaatctactaatgtcttcatttggaacttcataagaatcaagaatttcactgcatctaagatccgttttccacaagtcttaaaatctgaactacagcacgttatctatgtgatattctttctagcatttcataaacgtattcttttaaaaaaataattattttatcttgattatagaagaatggagtctataccttatttgtaggtgatagagcaagcaccaggcccttgacccactcttactgcctccgttcatcattatttttagtttctactaacctttattgtattatttggaacaaaatggaagaaaacctaactgggtgtataaattttgatgtacattaacaattcatcaaagtgatattatagataatgtgactgttttcataaacaaaacaggactaaaataaatgaatatgcagaagaaagtgtgagagatactgaaatattttgctggtatagtatattatgcagatgtttgcatttatgaggtagaactagaaaacaaaaaaactctatgttataatcatttttaataaatgaatttttatttccaggtaatttatacctatattcaagtcttggtaagcaatttaaaataatttgctgacttgttgatctcacctttcaaataatatgccaagggccaataacttcttgcaacatgtatagatatttatccaaatgtgtttttgataaggatatgaaaatatttggggaataaatccaatacttatgcttatttatggtacataaatcggagtttcccatgagtgaccgtaaaaattggaggaagtggaaagaaagaggaactgaaatataaaccaaatgtttgtttatgggctttatttagaaatccacattagtgattctgacattgggatattaatccaaaatttcctttctttgtggattattttcacacaaaattgtacattctcatgaggcaattctctttggagtacccatagagaattattacatttttaccagataggttctttttaatattctaatctagcaaatttgcatttaagaaaactactttattccaggatagcttttttgcacaagttattgttctgcccacctcccctcaaataaaaccagcatcataacttctcagagctttgtctgctttcaagattctttggcacctgcactgggttatatgccataccaaaaatgtttcccagccattcatgtttaaatacatttaagtttacattaatttttaaaaggattaaaagcaccttcaaaaatgaagcatgtattctctaagcagcaagtattaatttataggggctgttcatggaaaaaaatgctgttattgtatgtctcttgccccatgcataataaagaacttttctttttgaaagtaattgctgtaaaatattccttgagggatcaaaatattagtatgactgggaagtaggatctctgttcttaggcagattgttttgttacttagttccaaatataaaactggacaaaagtaggtgaggtaagggaatgatagagtggttagaagagatctttagataagaacatctttggcaacagggatagggccttcacgatctttcttaaaatcctggagcggcaggcttcacgtgggaggaaaccaggggttgccactagatcagctaagagacaagcaaataagaggctgggtgcagaaaatgctgagtctctccgaaggtttttccctcaagctgagctggtgtctggttttctgaccacatgttgtttcttctctttataagagtgaaacaacattcctgtttaaaaaaaaaaagccaaaatgtttgtcatcaagcctgacagtgatatgggtcctcactcaaatacagtgagacttcttcctacgatattggtcctgtggagttaggtcagaaggatgtggttataaaataaagtgatttcattttgtttatctcctactcagaaactttcagtgttccccctttcccgcagtgacaacaggaaaaggcccaaaagcttcagcatggcaggtggaggccttctagaacctggttccaatcttagcataacttttaccacttcctaactcaagcctcaactctagctcaaccattcttctatgtaatcaagagatattctaggcacttctggtgggaagtagagaataagccaaggctgggaggggtgaggcctggggaactttaacagagattagtacccagatcactaaatttggggttggagggtgaggcaaagaactctggtactgtctacactgacagtctttctaaggtacctttccaagaagagaagacagtgcttgcctagtgactgtgatggttcagggataatgtgacaattcttgacaccctgctgttactttacttatagatcagaacatattctgtgagctgatatattagattttagaaggagaagccaatcccaaaagacaggtaggaattaaatggggaactcaggatacccaactatcagtttggtggccagagctggacttgctttcttgaggaaattatgatgaaaaccagggcctgagtcttgcagtcaaactggcctctgaaagagagggctggaggtgggaatgggtgggaaaatggcagctcactctgctgcctaggactcataacgcctggtatatcagataccagaaaacaagtattatactattccagagattatctgtcttactaatagggccctgggtagggcagagcctataggcttttaattttgacacctgggcaggacaagttctttcagtgacggacacttatcttccagcactataataggcctcattatggtacatatgataaattatcttgtccaattaatttatgccactttagactaaggactgtcatatatatacatatatatacachcatatatatacacacatacatatatatgcacatatatatatatagtttctttargtcttaccaaagtattaaatactttttgaacaaataacgtattttggggggcattattctgtccacttacctaaatcaaggatgatataaacaataaatacaatttcaataaattagattttaatttttttttaatgaacagaaagccaattgattggtttcctgaagctctattgtttcctcctgtcaatggaatacaaaatcacaggaactctttatcacttagattggagattacgaatgccgtgaaggcaagtaactgcctttcttcttctaattattttggaaagaacatatttttcactagaaagaccagaagctggaaagccaaaggctttggccacaaaactgtgaagggactctggatggatggaggctccacaagagcttcattccaaattaagatgttcaggctacattgaagaaagcaatctatttgccttggaaaaatttattagtgctaagagctaatatatgaaatatacaatctgtatctggatgtttgcatttctctaaatcttgccctcaacatatatatcattttcaataaatggttttgagccataattttttcattcattctatatgccagttggtgtgcaggtggtgttgatatagaaatgagtaaggcacaggtgctaacatcaggggctcacagtcctcactggcatcaggtgaagcactgcatgcaatacaaggacaagtcctcaagcaactgatgcatagatttttaaaaagtggtatagccatacaacagaatagtctttggcaataaaaatgaatgaagtactggtgcatgctaaaaacctcagaaacattaggataaatgaaaaatgccaatcacaaaagaccacattttatatgattccatttatataaaatgtatagaataggcaaagacatggaaatagaaagtacattggtagttgccaggggtttggcaaccccactttgccagcggagggtgcagatggggagtgattattaatggtactgtgtttgtcgtagaggtgattaaaacctttcaaaattgattgtggtgatggctgcataactctgtgaaatactaagaacctttaaatgaacgcttcaaatgagtgaattgtatgacatgtgaatttaacctgaacaaaggtattataaaaagagagagagagaaatggtaggaggagatagatctttcaaaaaattgtgaattaggggaagtagagaaaagggaaggtgttaaaagaagatgttttaatctacattggttatcaaatgtacacaacagttttaagtacacattctcatttcatccaaacaacattgctgtgattttgctgttatttagataaggaaatggaagcttggagagcttaagcgatttgccaaaatacatacaacttaacaagcagaatgggctattaaggtcagacctgaggaaagcagatcacagttgagggggttggaggaaaaaaagaaagaaagaaagagaaagaaagacaagatgaagatacagggattttgaattctctgatcccagaagctctcattggctaaatcacagttttagcactgttcacttttattcttttgtaggctaatgtactaagctaattatgtatttacattttaaattccttgaggactaggcaatgtctctatcatttagattcttctaggtacaggcatccctcggagatattgtgggttttgattctggaccaccacagtaaagtaaatatcacaataaaattttttggtttcccagtacatataaaagttatgtagtctattaagtgtgtaatagcattatggctaaaagaatgtacatactttaatttataaatactattaatatattgctaaaaatgctaactgtcatctgtgccttcagcaagttgtaatctttttgctggtggtggtcttgccttgatgttgacggctgccgactgatgagggtggtggttgctgaaggctagggtggctgtggcaatttcttaaaataagacaacaatgaagtttgctgcaatgaatgatatttctttcatgaaagattcttctggagtatgtgatggtgtttggtagcatttttcccacagtaggacttccaaaattggagccagttctctcaaatcctgccattgccttatcagctaagtttatggaacattctaaatcctttgttgtcatttcaacaatgttcacacaccttcaccaggagtagattccatctcaggaaactcgtttatttgctcatccataaaaagcaactcctcatctgttaaagctttattgtgagattgcagtaatttagtcatatcttcaggctccacttctaattctagttcttttgttatttctcctacatctgcaggtacttcctcctctgaagtcttgaacccctcaaagtcatccatgagggttggaatcaacttcttccaaactcctgttaatgttgatatttttacctccttccataaatcatgaatattcttaatggaatctagaatggtgaatcttttccagaaggttgttgatttactttgcttagatacatcagaggaatcacaatctatggcagccatagccttatgaaatgtatttgttaaataataagacttgaaggttgaaattgctatttgatccatgggcttcagattggatgttgtattagcaggcaagaaaacaacattaattttcttgtatatcttcatcagaactcctgagtgaacaggtgccatgccaattagcagtaatattttgaaaggattttttttctgagcagtacatctcaagagtgggcttaaaatatttactaaaccatactgtttaataaaccatatctgttctataaacagatacgctgtcatccaggctttgttgtttcatttatagagcactgttagagtagatttagcataacttttaaaagccctatgatttttggaaaggtaaatgaatattggcttcaacaaagtcatagctacattagtttccaacaagaaggtcagcctgtccatttgaagctttgaatccaggcattgacttctctctagctatgaaagttctagatcttctaatagaaggctgttttgtctacattgaaaatctgttgttcagcgtagtgacatacctcaatggtcttaactgggttttctggataactagctatagcttctacattagcacttgctgcttcaccttgcattttcatgttatgggccctctttccttaaatgaaccaacctctgctagcttatatgggtgcagttcatggtgctccaaaacaattatgatagtaaatcagaactcactgctcacaggttatcataacagatatagtaaaaatgaaaaagcttgaaatattgcaataacttttcttttgtagcttccttacttctttcagccatcatagaattgaagagagttagggctttcctctggattaggctttggcttaagggaatgttgtagggggtttgatcttctgtccagacagccagaactttcaccctatcagcaataagactattttgctttcttatcactcacgtgttcgctggactagcactttttttttttttattattgagacagagtcttgctctgtcacacaggctgcactgctttggtgcaatcctggctcactgcagccttgatctcccaggctcaagcaatcctcccacctcagccttctgagtagctgggactataggtacatgccaccatgcccagttaattttaaaatttttttgtggagacagggtctcactatgttgcccaagctggtctccaactactggattcaagcaattctcctaccttggcttcccaaattgctgggattacagcaatgggccaccacacctagccagcactcataatttccttcaagaacttttcctttgcattcacaacttagctaactgtttggcacaagaggcctagcttttgccctatcttggctattgacatgccttcctcactaagcctaaccatttcttgtttttgatttaaagtgagaaatgtgtgactcctttcacatgaacactaagaggccatcgtaggttattaattggcctaatttcaatggtgttgtatcttagggaatagggaagcctgaggagagggagagagcaccatgtactgcacccatataagaagagaaacctaatcaataaactttgtgttctgactgctccatcaaccttccggacaagtcagaacacaagcaacatttattgattaggtttctcttcttacatgggtgtagttcgtggtgctccaaaacaattacaatagcaatatcagagctcactgatcatagatcatcataacagatatagtaaaaatgaaaattcttgaaatattgcaagaattacctaaatgtgacacagagacatgaagtgaacaactgctcttggaaaaatggtatggatagacttgcttgatgtggggttgcaacaaactcgatttgtaaaaaacgcattcatctgtgaagcacaaaaaggcaaagcaaataaaatgaggtatgcttgaatatttggggacctgactacccatttgcctgttttgggcaactgtattctgagaaaaatctgagctcattggcaaccaatcagtagaagtagggtggccacagatacagacatatgtccttgttagttgttattattttgtaagagagtatcacctgtagtgtcaatatgtattaccctgccctgaactgataacatggaacacacattagctccaagtttttggcagagatgctgtcctttaactctttgttattcaatcctcatcaaatccttctttcctttttctaattgcactccttttatactcccgtatcaaatccttcaatgtaaactgttaattctatttctaaaatatattgcaaattcagccacttctttttctcttctgtgaaatcaggcctggccatctccatcatctttgtttaggtctttcttttcagctggttacattactttcaagtctgtctctcctctactccgtaactgaaaaactatattttttttctatggaaattccatcacatagctccctgaaggtcctcctgcctagaaaaattatcatcacacaattaccttttaaaacacatcttaaaaacccaatcagcaaatgtttgaggggctaatatgagggagcttcaaaaagtttgtggaaaaagtgaattaaaaataaaaatgaaaaatataacctttatttctcaacataagctccatcaagttcaaaacacttttgtaagtgatgatatcagccatttagtttatccctaaataactgggcactctaggtatataaccatatcattgcagtcttttttacattattaactaaagaaaaatgggtgccctttacagatttttaagattaggaaacaaaaaaaaatcaaaaggagttaaatcaggactttcaggtggatgcctaataactttcccttgaaacttttgtaaaattgcccttgtttgatgagcagaatgagcaggagcatcattgtggtggagaaggattttctggtgaagctctcctgggcatttttctgctaaagatttggctatgtttctcaaaacactgttataataagcagatattattgttctttcacctgcagaaagacaataagcaaaatgccttgatcatcccaaaaaactgttgccatgacctttgctcttcattggtcagcttttgctttcacaggaccacttccacctcttggtagccatggctttgcttgtgctttgtcttcaggatcataccggaaagccatgtttcatctcctgttacagttatttaaagaaatgctatagaatcttgattccacttgtttaaaattttcattgaaacctctgctcttctctgcagctgatctgggcacaatggttttggcacccatcaagtggaaagtttgcccaactttgatattttagtcagaattgcataagctgacaaatcaagatatctatggtgttggttattgtttctgctgttaattgtcactcttcttcaattaggacatgaacaaagtgaatttttttcctcacagattgatgtggatggtctgccactgcaagcttcattttcaacattgtcttgtcccttcttaaaatgagttatcgatctgtaggctgctgattcctttgaggcattgtccctgtaaacttttcataaagcagcagtgatttcaccattcttcttcccaagcttcaccttaaatgtgatgtttgttcttgtttcaattttagcagaattcatgttgcactgatgggggctctttttcaaaaaaatattttttattgtactaaaatatacatatataatttaccatctttatcttttttaagtgtgtagttcagtggtaataaatgcatttatattctatttgtttctttgactcttctcccctctccccttcctggcctctgataactaccaatctctatcttyatgagatctacttttttagctcccacatgtgagtgagactatatgatatttgtctttctgtgcttggactttttcacttaacataatggtcttcaattccatctatgttgctgcaaatgacaggatttcattcatttttatggctgaatgatatttcattgtgtatatatatggcrttttctttcttcattcatctgttgatgggtacttagcttgattccgtattttcactattgttagcagtgctgaaataaacacgggagtgcagatatctctttgatgtattgatttcctttctttttgatatataccaagtagtagaattactggatcatatggtggttctacttttagttttttgaggaaccttcatactgtacattaggctgtactaatttgcattcccaccaacagtgtatgaaggttcccctttctccacatcctcaccagcatctgttattgtgtgtggtgagatgctgtctcattgtggttttcatttgcatttctctgatgattagggatattgagcatttttttcatgtacttcttggccatttgtatgtcttttgagaaatgtctgttcaaaccttttgcccaatatttaatctgaatttttttttttttttttttttttttgctattgagttgtttgaactccttatatgttctggttattaatcccttgtcagatggatagtttgcaaatattttctctcattctgtgtgttgtcttttcactttgtcgattgtttgctgtgcagaagctttttaggttgatataatcccaattatatatttttgcttgggttgcctgtgcttttcaggtcttaaacaaaaaatatttgcccagaccaatgttctgggacatttctccaaagttttattctagtggtttcattgttttaggacttctattgaaatattttatccattttgatttgatttttgtgtatagtgggaaatagaggtccaatttcattcttttgcatatagctatccagtttttgataggggctcttttaaaactgatgtcttatccttcttagtgcctcaaactagattctgttcagatatgttataataaattagtatgagtttattttgatgcaaaaaagttgaaatctatttttttataatacacatttttcatgaacttcttgaagacccctcctatttgccagacactgttcttycattgactaataaataaattctctctcctttcttttttcatttttcagctcttgggttttacagttttaaaaattaatttttaattagacaagtaaaaattatatgatttgtactgtacaagtgtgatgttttgatatgtatgtacactgtgtaatggccaaatcaggcatatccattacctcacatacttaacatttttttgtggtgataacacttagaatctatcctcttagcaattttcaagtatacaatctattgttattaactatagtcagcatgatgtacaacatatctcttgaactttttctaactgaaaatttgtgtcctttgaccaacttcttcccaatctctacattccctcatctctggtaatcattattttactctctgtttctatgaatttgagttttctagattccacgtataagtaagctcagatggcatttttctttgtgtgcctggcctattttacttaacataatggccttcaagttcatccaagttgttgcaaatgacaatatttctttttttggtaaggccgaatagtaattccattgtgcctatataccacatttcctttatccattcattcactgatggacacttaggttgattccatatcttgggtattgtcaataatgttgtaatgaacataggagtgcaggtatctctttgacatactgatttcatattctttggatatgtgtacccagtagtgggattgctgggtcatatggtagccctatttttaattttttagctctatttttaattttttgaggagcctctacactgtttttcataatggcattctcaatttacattctcttcaacagtgtacaaggattcccttttctacttatccctgccaacacaaattctaactcttcaccatggcccaggaggtcctgcatgatatggttcctgcctttttgtcagattttgtctcatgtttctctttgccctttctcactgcactccagccacaaaaatcctctttcagcttcttgtgaaggttttcctgcctagaggcttttgtaggtacagtgacctctgcaatgagtattcttgtctccattcttcttgtccatagttcgttagcataaaatccttcagtttttcagcttaaatatctcctcagagaagtcttccctgatcacctaatacaaagaagttttctgtccccctcattcttcagttagctaaaaataatagaaaacccaaaacaatagttgcttacacacmatagaagtttctttctctgtcatatgaaattatagataactatgcaccagagtgttagcaacccagattccactgtccagatgttcctttccaagcctacctcgtcatccaggatggcttcttccatctgcatttgagtgaccaggataaagacatgccaccccctttaagtaacatggccacatctagctacagggaagctagaaaatggggtctttttaaaactctagacagtcatcttcccagcaaaattaaaactgttattactaagggagagggagaaaatggaaatggagggatgaagaggagttacattccacattttatactcatggtagaaatggacttttgtacattattgtatcacatggcatttttaattatataattttcttgtaggcaaataactttcttatgggaaatttgtgctactcttaagcaactggcttgttttcctattatggacattgtgaatcttctgcctgattatgttttgctttttgatttgtttgccaggaagtttgtagctaaatttatggtcctctccagcaactacacaaatcctatgatggatattttttctgataatattatctgtagcgttattttattttactatactttcttcctttctttctttaccttcttcctttctttttattttcttcaatgtaattttgcaagtctcttcaaattcctttggtaataagtcaggaaataagtaaaacacaagtataaataaataaagtattttatatttaatgaaggtgataaaagtgcctacattatagggctgtcgagagaatccactgagttaatgtaagtaaaacatttagagcagtgcctggcatattgtaagacctatagaaatgctagttcgttattattattattttaattaaatctttcctgaagtgactgtcagataaatctgcttgataagacagttttactttaacttttgttctaggttaaacaaagagggaaagattaaaatatacatttaaggaccactcagcaacaatcattctatgtcttcatattctaatctacatggcagctagtaaatgcattgtgctgtgtaagataatgtgctaaaactcttagtggagatggcctctaaattttttatgtttagtatttaggcatcttgtagataaaatgtatggatgaataatcagatgaggattcaatgaccagaagtactgttgctctctctccatctctttctgttagaaatagatctccatcagataggtctgtgtttgaattttagatgtactaccaaccacactatgtgacctaggtcaagtctcagctttcatgtcaatatatttaccgatgggtggcagtaatacctatcatatagggacataaggattacattaaataatacatgttaagatctttgcatggttcctggccagagtacacatacaatagctatttctgatatcattattttcactcaagtcttttaaattgaagaattatcaccttttagcacttgaatttatattgaatctatacacacatcatttttttatttaaatatttgaaatccttaccctacaatccaatggaaattctgcaaatgtttaaagttttggactccatgacaaaattgtatagatagaatagtggttttaaatatggctcggggattacaaatggtccacatggatccttgggaatgaatcaagctacgagctcctatagcaataatatttctattaccatagcgtatgtgcctaagtttctggtgtggattaataaattattactgttgttaaatggatgcctggttttcttaattggtagctcatcaaaagcttattaaaaacttcctattcattttgttgatttcagtggttggggataaatggcccaggaggctctttgccctgctaaagtggatcatgaacaatgtgggatatttaattcaattcaattcagcaaacatattgaattcaaaatatgcaaaaagcattgtgctacaaattgtgacaatatcaagggacatcccctgtggtggccttctgttatttggtacccaggatccatttttattctatttgggaactacagccttggcccactccaagctatgtggtttgggtaggattggccccttacccaggtctgggggtggaatggccttgcttggcttaaggtagtcagcataaccctttcctatggccatggtattagatttatgagtgggcatataactcatgaatctttaaaagacttgtgcctggggcttctgaaaaaaaatgaagtctcctctgtctttgcagtgggaacttctggaaaagatactttctctttccctgggcctatagttaggatgtaaggtataggagagcctgcagatgttttgggggagaacaccacacagattttgaatatgaagctaacaccatgggtttggagtcggtctgacctggattcaaatccaagcactgtcactttctagtttggtaaggtatttgagcttcgttgtgcctccattttgtcacctataaaatgtggctaatgcccttactctctcctccttaaaactatttggtactggcttttaattgtaacagaattaacatcaataattggatttgtgcccatcaagccaatgaactttcataaaatgaaatccagaaaattttcatgtaattcatagagttcttatatttaacccatgtctctagaatcttcttctagtgacaaattatgttgtattgaatcatgtgaaactgagccaagtttatcattatttagggtagaaattctgttttgttacagtagtttcactcaagttttacttctctaagaagaacataagacacacttaaaattttaagcatatctacataaaaaagcccagtttgttataccattttcatagagttattttagccctctaatatagcactgtaataacattttgtacttgctacaaacataagcacactagtttctatcatttttgcccttggtttataaagatggaatttagaaagcaaatacatttagggatgaaatagtgaaatctgctgaatgtgtgtagaattattaaagagtataacatggctgcttgttttatttagaaatgacattgggtgggttagctaaccaaagctgccaatactgtattttaatgatcttgagtttatctcctatttacaattctttgtcatttagtctacaggtgttagatcacttaacacttgctgaattcttcagatttgtttgtttcctgccgtttggtgttgatcattttgatgtgtgataggaggaggaagtagttatctaattttcactgaacaatcttccctaaggtatcacatatattcattctatatcttctatcagtcagccatagattgtgaaaaactttgatagaaactttaaattcagagcccctgaattagtcagttttcactcagtaatgctatgataacaaacaacctccaaaatctcagtggttcacaaaaaccaagctttaattcttgttctgtatatatatatacatatatctgccgattagtagtgcctttgctcctgcctcaggtatctttttttaccccagaatgcagacagaaggagcagcttccatctgggacatgccattctcctggctgagggcaatgatctctctttttcttttttcttttactttttaagttctggggtacatatgcaggatgtgcaggtttgttaacataggtaaacgtgtgccatggtggtttgttgcacccatcagcccattacctaggtattaagtcaagcatgcattagctgtttttgccaatgctctccctccccgtactccactcctcaacaggcctcagtgtgtgttgttcccctccctgtgtccgtgtgttttcattgttcagctcccacttataagcgagaacatgcagtatttgatttactgtttctgcattagtttgctgaggataatggcttccagctccacccatgaccctgcaaaggacatgatcttgttcctttttatggctgcatagtattccacggtgtatatgtaccacattttcttagagacaatgccaaatcttgcaatggtccttaaagctcctgctcaattatgactgtatatcatgcgtattcatattccattggccagagaaagtctcttggccaagtccaagctcagtgtctttgactgagatatcgcagtttacaaggcaatgggtgggcatgagttttaagaggaaataatggaacatatgtcataggtctgttttggacagggctactggtgtatttttctcttatgtcctattcttctgctgtttttttctccaaaaactcccttccttggttctctcatccacccctccatcacttcctctgtactcttggctgccaagtagacccatggagcctactccacttttctgtccagcctgatgtagaatctttaggatataggacctaaattattgctttagtaaaaactggagctgtctgatgttataaggaatagctctactctgagccaagtaggcttggtatttactgaagtcatatccactttgttttattcctggtaatttggcttgaagtgaaattttaaataaaccagatacttattgcttatgcccactaaatatatgtccacagcccttaaataactacctttgtcttatagtgctttatggaacatagagcaattttaccaccattatctcatatgatggtcacaagaagcctggtgatgccaatattattgtgattcccatttcacaggataaaaaaaagttaagtagcttattcaggatcaaaaggctggtgagctttatagccagcattcaagccagggtatrtagtgataggcatttcttgttattgacaaagaaatcctctgctttaagcatatatcgaataatgcataatgtaataaataccctgttttttcaaaaaaaagttacagagtaagatgttggcttgtttcactgaaaatattcaacttaaaatttttagaaatgtcttattagttttgaatgatctgatgactaaatttcagtttatataaaactttccctcataaaacaatcattacacagtttgggcactatgcttgctggagtataaaaccccattgcagtaaacagtgtgtcatcatgctgttactgaaagtggcctactatgctttatctccactgccctgtcccaatctaagccactgtcacctcttacccagaatgtggcagtagtcctttcaacagtcctctataccttttctgacttcctccaagcttttcctcaagctgagcctagtgatatttttaactgtgaatgtgaatttgtctgacttccctatccttacccaaagtccttaatacaagtctcccatgtgatatcaccctgcaaacgtggccagccttctatcgtcattctctccctcaatttctgcttactttctcatcttagtcctctctcctacccaccctccagccagtgtctcctagtcaattggcactcatttttcccatcccagcttcccagggaagctagccatgacccccagaccatgataactagcccattttagtctactgtagctggcaactcacctccatatcccacccattgccacacctggattttcctctgtaaatactgcttgaacctgactgaggtgcattatgcttcctgctgctcactttaccaggttagatgacagcggttttcatgaaagccgtccctcactcacgcacattagtcacctttacaaggaaacacccagtgattagagagaaagcaaccaccatgtcagccatgcttcaaagcaaccatattcaaaacaagttgtttttggaaaagagtatatttcatgttttagagtataaatgttccctgtgataattactataagaaatcaagatactccagtctgagtgcctgttcatgctgctgcaaaaacaatgggaaaagtttggattttaaggcaatccaatttctaaggaccagaagcagtctatgcttatggctgcttattgctagttgggttcttataaacctggagtgtcctacatttcatgttgaattgaacataatgggcctgtgataggcacctctccacaaaataacaaaagtctctgtataaactcaatattttagaagtcaaagtagacaggatactttgcttgtggcttgtcctcaggtatcagtacagcaagtggctctcagcacaccaccaaacagggcaggcagctggctctctagagataattataatttattgtgcccatggattttgatgcagtggggtctgggctctctcacaaggccaacagagcaggtctaatttgagccagatctcaggagacacagtccggagaggatgggtcatgtgccttcagttatcacttggagttgcactttgccccttgttcctctttctctcaactagtagctgagttttaatttttttccctgaaaatttattcagagagactgttttccttttcttcctggaattcacagaatgaagatggaggtccataaataccttggttaaaagttggaagatcatagagtgtcccactgtctgttttggggcctggcaggaatactcctaatcactgtaaatgaataggtgtttcatctatttttgtcttctcttctttgttctctacctgaaaatgtccttccctcattttcaggctactgaaatcttctaaagccttcttaaagtttcttctttataggaaacttcctagatttcttcctttagtcagaattaatgctgatttatgttctctcatgaaattgtactttgtactttcatttastgctgtgactgttctttttaaagttattgtttacttatttttttctcctccagattatacaatccttaaggatagtactggaatttcctcatcttcctattgtccacattgcccagcgtgaaattttggcccagtaggaaggctatacatttgttgaattaatttkgatctgtaaggcatattcttccacgaaaaggacattgcacaatcacaatattctccataaacaaatggacactcagaaagaactgttgtgttcttttatctgccttccatgaatgtgcagtttccttaccacttctccatggacctagttatcttgcatagtgcacacattagaagattatgtgataagagtagaaagctaggtttcctttgggtagggctagactatttcctgttcagaggtgaagacttctgaaatcagaatcaattttctaaaacataccacattaaaataagaccatagacacgtttttctgtctataagtctttttattttratggtagaaaatgttgtaagattatttcattatcttcttattgttaactgttttggggaagaatcaaatcaggagagactgagattggagtctttttatcaaattctctatagactacatgatccgtgccaataccacagcagtcagcagctgttgtctgtgctaggagaccacagtagtaattacacacaggttaagtggcttaaaaaaattgatcggttttgaaaattaggtgtggaagatagaaaggaacctgaggatttttataatatttttgtgatataatagactatagccaaaagagttactttatagtgagtatttttagcttcagtcccacattctcttcagaaattagtattataatccttttcattactctaaccgagtctgatgactcctgtcctaggatgaaacacccctcccaactcccttattaagagattgggacctagtgtgattaacagcaccctgatcgatgagcaagattcttacagattaaggaaaagaattgctgacaacttaggctgacttttatatacctatttgttttccttcctaattcctcttaaaatgaaaatgccaagmttttcttttgatatttgttacatttgtgaaataatataacaatgcagttaatgggaagagcatgacccctggattcagatatccaatagttacaaatctcagcttcagcacctagcagttatgtgaactttcttctctgcacctcagtctcttcataataactactttgcagagttgctgtgaatattagtgtaaataatggacattcaaatatagctattactgttattatcatcatcaattattctacctatagaaatatgcaagttccttggaagtatacatttctggagagtgatcagggatgggrtattatacttttattttttcggtttctcttcattcattcagtgggttatgggtatgtgtgtgtgtgtgtgtgtgtttcacacattatgtgctaggcactatttcaggcacttggaacktacattattgtaggggtacaactggaaactgataaatgctgtaaaaaaaattaaacaagctaagaggtacaggaggttgggagagagttgcaattattaatagggacattagggtaggccttactgtgaatatgacacaggttttgtgttcttagaggttttcatgaactatcttttggaatgggaggatgggaagaagggagatgagagtaaagagtaagagcttgctgatttgtaggcaggcatgaatattccctttggtataaggtgtcaaaacacaaactaatatggaagggtaaaattttctaggtggtctagttttattttattccatttgagcaaaaatcttcctaaagtattttgtacacaccctgccttcccaaacaatggctactgaatacagtggcccaccttgtctgtgactgctggaggaggtcatcaccatggctcacatctgttattggactttcatgaaacaagtccctcagggccagaagagatgctgtcatctgtttgtcctatgcaatggcctgagcctgcagtcattgtgagttctacccacatgtggctatttaaatgtacgtataaattaattgaaattaaatgacattaaaaattcagattcttagtcagtctagtcacatttcaagtggtcaatagccacatgtggctaatggctactgtgttagcacagatatcaaacatttctgtcactgtagaaagttctcttagtgttagttattttatatgtttctgactccaacattgttttttgtggtactgttgtcagttttcagaccttatttcctctttttgatttgttgtttctcatagctgataggtttaaatgccagatgtagaattttgtgtaaagtaagggtaaccaggctctaagagatcagaagagctttcttgtgttcaagtttttgtacttggaatttttatttctattctgagtgccccaaggcctcttttgcttggttattgttctgcagctgtactgtaggtgtaagggaatcagactgctgagttcctatgggagaagggctatcaaactttaaaggtaaaactgaacattcatggaaatgctttagatccagtcagcagtctcttatttggagcagcacaactccaggggtgcttaatgaccaactggctacatgtacgccaggcactgggttagtcccttgacacacaaacaagaatgaacatggacccaaatggaggaaattacagtttaaggggtagagagagtttcattaagtcaattcccagatatgtcccaggtactctgaaagtccagagaagggcggtacctgatccaggcttccctgatgttacaggagacaagaggccagggaatgctccctaaagaagtgattcttgagtggaatcttgagggatgcataggtactggtcacatgatgaaggtgggaaaaggtgtctgtataggtaggtgtctatacagggaaaagtgtctgtataggtaggcagactttggatgttgaaatgatgggttttcggcagaagtggaaatggggaagaggggttggggatgctgcctggggcagatctgactcttcagtagtttgacttgttcactctggcagctctgtgaaggtaaaaaggagccaggctggaggctggcacaccggtggtatgggagggccagggagtagagacctgtaatagttcaaaagagaggtaatgagggcctgctgtgagagtgtaagggggttgaacagagttcatgatttcaattggtattgatttctaaggagtaaaattatcagtattgggggattgattacatatgggggataaaggagacagaggaatcagagatgactgtgagttttcagaaaaacagattaatttaaactcttcttccaagttcacagtgataggttttgacctgtagctgctactagtgatttgcattggcaactgtggtgtctagattaggttttggcactttaggactccactctcttgtttgttaaaaacaaaacaaaacaaaacaaaamaaaacttgaatggaagcatagaccatartgaagtaccaccctcgtgtgactttaatttcacagtggcctatgaaaatttatagaaatttggcttcatttctagtggctccaatccggatgccaaaattgccctattgttgcgacatcccttgagtggactatcgaacctgttattcattaggagcagctgcaaaccatcagccaagttcccatactatgccaacaataacgccagtcaaatttcaaggtaactccaggtttcagaaatgtatgaatctcaaaatctgtctagccaaactcttatttgtatttttatgtatgcatattatatgaaaaaagctggtggtttccttagtttccataattatacattgcttcttttagactataaattgagttctcagtgttggtgaaggcatacctatagatcttagccaatcactttaaagtgaaaatagaaattcagtctggatcatggtaccaggggtagccagcccaaagggcccattatgatgaggcctatattgaaagcaaaaattcttgcatacctgtagtgcattttaaaaggattttccaagtaacagttaacatttgttaagctttcagaaaaacttatttctctagtttttaatattaaggaaatatggaaatatatgttgatactttgttttttactgacatacttcatgactgcatggctaaagccacaaaacactaggcacttaccactttctttcttttagatatatttagccactgcatctggcctttgttgccaaatattttttcccttttactctaactactccatcaatttggatctttaatggtcaggcaaattttgaatgatttcttggaagatgtgaaaccctgttccctaatcaggaaaatgtgggcaagtcttatggtatgagaaaagaagggacatctcttctaacaaagacaacaggattatagcgccattacacaacatcttcaaagtttttatttgaaaaataatgatgtgtttggtgatgaacaagtaccgtaaatgggaagcatgggaagtttccactctttaagaatgtttctatgcaaaggaggaaggaaagcttactttttgtggttcttcagagagattacattaaccatttgttgaaagtttcatttatgaacaacattggcttctaagagtattcttcacacactggcatcctttgtatgatgttgttgtaggttgtttagcaacatatcaaaatagttatataaaaagattaatatgtgtttcattaatcctaaggagagctttctgaaattcatttttaaaaataaatgattagcatcattctttgaaatttgtgacttctgagggtgggaaagaattaaaaaagaagctatcttttcaagcagtttgtgatttaataccagctggtcaagtgagttgaaaaaccttatgatttttatgttatattattttgaatgccttttcactctcttgggaagttggctaaccccacagtccttttcccatggtaaatggctctaaaactttgatcttcttataccagtttgccagatgtagcagaaagagcatgtatgtgacctttcctgtgccaattcaacccagctgatgggaaactgtaagttwatcttgcatgacttttatttctaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggtkggggctttggcatctctcattcgatccgtggcctccttctccatctacaggtttgtcacaatgttcatttgaattcctttcaaaaacaagggttttccgtgaaggaaaagtccttatgaagtaaaaacaaaccattcaaatgaaaatacttattgttcatggagtttcccccccaaacacacacacccattccacatttggtcatttgtttgtaatatcttctttggcttttctggattccaagcatcayttgtgcattcctttaaaaagctttaaggcttttcacatccacagtgatcccattacattccttatataactaatatattatgtattttcattggaggaagaactgcgttcatgtctgcatttcatcaaagattcctaatgacttcagagggagccagcctgttttmcatgttgctagagaagtggagtaaaaagagagtgggtgacatgatgggggccatctatggtatagtgaagagttagggaattagaggamcttggatacagacttggctctgctcccaaacaactaggtggtcttaggaatgtttcttaaacttctctaggcctcataattttcttctgttaaccaggggtaaagaataataataaatgtacaaaataattttgagattaaatgaggtcaacttgaaaaagatacttaattatctgtaaatgattatctacaaaggtccatataaatatttggtaatattgtttgagagtaacataggacttgtctttttctttgtagttttgattgaggtaatgccaaataactttattggccctcagtcctaggatgaaattcagtattacagtggataaaaagtctaaaaactgagatgtagatgttcagcctagtttaatagctattatggcagtgtcatacgttaaggataaaatatttgagaaacatggggaaaagaagcataactttagtgtgatagcctggcctaagatttttttaaaatgcaaaaataatagcagatagggtttatttgggtctccggattggatttttaatatctattggaaagggaagtttatttattctgcacaattgctatttggaactggagacacagctgcttgaccttaattagcaccctacacccctgaaaataaaaataactggggaacatatgtcagcagctaggaaatccagtcagaggaaagttgtacaaaagtgcagggaaaaggaaagagacattttccttatacagggataagatatcttcccaggggaggaggatggggcatgttaaaactacatgttagaaagttatacgactagttacattgatgtcatagtgctaaaaataatgttctttgcggggtctttagaggtttcaagactagtgaaataatgattgcaccatattcttttggatgattaagcttcccaggagggaagtcctaaaatggctagcttacttcccataatacctccatcaccccttggaataacatattcagcaagctgtggccattcaccatgatttcacggtcatgagacttaaattatggagctggtctgttgctttgtgaaactgggtgattgccagaaacctttatttaagaactactactcataagactaataaattcccaaatgatttaatgcacagtaatttgtcaggattcactggcatttttttttttttttctggcataatgaagacatctggaaacccaagctacaacttaggagtaccagtagaattgtccagcaagggacttcagaatctgttgctagcctctaagactgattataatgtttcactgattttatagccaatccatatttcactggactcttaacttgtataattctattctttcaacatttataaatacataataacattggactttacatagcactttagaatctttcccatgttactttatttgctctgacaacaattcagtggctcatgcagaagggtcattattagccctattttattgatagggaaataaaagttcagacaattagacatattaacatgtttaagttttgcatcctaagaaataaaaacgaaaataaaatgagataaactatgtttgtctacttctagcttattgtttttagaaccaaatttctttgatgagtattctatattcctacctctaattcctcacctttcatttgctcttcagactattatagcctggcttttgccaatactgaaacaggacttgttaaggtcgcaaataactgcctacgtgtcaaatttaatggacatttttcaggccatcatcttacttcacttttatgaagcacttgcctccatcaactgcattttcagtgtttcttctctttggcttccatgacttctttctcatgttttctctctctttcttgcttgctgtcactctcactctcttctctattccttccctatatctctggcttctcactgtgactgtttgacctgtgtatcctcatcatgctcctatgaatgcggttcatacttgtgaagatgtgacttgaaccacaatctacattgtggccatttccaaacccctctctcccatccataccactgccgccagctctaggcctatatattcacctgcctgtggattcttctctgggatgttccatagctatttcagtttcaatttttttcaaaattgacctcatccttcatcttctaagtcacatggtcctttattgcttttttctctttctgtgtccatcatttctaacagacactgagtctcttaggttctgctccttatcagtcatttcaacaattacacacggaacagctccatttcccagcatgactccacattccagcagtcagcaatcactaacacttttcccacgcaccacgtttcctcaaagtgttgtgactttgcatatgctttctcctctgcaaccctccatttcccttctcactgccacacacttatgagtttcttcctctggggatccctccctgatatccacttgtagcccaggtgagttacctcttttttggtatttccacatacatcgttctgtgcatgctctgtatcataatgtcttggaagtattgatagttttggttcgtgctttggtagagtagactaactgttgtaacaaacagcttcaaatctcagtcacttcacacaataggagtcttttgcatgttcacataatggtttcaagggggtggtcagaatgtggccttctgctcctttccatctgtggctctatcatttttgagatctgagttctctgcagagtcttctgcattcatctgacgcataaggggatagagagagaaagtcgataacctagagggagattttccatggttatccatatctaggcctggatatggcacacctcacttctgctgacattctattgggcagaatgctattacatggaggctaggaaatttggcctatctttatgtccagggtgaaaggaaagtgaatttggtgaaatactgcccagtctgccccaattgcctgtctccacactagactctaagttccagaaagacattgattacgtgtattttttaacctctggattcctatcatctagtataatgtttgaaacatggtaataacttaggaaatgtctacggaaggaatgaatttgtctgaggatgtagagtaaatcatggcagggctctcgtaacaaaccagctgacccggttcctggtgctctttgtccgaactatgtaacccatgtatagtaagtttgaaacaacttgaacttttagggtactttgctctgcatttggaggaaaatattcagatgcccaatatgccagattatacattttttctgccactacacttatgaacaaagatgttttgagttgctgattaaggaaaatagctcccttctctctgaaaagcatttcacctctatgggagtgggtgatactggatttcatctaaaaatattatagaggtcagcaacactagagaacattatattatatatatatatatatattatgatttgttgctgttggattcaaaatttgagaatcccctggagggtagtttgatttgaccagtttgattggacactttgtggtgtaatcatcaatatcatcagccattttgggtctgcagtggtcacacagttgcatgacagatgtcctgaaaaaatgtccattgcttgttgtcagcatcgtctccaggttcattattgttattctctgtgttgccattattagtgttcttgggctcaactttacttctaggagatattccctttattaatgcttttctaatgacacttctttccatcaccattatcaactgagacccccccattagagcttttttagtttttctgatggtaaaatacctttctttgcttttgtcctgggaaatatgttttaagaataaatgcaattaattagagatttaagtcccacagaggaaagcttctctatggaacaatttgtcttgcattatttctctaatttatcatattgtttagtrcatatttcttgagagcttcctagttgctcagaaatttccgagtactaggattactaaggtgaattccatrtgttttttgtcctcaagaaatatttttatgtagccaaaagagamgggggtaagaacatgtaagtgattagtgttatttattttatatttagtgctaagtgaatgattgggggaaagggataaagaaaggaaattactatttattaagcaccaactttgtactattctaaagggttaaagagtttgtctcaattaattctttatgtaacccaatagaagtagatactgtattggtatctcttttactgaaggagagacaggttcagaatgattaatggcttatcatgctacacatctaatgaaagaactaggattcaaactcagtctctggctctaacttccatgctgttagattgtaccaagcaacctggagagctaatgctataggaatctagaggagataacagaaatctgattggggttggttgcactgacaatgtggatttggggtgtgttcaataaaaaggcagaattgaccaagagaaaggaggtggaaagactctctgtaaatatcaaagcaaggtgggactgcatgatatatttgggtaaaacacaagcagatcagtttagctggagccaggcctcctagggggtcagagaaatgcaattctggggtgagaggaagagaccaggcttgaagaattcagggtagcagattaggcagttttaagtctaatgtggaggaaatggagaaccatggaatgtgttaaagatatggggtgaattttacagcagtggttcttgaagtgtggtccctggaatagcaacatcaacctatctaggagcttattgatgtgcaaattattaggccccacctaatacccgttgtatcagaaaagctaagggtggggtccagcaatctggtttaacaagccctccaggtgattctgatacacattaaagtttaagaactactgttttagaaagatcaatttggccattgtgcatagcatgcattagacagggaaggacaggttactcctctaataatgcagatatgaagtaatgagggcatagatgatggcaattggaatggaaagaaatcagcaggaggcatagtatgagaacattagaacttggggattgattgtattcaaagggggaaggagtaggggtccaagttgataggcaaggattaaaatctatgggatgaatctgtatttagttcagcccaaaatttaaaaatcttaagtttcaaataacaataaggatttgtggttttagagaaaaaccagatttggtgatatatcttgtatgttccattgggcaaacttcagctgagcagattagccatcaaattcttcttgttgatgggatgtcccccctcttatctgccaagttttcccctctttttttatatactttattcatttatgttgcctattcgagtcctgtagatatttgagctgatgatccctgctctaaggatcccagcttggggacaggagaataagaaatgtaggggtcgggagagggagctggcttggagggaaaccagccagtttggtttctagacattttgagtccgaggcaactgtaagatagtcccattaatctggtctttatattttgcaagaaaaacagttcagcatttccatttctctgttgtccgctttttagatcacccaaggcagtttaaaattctaggctggctttcttgcaataccttgggacttctgcctcctgctttcttagcatgcgagctcaagaatgcaaagtaatttttatattagcccatgtaaaatataattcaaaaggtaactctactgaggccaaactgtttgttgtattcccactgccacacatacattttttcctagttattttctccattgccccagatagttgaacagggactgcgacttttaatcagctaaggaagcaaaagactttctcttcactttactgtgaaaattgcatcaccacactgggtatgaactcattgaggtgggaatgagttgttgatagggcttggctttggaaatactactggctgatgttttatatcacttggcctttgtgtactgtattgacagagtatagtgaagaggaggaggaagaggagcaatttagtttgaagatgactaagagctgattaaacattcagctggggagagagatgagtgaatccaggtgatgtttatggagtgtcagagagggagaatgctataccatctggtgagagagacatgaaaaagtacataaatcaatctctataatgatacttaattaatacagagttgataaatgacataattgaagcaatgggtgggctacatcatagagttaaatagcttcaaagagggtgctgattaaagccattacaatttataaaacattcttcatgttaagaaagcatcttgatgagatttcacatgaacattttgtaatcagagggccagcttaaaacactcagagcagaggtgaaatgtcttaagaggtctattttggatgatttttgaaaaccagttattctcagggaataaaaaagcttgctttccccactccctttgttttttaatgggaaaaaaattaatgttgcattcttcacctttagacaatctcagatttttgatgtcctggtggtttggttcttaagcatgaccttaagataattagctatcaagcttcatttaaattgttttgaaatatcattgcaatttggggagcatatgtgcctgctggtgaaaaataaggaaaataccactgggactcaaaaactgtacaagtgactcacctcgattagtaggcttattttgtttttgcttaactcactctgaagctcataacagatgcacagtaatcaagcagaatgccaattctcatcattcatgcaggtggagggccactgtgctcccaagggggaaccagagaagacccacaacaaacactgcgttttttcttctcatcatcctttcttttccccctttctgatttttggaaggtacattctttgtttggaaagcctttgttagaaattccaaaatgttctttaatcactggattcttattattgtatcaggtagtgtgacaggcatgcttcctcataatggatagagccaggcaatgtattttggagcccgcattctggagactccatgcctgtgtctttgttcagccacttgccagatgtgcctcattggtgcctcagtttcatctgtaaaatgggkgaaatatcttctttgtttttcttcctggagttttgagggttttctttttttgtttcattttgtttttgtttttctgaggcagagttttgctcttgttgcccaggctgcagtgcaaatggcatgagttcggctmactgctacctccgcctcccgggttcaagcgattctccggtctcagcctcctgagtggctgggattacaggcacccgccaccacgtccagctaattttttgtatttttggtagagatggagagtcaccatgttggccaggctggtcttgaactctcgacctcaggtgatctgcccgccttggctcccaaagtactgagattacaggtgtgagccactgagcctggccttttgtggggtttaaaagcagtaatgttattaatgcctgacctatagtaagttttaagtacatgtaaagttgctactattatacagtcttattaactattgactggacatagttattgaatgaaaaggaggaagggagggaagcaggtaatcagggagggattgagggaaggaagaaagagaagaaaggaaagaaagaagaaggaaggaaggaagaagaaagaagagcttgatttagttaatgtcactgttgtaattggtggattataattgaagctgtctggttgggagacaaaccctatgccatttagatctctgtctgttcagtttgtccaaactctgctggggttatgtatttactagtctgtctccctttttggattggcaattctgcagacagactgtgtgtcttactcatctgggtatcgccagggctgtgctctatacctggcacacagtagtgctggaataaataaagagctggaagcagcacatccctttctctaacatgtaaattcaaggtgtcaccatttcacattcatagacattgaataataatgtagatgaggtgactaaccttttgaattgctactcatcaaaaatggaatctctggaatctgagaggagactatatagttatgtaaatttcggcaaagtattgcaaactccatattactatggtgctttgtggggctgctataattaatggtctgtttgcatttctagtacaggctgtcatttttcatctgcttataaccttgatataaacatttattcttggctgctattttgcattcataattgtaaaatatatataaacgttaaccttctgtttttcagcttttttatttatcaaaagcacagctcaagaatcacatcattgtggcatgtttttctgaatctctagtggcaaaaagaaatgaatgcattttgaattcaggcttcaggattaaggcaatgttgtttgcttatgcagtgccctttgaaaaatgtgtaatgtagcatatgaaccaaaagaatcctgagaaactttttccagccggtctttttctattacttatgccttttttatccctctgtgttcctccccacctctgtcatcagttcaagatgactcttaaagtcctcttgcatccatccaaatgacccattggcctctttaggtgcctggagaaagtaccagcaaaggtatttgttggagtctatcaaaggtaacaatacatagagtgggtttcaaaatcagacaggctgggttctattgttggctctcccatttagatgctgtgtgaccttatgtacattaaacaaccagtgtgagcctgttttctcatctgtaacatgtggagaacaatgtttacctcatagagttgttgagagaattaaatgaaatcaagcccttgayacagactgaaacatgggaagtgattgatgaaatataactgacgtcttatcttggccatggtcattattatcactgtcatcattagatagtgatgggactaagctaggtaggttgacatgagctgacttatcttaaaaggcaccagctctagatagagccctcctcagtgttcaaagactcaaaagacttgggttctgtttatctcccgatttcgggagcccactctccttagtctccctcagtcattgactaaaaactatgcacttgtcttttccattctctctatcctcatgttaaatgcttgatattgttcttgcaagctgtaccaaagttgtggtggcccaaatcagtatcagtggccagcttacccaaaatgcagcaaatattctatttcaaacaatacccaagatattttccacctcagggcctttgcactcactgtcccctttgtctggaatgctgtttccctgctttgtgtatggttggctctgtttcaatctttacattttaactgaaaggttctttttgtgaaaagcctttcctgactatactaagtagagtagcactctccctcaaactctctcacacataatctcctctgtatgcacagaatcctaattatatttggtaatttatgtctatctacctacctacctatctagttttcagcatgtacttctgcataaaaatataaattgcatgaggactggaactgtgtctttcgtgtacctcattgtattctcagtacctaggagattgctggcacagggcaggtacttaagagatattgattgaataaataactattttaaaaatcatctaagacaatagagaaccaattaaacagatacatactgtattatagctatttttctgaagccacattctaaagcaccacagatttttttctcaattttttgttttgttttgttttgagacagggtcttgctctgttgcccaggctggagtacagtggcatgatcatggctcactgcatccttcaccccctgggaccacagacacaaggcacaatgcctgtctattttttaaaaaaaattttagtagagatttttgtggaaaaatataaatctatagtaaggctgaaagaatagtaaatgactcatttactcttctgagatcagacaagatctcagtgtggtatggccatagatgtgactcatatactctttataagaaattgcctaactttttatttttatttttattttttgagacggagtttcactcttgttgcctaggcaggagtaaatggcgcgatctcggctcactgyaacctccgcctcctggattcaagcgattctcctgctttagcctcctgagtagctgggattacagtcatgcaccaccacacctggctattttgtatttttagtagagatagggtttctccatgttggtcaggctggtctcgaactcctgacctcaagtgatccacccacctcagcttcccaaaatgctgggattgcaggcatgagccacggcgcccagcctcctaactttttttaaggaagttgtaccattttatattttcggcagtcatgtgtgacacttcaggctgctccacattcttgccaaaatttaattttagcctttttggcagatatgtattggtatatcactgaagttttgatttacatctccctgatttctgaatccctctttgtgaaaagtctactccaggcttttgcccatctataatttttttaaaaattactgagtggtaggagttctttatataatttagatacagatccgtagtcagatatatgttttgcaaatattttctcccagctgatgtctttcccatcttttgtgtcatagagtcttttcttaatagtgccttttgatgagtagaagttttaaattttgaagtctaatttatccacttttagttgctttcttttatatgcatctacattcattactcaatattttgccacatttgctttctctctctctctctctgtttctggatcatttgaaagtaaggttgttataacactgaaaacatttcacccataaatatataagcatgtattcataagagcaaggaccacctctaacataactgtaatatctttgtcatgcctaagaaatttagcattgctatagaaatattatttaatttaaaattcatccatattcagattttcccaattgtttcccccagtaatgttgttgatcttttctttctgaattccataatccaatcaaggacatacattacatttagttgtcataaagctttagtctccttatatctaaaattgctccctagtctttttagtattttatgacactaacattttcaaagaatataagggagttattttgcacaatgactctcagtttggagttgttcctcattattagattcacgttaaatatatttggcaagggttctatatggataatgtcatgcccctcattgcatcacataaggaaacaaataatgtcacttttccttattggtgagaccaaatttgatcacttgtctaaggcattatctctggatttctttatygaaaggtagcattccacctttgtagaggaaatacattgcaattattgtgggatgctcttgagactttgtgaatcttaagttctttaacaaaatttcacccagtgagattttaacatccgttgatgacccctgcctgaatcaatcattgtaytggaagttgcaaatgtttttctaattcaattatttctattacaattatttgctgtgtgcttttgtaataaagagcatctgcctccttttccttctttttgtttctgatgatcacttcatgggtttttaaaaaatgtatgtgataaaattcattactatcatcattctttttgataaagcatcaaaaatttcaaaataattaatgtaaaagttagcattacatgataagcttgaatatttgaagcactggaaggaatactctttttattcatccaaagttacccagactaccacagataagtcaactaattaggagtgtgtaatcaatatcatttcctctgaactttttattaacagcatgagctttggggtaataatcctgaagttatttttagtttacaattgccaatgtatagaatatgcaaataaagatccttcatcccatacataattgctgttaattgttaaaataagtgagcaaaatctcaggtccagcaattgcttctgagtttctgcagactgatatttgttttccttttttttttttttttttaaactatgcagctctgatgttgaggagtatgaaaagagcttttttttttttttttttttgcaagagaaataaggatctcaatataggtttgcagaggccarcagggatgtatctttaggatgggtttacctcatatctgtgtaatacagagaactataaattatccacccactccaacctccccatgtcatcagtggttgtgaaggggtaactagcctctgcctgggtgtcaacagtaatagtttaatagctcagtgaatgtctgttgcctcactggttactgctccgtagagtaaatatttgacatcaaggacaagaatttaatttttaactttctcaacttaattttattcagtaaacatttattatgtgtcttctatatttcaagccaggagaagacccaatttttgtaggggtaggaacttacataatttgggggcctctttaagaaaaacaatacaaagttacttctacacatttagatataaaatcaacatttatttacaatagggaagaaattataacaatttatgaatttaagagagccaccaaatactacaaacgtgacacaattcagaaaaatatcttgttttgattaaataactacctatcaagctgctgtactttgtctgcattttttatttgcacattctttgattgctctttgtatgacagtgcttttgtgttgtagtttctaaaacaagaataaaaaaggaattcagtctttcctgtagtatggttgatcataatttagcttttattattgatagtttggaaaagtttatttcagctttatagcttttttattggtagtatcattatacaattttaggattgttgtcaaatttgggaaaatgttatcaagttttgttcatgtatgggctgtaagatttcaggacattttatgtttttgtatagtgacaatgaatgaacatcattccatttagtttgctgtctagatcctcgtttttagtggcattttatgaatttttgttatgtttgtatttgtcagcattttgtgtcaaaccaacaagaaatttcaatcttttctcaaggtgatgtactttttcattatttggcttattgagtgatctgtgagactactcatcccaaatacccaaagtatgtctctttctgtcaataaactgtagttttgtatggcttttgtctgggaatgccatactttgtcagaataagatgtggtgtatattttaacatgtaatccaatatgttaacacaaatraaactgtgacttcatacatagatgcatttgctctttgagctctacaatcacaggaattctgataaattctattttgcatgacttccttaaaaatataaaattagaggttgtgttcgcaatagcatactctgaattactgaacctattcttgataggagagaacttccattttaagtaggaattaatgaggattggatacctcgactgcagttctgcatatctgataactggaagcattttccagtgactggcttctggatctccaccactgtctccatgctttcactgccagatgttgcaggatgcattcttgttacaatatgacctctgaccctgtgtctttgtattatgacactagtagtcccgggacacattcctgtaccaagatggaaacaactgtgaatcacctaagcacatccctgtaaacccaagccaatatatctccaggtcagcttctcctagctggatcctcaatgcctatagtcaatccagtgctgctccatatgttgggaagtatgacagaaaggaagtcagagtggattaaaagattccacacctttggtgtgcatggattggtgcagcccttctagtgagacatccccagatgttagctgataacatcctcaccctcatcctccccaccatcacttctctatgttttactggcctgatccagtttttggtggcttggcacttggaattctttacaagcactttctttctatattgacttactatcatttttagaacccagattttttaaatgttcaagctggatgaacccttatacatttgctctactctttcattttataaatgaggagcttggggctgaaggtcattcagctaagtagaagaacaaggacacattattttttagctctttatgccatctttcttttctttcaagtctccatcagactacacccagccttccaggattaaagtaagttaattaggcatgcattgatttgatctccgtaggtcccccctaaattgatatttttaggagttagaatattcaatgtgctccccaaatgctacgtaatagtggttttttgctcattttgatagggcttttagcagagtgaactgtttcgtggacactgtcacaggaagtggaaactcaccttgtgaaaaggtaagctttccatgggctttgagttttcctttcctcagcaggggaagggcctatatgtgttagtgttagctgcctggccttcctctggggcttggtttttaatctccagggaggcaaggctgacaaaatgtcatctatttgcctactaaggaaagaagctgtgaaatagatctccattgcttatgcacctcaagtcgcttagttccagctgtatccataatatcatggtgtatttaaaatactgctcattgcaatccttttgaaaagagattctgatgctcgtaaatactccaaaaaggcattaaggtgttacactgatttttatttttwttttattttattttwtttatttatttatttatttatttatttatttatttattgagatgcagttttgctcttgttgcccaggctagagtgcagcagtgagatcttggctcaccacaacctctgtctccagggttcaagcgattctcctgcctcaacctccctagtagctgggattacaggcatgtgccaccacacctggctaattttatatttttagtagagacagggttgctccaagttggtcaggctggtctggaactcctgacctcaggtcatccactcagcctcccaaagtgctgggattacaggcatgagccactgcacctggccgctttttatctttaattggatttattccctttagaaaacttaagtttgtggattcatatccaaatattgccctttactgatctagctttttctgctgtaagttctaggaaccttttaattcagagaggggwaaagaaaagagctagcatacactcaatagcttttatgttttggatgcttcataaatatcacctcatttggacccttacaagagctttgggaggcagggagctttagacacattttacacctgagtaacttgatcaggacattttgaaaaaaaggtttttgattatctgtttttcaacttgagagagtcgtgagataactaaactacaaatgaaaaatacgtaggtaagtctctttgtaaggtcatattcgtaaaggttgcaaaagagaccaaacaatgtattccaattgagaagtccaggtagagtatttggttcatttgtgctgctrtaacagaataccatagactgggtaatttataaagaatagatctttatttctcacagttctggatcctgggaggtcaaaaaacaaggcactggcagcttctgttgtctggcaagggctgttctctgcttccaagatggcaccttatttcttcatcctccagaggggaggaacgctgtgtcctcacatgtggaagaacagagggacaagtgaaccaaatctttgtgtgaaacctcttttataaaagccttaatcccatttatgaggggaggagccctcttaaaggccccaccacttaatatcatcacattggccattataagtgtcaacacctgtattttggaggggacactttcaaaccatagaataaagaaaacgaaagggggaaaactgcaaacaaatgtgctatgagattagatggatttgaaggggactcgacagtcttgggccytttgttttggaagatggattttgaaagttatcttttattgtattcctgtgaggcccatttgtttcctacccttttctcttgtccccctcttccttctctttattcagtatcttcctctggcaaatagcagttactaaatttggttctctgttatcttccaactcgaaaggcaaaaggcacaggcagtaccctcctggtaattatttatgatatttctccttccagagatttgccctatggcagcttcaatccgttaccatcactttttatttttttgcccatattggcagcttcccaagactttgggaggaaaaagcagatctgcagatacgcaaacctcaaaatcaagacttggttaatgaaatcactcctccacttgcccttgcctgttactgaatcctgttccagctgggatggaaaaagtgcattggtcatgctgtcaaaagcatatcacatttctccactgctatttccttccttcttaactaaaaacaaaacaaaacaccatagacaacaaatagacacacacacamaaaaaaagacactaggtgagagtgaaggtagtttgtactattttcatttttcgtgtgttcaatcgtatttctctcagcaaatatgattggaagtggtgcttttccttccttccccaccttccagcattaggtttgtaggtgaacataaaaatacactgacactcaaagaaagagctctttctgctctgcacacatcccatctcgccctcttccttgctcctgcttatttctctctctttctgcctccttacctccttcagtttagagcttagagaagtttttcactcttcttttgacaggtgtcagatagacagtatgagctcatttaagctgaactgtctgggggaaactaaatttgttcaggagaatagcaatttggatgacaagtgccaggacataccagatggcacggctggagaaattcttatcgggctcccagctcacgttccaggcggcctctctgtctctctcctctattcttatttgttcatggttgacccaratggaaacttgaaatgcaaatgtatttcttcttggaagtttccaagtaaaaaaggtgatagtgactcagcataagatgcttacatgcccccaaaagaatagccagtacttgttatttatgcttattactactgatgcttcccagacccctgtgggcacatatttgaagaagtcttaattgtgagccctaaactgattgtgtaattccagttgtttactaaaataggactgttacctaagctgcaaaatatttgatgttcttgtcaggatgtgaatggaagtgttcttaaacattcttcctcagttgccacacagtttgactgattttgttggccctcactttccagaaagggaaccgtggacataaatgtcatgggaaggtatttagtagaaggtgtgatttttgggggcgcatatraaacattctaaaattcaaggccagggcgctgtgacaggctctaatctatgaatcattatattcttaacatattctgagaacaggaagagaaagctcaacctttatagacacagatggaatttctcctgtgaagactggtaattcatgtgacatttgctgtttgcttttgtttgcagtcaaattctttctctcaaccttgcactgtgctgttactggtcacttaacagaccttctgaaagagcaatataagtttatattttaggtacacaaacaaagcagatgtttataatactgggcatgatttttttttttttggtcaatatttggttcacatgagaagatcaactttttctagcctgtatactttggctctgaatttacgtgttttgaaaggtttgttgttgttgataatttagtgatgaaacttactcgtggaaaaggcttattgtgagtgaataaataaatagtataggctaaagtgtgtgtagcctacattatttggtagtgtagtgtacactccacatacttttatcattttaattttctactaaattatgcatgtcctggtattaggattcccatagtcatggcaaaaccaatgatggtaacgccatacttatctggaggttaaagtttcattaacaatttaaggtggaaatcagagaagaaggcctctgagccagcctaatagctattctaaccccacacagcaaggtagtatattgtattgctgctcttctcaccaagagcttctgggcctttagcacattatttttaacatgtttaaatttctgggttttgtggacacatcacattagcagatgtgggaatgatagaggttattttgacatacagagaggagacaagaaaacggaagtgtaaccacaaagctgggttgccacatcctatggaggtgtaaattcataaggataacattgagtcacccagaaaagttgtattgtgtcttccttttaagaaacaatgtgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagcagggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaaatgtggtggaactaaaagcccagtaaaagtgtaacatgaaaggaaaggctatgttatattcatccaatagggtgtgtgtttgtgtatgtgaatatgaagaaatttatcataaagaattggttcatatgattacagaggctgacaagtcccaaaatcttcagggtgagtcagcaagctggagacccaagtgagctaatgctttagttacagtctgagtttgaagcctgagacaggagaactgattgtgtaattccaatcctaaagctagcagactggagaccaaggaagagttgacgttttacttcaaatgcaaaggcargaaacattcttcctcaattgccacacagtctgactgattttgctggctctcactttccagaaagggaaccatggccataaatgtcatgggaaggtatttagtggaaaatgcaatttttggggtccatataaaacattctgaaattcaaggcttgatatcccagtttgagggcagcagggcaggaggaattctctcttccttggggagggtcagcctttttgttctatttgggctttcagctgcttgaatagggtccactcacattgggaaaggcaatgtgctttgctcagtttacaagtttaaatgataatctcttccaaaaatgccctcacagaaacatccagaataaagtttgaccaaatatatgagcaccctgtggcccagtcaagttgatacataacaatcacagccatccttccagttagtcacagaaagataccttcctgcatctagacaacaggcagctgctgaggagggctgggaacagcagttcatgatctggtatcagatcatgaacccaggggtccagcacaaagacgtagatccagccctgataggagaatgcctggtttttagaaatagggggattagcttccaaactataraaagaattcattcatccattcattcattcattttaaaattcaggtcttaattcaaatatcacttccccagggaggcctttctgatacattgtctacagaagtcctttcagccgctctcatttattcattcacgaaaatgtatcaggcctaccctgtgaaaggcactgggaatccaatagtgactgtgaataacaagcaaggtcccttccctcacgcatcttacttactagtggggacagacagaaactaagtaagcaaataaagaaggtaatttcagatagtgataaatgccataaaagataaaatwgggtaatgcattagagtgttgatttgaggacagggggaagttacactagatacacccgttagggaagacttcyccagaagagcagtcagcttggattgaaggatgaaaagtaaaagctccattcagagctcttggggaagagcctcttaggcaaaaaacagctggtgcaacagatcaacggacagaaccatttggccagttctgggactgaaagaaagccagtgtgactggaatacactgagcaagggagagaaaggtcagagaggtgagcagagaggttggcagggcaagatcttcatggaaggtcatataggccctgattcagagcttgcattttatcctgattggaaataagttttaagcagaggagtgatatgatctaatctgtgctttgggaagatcactgcccagcgggacacagattgtgtggagcaggaatgttgtaagaagtacagacatgtaggaggctattccaatagtccaggtgagaaattacgatagctgggctagggtggtagctgtggagacagtgggcagtgggcaagcttggctgttctgtgaaaaagtcttcaggaattgctgatggtttggatataaggggtgagaaaaataaaggactcaagagtgactgctaggttttattttcttaatggcacatatttttatttgaaattatcttgtttatttgtgtacttctttactgttgatctccctcatcaggctgtaggtacagtgagagaaggaatcttgcttatcgtgttcactgcctcagcctcagtatccagaagagcacctgttccttgaatgtatgtgtatataaatattgattgagtacttagtatggaccaggcctgtactaaggctgagatacagaggagaacaagacagagatgacccatacgatcatggaggctgcattctggcagaggagatagacaataaacacatgaactgagttgtttcaggttttcataaatgctgtgttgacaaaaggatgaagagagtggttaaggaaaaacctcttctctagtggttctgttattctacatgtattcactagactctaacatctgtgaaagcaaggactaggtcttatattcttcgtgtagtgctaagaagatagtatgtgcccaggaaataaaagtgggcttgtcaagcctggaagccatgctcagttcctggagcatcctcagtacctgttttgttatctatgtgatgtgacctgctagggaaattgtccgagtctctcctttcttgtgtaggttgacaatgcctagacccatcagtctctgcctggacaggcctgtaatttaactgcctgcctggctctgattgctaataggcatgggtagccacctatggatttgcacagccacacacggccttgctgcaaatttagcagcagatagtgcctcaaggtcactagagaagaaatgaatctgtaaggtgaataaactaaggccaataagcatagagtgccagaaagtagtgcccagagggatccgaggggcatctgcatgtttattaataaacaaacacacaaaaacccccgcctcctcctctacttaaggaacacagtgagatctcctcttatgaagtcatttctcccatgacttctgctttgaacagaagattttcaaaagagctttgtttgcccttaagcagtcttatcctcagataaggataaacgatcagaggaaaatttcactgggttgttggtcagctatcaaaatgaaaaatgaaaaatctttcttaactggagtaagtgtggaatgcttgaatagtgcagcagcttttagtcattcttttacaactgctgtacacattgcagccagaaaagacattttagttgtcaggtagtcaataaatatttattacmtgcttcctgtatactggttctccactgggaactgttcctaaaggtttgttttcttgttacttttcttgtccctgtgttcctcataactcaaaactgctgacccatttaggaggtatgggaaagcaagattgatcagaaagcagactgggaagagacaagtcatgataattcttatgctgtcaaaaactgagtttagcatcatgctaagcaggcagtattcaattcataattcaaaactgagtgtcgcagtgaatggggccctgcaaagtcaatgtctgattgttttcttgctgataagcaccatgatcagaggtctcttcactttggcttaaatcataaacatgtttggagcacctaccatgtatggccactctcctaagagtgargtaggatattgaggtactcccagtgtagtgtctggcttctggggactcagtgttaaatgagtgtggagaagatgtgtatatgaagactgtgtcttaagggagaatgtactaagggaaatatgaagtctggtaggtacacaggagaaggagatattaatacttcctggggggaatccaggccttactagagatccttctgcacactgtcccccagctcctcactttgagtgtttcttttggattattcattttctctatcttgtggcaggcctcatcaagactggtatgtgcatctgtgtttgcttttatcagataatcttctacctactttgagtttaccttctatttctaattccttgcttaacttctgggttccttgcacagcagcrtctgatatcctgcatgttagttctttgttttccctacccaactgaaaattactaatgcaaaattatattagcaaaatgggcataaccagaatcaccactgctggggtagttaatgagcagaggtctcccatttgcttcctgcccaccagtctctctcctgccctttcaaggcagacgggttgctggctcactaatttcccacatattgcaatcttttcctgtgatgcagaaagctatgtgtatttccccactcctgaggtgactgaactgtttaagtagttttgataattcgttgctttaaaaaatacacaaagatttgaataatatagataaatgttttccttgactacccacaccaccctattgaggtcagtattcttagatataacgaacaatgtgagtttgatctatattcttccagactttgttcccatgcactgacatatgtatatgtgtgtgtgtatgtgtgtttgtgtagttttgtgcttttttctaacaactcagctgccaaatgatcagtgcatatagcactacttcattgtttttattctcttgagtgtcattcatgtatttctaactctttgtatgcctaatatttttttgtttgaatgccaggcattgttttaaaaagctattgatgctccataggtttacctttcctctactaggcagatcaggttgaaagactgattgccttaatccaacaactgactaagttgcatcagaacaggttgcaattttgttaaattactttttgttctccctatttcagaagcatggccctccagggcttttgattgtaattctttgtctcctcagcactaagagactgcagaatatcttgtctgcttttgagagatttgggcttagctctttagtcttctgtactgtgcagcttctgaacatgacaaataacttgacagggagaccaactctgtgttcaagtctcctcaaatcttcaatttaaccactgaagccgtacatggtttccagaggatctgctggtttctttgtcccagcagcttccctctgcctgaacctaccctagattccattctctagaatgagccagcttagggtggcaartgtccctgaagttggctgcatgtcctcagatcacctctgaaatctttcctttctataattttactgttgttagaacttttggcttcattaactttctaatgtccttaaatatgtgatttttataatttatttaacttttctagttgtttttagtgggcatgttggcctgccatgaacaacttcattatacttagaagtagaacttctccctcattgcttttaactccttcagattctttcattgcatgatgtctgtggcttatttggccatttccctgttgatagacatgctgatttttatttgtcactgttacagtcttataatttaaaatgaagtacatacattttgtgtacttatttatagcaattactaatatctggaatttctggatttaaaatatggatttttaattttaatagagattaccaaattgttctccaaaaagacttaaatttaaatctcaggggctgaggcttccctttaaataaaccaggtctatctctgatcttataggttggccctagtaccaaacagttctactagtaacattgagagttctatgaactcttttagagactctgagcacactgaaagcttacctgctgtgttgtccttgccactcttacctcagtgctctcctgtgggtacatttagtacctttacaacgtgtgcagtgatcatgccatggattacaagagtttaacacattttctaagacaccaagtgagtaatgtagatactgaggagatattcagtagaaaaagccaaatcactaataatagcatattytcaatatacaggcaatttctcagttgaaaagcttagctattattgctatggccatggcttcaaagctgtgaggttcgctttttatttatattggcaattttcccatgtgcttataaaaatcagtcctttggatggttcactcagtgtatttgaataccttttccaattctctgaagctccttgatccagtaacagtttctttccttggcagaccatgaggagtgggaaagtagctttttctaagtaggcattgattggcattgagcagtgggaaagattggagctggtgaacatggggtgtgcaaatgtattcagccaacaggagctcttccagttcatagggtggatctgctggaatagttgccttggttctcctttcacttcagggtggaattaagctcctggctcaatagggaggaagcaggataagtcttagcctctggacacttaacctaaaattctaaagaaaaattccttattccttttttccttttcaatggcttacctttaaacagcattaatatcctgcctgttgtactgaagcaagaaactgtagtatctattttcaaaactagtacatggattttcaatgtgagtgtcttggtaataaatgctggtttattttgaatttaaaaatgtattttgattttgtactgacagtttaactctttgaaatataacggaggaagggtcagaaataaagcaatctttctttcttctggacttatttattcactcttctttaaacagttgttaaawctctcttatgcatttgacattgggctttgcactagtgatagaaaaatgaataagactgtgacatcttttggtactacatcatataaattgtctagattgtacttctaagccagcatgagcattttagaatataagaaatagaaaccaaaccaagaaactctagttcggagcaaaattatatgcccagttgtctaagaaagggctttgctttttaccagtaatttagaattttatgactaagacaaagcagaaaattgggaagaacagtgaaaagggcaagaagttaatggagtgyggtcagagctgagaggacaaaatctaaatgaaagggggaaaagcaataaggattgaggaaggttgtttaggtcrttaagcttacaagatcttctatttcccaattagtacattctgaccctgaagacgtttaagtacatgacgaggatgtcactggagtgtgacaaattcttcacattctcacttccctttgctaattctggcgtcagaagttattgcagagaacatagtcaaccgtctgtggagatacatctaaaacagatgtgcctattgttaaacaaacatggtatgtttaaatccatatttatttattaaacaaaaattagataattactccgattatctggtacccacagggatcatacaaatgacaaacacaaagggccagcactctgagaatgagaagcctagagagaggccaggctgggatagtgccaaccctgacataagatagaatataattaggactttaaaggaaatacaaacaaatattgtgggcactcaggaagaaaagcacttttggtggttgtggatacaggtagagggagaaagcacaaacaactcagagaaactttcttgaaggagatagtatgctaactggccatggaaaattgtttgaatatcaacaagtgatgggatctcaacagggataaaggatacaggtgtcataggtaaggtagtggcataagcaaagccatgaaggaggacagcttgtttgatgactagcagtgtgtgttataggagatggggtggaggatgcagagaaacaatgtattttgagaccacacaactatgcctttaaatcccagcccttccgcttatgcatacgggaccatgcctaggttgcttaacctttctaaatctcagattactcatctttaatatggggacaataatattgatttttgcatttgtgtgtgtgtgtgtgtgtgtgtgtgtgtgtgtgtgtctgggagagagagaaaggagagagagaggagagaaagactggttataatctatgtaaaccttctggtgctcaataaatggtagtaattattatggcaagtagttaggctatctcaattttggacaatgtgttagataaaataaaaaaaataatttgtgatcaaattttgggtgatcttaaggagctagtttaggaatatggagttactttgataggcaytggaaagccattgaagacttttgaccagggaatgatgtgattagggcttagaattgcagtgctgattctagatatattgtagagctacgacataaaggattagacaattagatatgaaccatggtgtcagacacctacatatctgttctttactctcttgcagttataaaaaccctgatttttagctggaaacatgactgtctaaaatgaagaccctatttacctgttttgcttgtggctaagtgtgcctatgtgacgatgttctggccagaagtatcatgcagtagcatacctaaaagatggctggcccaccttcttctttatcacttcctccatcctgcttcttagattacctgccatcttggtctaggtccagctgctaatttggaccctagcaatattggagggatgaactggcaggagactgagtcccaaagaacttcatggaacagaattctgccataccatcccttgactaaatttcactagccttctacatgagaaaagaatgaactaccttgttgaagcctctgagattttgagattstgttacatgcagttgatcttacaatctgattctaaccaattcagatatggaggaaataaatgaataagaacttagtttctaggatttcaagccagtagccattataggaatataaggaaacatgtttggagcagggggaggatgatggttttggtttgggattcaatccaggtggagatgtcaggtaattggaaacaaatgtcaggagcttggaagagaggccagagttggaggtttagacttggggtgggaagcaggactttaaatagctctgatagttgaatgtatgataggggaagacattttcaagggataaaagtataaaaagagtgcaaaaacctgaaggctgaccctggactaagtgtctgcttatacaggtgaggaggcaatagagatagtgaaattgggcaggaagaggtgtggtgaaggtgagggtaaagggaagaagagttgaggctgaattaatgagcttatttcttttgcatatggcatgtaggagaggaaaaggattcctaggtttmtcatagtcaagaatgtactgattatatgcatttgcttcattaatgaatacagtgctattttgtttagtgtttcaggaaatgctttgattccagcattgttttccgcttttaatgcttggaaacagctttgctaggctcttctcaggtgagtagctgcacgccaaagtgtctcagtgacagcattgctaaggagttttatggagaatggatggtcttgactggaaagtcacttaatggcttttaaagttgtgagcagatgatcatactgtataagtgacagactgtgaagtctgagacctcatgaatggttttgatgttggcatcagataaaattactaacaaattagatctgacatattttaatggtatgtataattattattggtctttgtgattataggctacatagtaactgctatcactggtaatagccagtattacttttgtctggacacacaccagacatttacggaaatagctggaagaagaatgatattgagaattgagggagagggtggtttgtgccaaaaggaaggtttggaagaggtggacactattcctctctcacttcctaactggcttattctggagttggaggcctgcagtgcctcaccctgtcaagctgacctaggcacctagtatgtttagctgttccagtccccactctccagatttggccacattctcccagttggaaatgatggaagatattgccatctggagttctctgatttcctgtaagttcttggagactttatgcatggccccacccaaagcttttccttcaccccaacaggagagaaggaggctgcagaccacagaaacttcagagatgatgatttatgtggactcatcagaagtctaaaggggcatgtctgtgttcttaaagggtacgggaacctcagagagccaattggcccaagaagcagtatgtagaatggctacatattctatattttcaaagatcaaacagtgcagagtgcaagattataggaaacccaaaagggtcacaaaccaggataagaaaatatcccattcactgccatattttccaaacctaaaagagtgcctcaatcaatgtttgttgagttttaaataaatatctttatttcagtaatatttaaaaatgtatcctaaatctacttgtyrtctgtattttcaaacatagggaaataagcaccaatagctaattggaggaataggatgggggatggggcacagcatgaggagaggagtgagagtatgtctctcccagaaaacatttattgtaggtattgattcaaattccagttcctttcattcctagctgtgtgatactggacaagttacttaaatttgagccagagtgtctccactgttaaactaagtaacaatatctactttataagattattgtgtaaagtaggtaaaatttatgagaacatgcttaataaattctaagtgacaaaatgttaggtgttattactgacatttataacaataataataataataaaataataaagattggaacatggccagggagtggtgaggggtcatagcattggtgtgaaagttggatttgaatgtgagtttctctggctcatatggtaactctgcctatccaggatttaacttagaatcaacagctccccaaacaacagcagagctctatccagtttgaacacttgaactagttcttttactcagtgagaacctgtgagtctgtctggagtagagaggcgggtgttgagattaaaccaccacagtgggctgtctctgtcttagggaagaataacagagaaggagtttctgcacaccagtctgacttagagctgagcagcacatagacgtgtacccaggtatctcatgccttatgcccagcgggacccttcctggtgtgtatggtcgatatgctaccctgtggagggtggctatttattgaattcctattccactcaacttcagtttatctgactttggaggggttgcaacacggccttgcctcttatgctgagctttctttggaattgctatgtgactgtttctttgacagacttagttagaaattcagatgatactgatttaaaatagacccgtggggtttgagaacagttagagagagcacagatgagaaggagaggttaaattttttctaaactcaagttgtcagtactaaattcattatcccccattaacaggcataataatgaaaataataatgtataactttttcactccattcactcatttattcatgaaatatttattaagtgcctatgtactagagtgtatactaaatgctagacatatatagataaatagataaaccatgcctgtcttagggagtaaggtggaaagcctgagggtggcatgtaggttagtctggcatataatctcaacaagcttttggaaagatgaaatggttgtacttagaggcagaaattgcattggttttggtcacagatgtagcctacctccattgcctgccacagaacctggctcagctaagtacccaatagatgttttttgaattggcttaatatttctaattgcatgattaagtggccagaatcagttaatttaacccatgagtccttttcactccttttacagagctagaaactttttgtggccagtcaacctggtaaccaaacatttaaattctggtaattggtaaatatgcctcgtcacaggtttgttgaatgatttatttttcataaaagcaggaggttcatgacaagctcagcaaatctgttggcagttttaagacattataccgggtagtttagggaaatttctcagcacatgagaccctttagattatgtaatattcttgcaaggcaactaggaaaaatagtttttaaaattatgtctattttgctatatttaaaagcagaaattatcttattatggagaattgattaaatatttgatagcatttttgtatgatttaacatatttataggtgttaatttctcacaaaatttaagttatagctctaagtgtagaattaatagtttccctttgattacagtttttttggtgttaacgttcatctatttttggatgatttgacttacccttcctttttaaaattcagactctaaatttaaggctatacatcaccatagtgtttatgaagtgaattaaatcttacagaaygttccagtgcaatctgaaactacagcaactacttgaggttttatgtctgaaaagtgttttaatcagtgatggatttggaattattgcagctgattcctgaattcttaggcctaggccttaggaacacactatccagatgtttataaaatgccattttaccaatgtcctgtttatactttgactttgtggttcaaaaaaaatacatttgcctacttcaaagtaccagatgaaagtattttacatcaactaaatactgcatttgagctgcccaacagtccctaacactgactccttctgccttaaaggcatttatttcctatcatcacctgttttctccaagacatgtgagaagaataaagcctgtattgtggcattttgtgtgaatgctaagwtcttggcaatgtttcttataccttccctagctcttctattttccctaaaaagtattctctttttgaaagaaaaatttaatttctcaatttcttaaaccagattattaattaaaactgcaaaatgaaggaaggaacacccactaattcttcaaagctcagcaacagaatcaaatcctttgaagatctgtctgcttaactcatcactattaatcagtttaagactatttagaaaaggtactgagagaaagaaatgaataaaaatgggtgaataaggcaatattaagctgacactttatagtccggttggtagagtaaaaaagcaatcaaacttaacagctttttaaaaaattaagaatgttatataggttgatgttatttttattattataaatrtaatatttactccttttgccaacttggaaaatgtagaaaagtcaagaaaaacataacattcatccatgatcccaccacccagacaaaaccacttttacctttcccctattttttaagtcattttttgctatgtaattaatcaatttgcataaatacaaaattgaggtaacggtatatgcacaattttgaaacatgttttaatcactttcttgtggcattaaatattcttcaaaatatgtttttagtggctgcagagttatgttatgactttctcatcctttagttggtctttagtgtgtttttatggtgtccagtttcagtattcatgttgatctcctttcaccctttgtcttcactgagtcactcttggctcastatggtaatcattagcactggtttctagatatttctggctcttcacctgcacataaaacagggctgtacatctcagtcccttggagtttgggtgaggacatgtgactttttctaaccaatgagatgtgagtagagcatttaattactgatgagagagacctttcagagtgctgtcctctttgccacagtgactggcagctttccagagagtggctgctccattagcgtggatcccagagtgaggttgaggccaacataaacacctaattggcctgggatggataggtaatgtgagaagaaaatgaaactttgttttagtgagtgaaatcttaggggctgtttgttatcagtgaataagtttgcctgtcttaactgataacaccaatcatttgtatctagattgggaatctgatttagaccttgtggtcatcttatagactcatgttcaccttcacatctgtaaattatgtggcaggtcatcatatacactttctcaaacaattggggaatctttgcccctatgcatctgttttcagggtgtttctttagttgacttcaggcgtattcaataactcatatcatatacatacataaacactcataccttcattctcacaatgtttatgattagccttgttcatacttttctgttgcctaggaaaatgtcaatagaaattttaaagtaaagactgattttttttaaagtataaacttagtagttatatgaaaatgagaaaattcataaggaaaaaatcctgtcatttcccctgccattcaaacctatttttattatcccatatttcctctattccctgtgtataaaactttatattgcttatcatagtttacatacaacttgacattttctatatatataaaaattttcatgtttttcctacacttcataattaacattttaatggctgcaaaatattccactgaaattgaacaccgtaatttatactacaatttccttattactggttttttagtttgctgcaatttttttgaaattctgttggaataaataatttttagagcattttaaaacaaatatactagaatgtatacatctaatcagtattatcatataaataacttctaagtctaaacacatattctaatgcaggtgccattgatataaacatttctaatctcttttaaaatggtctttatggccaattgatgagctacaaattaaaaattagtctcattattttataatatatcttgatttggaccccaaatcattcattcattttgttaatcatattttggctgttttcaaaagttaattctaattttaaagcaccaaattttgccttcatttagaccatttggaaggctgccaaatgctctaaaggcaatttcagaggaaaagttccaaaactgttaacagcactgggcaattgctgcgataactgagcagcctaccatagtgatggttttagagaaaaaaacactcctttttaaatgtgagtttgagtggatttgttactgtaatcattaaatccacaactctatagtcacactgggcatggatgtaatattgttcaaaataaatgccagttgcttgatagcagggactgattctttcatgacatctacattagtgccttgcacatggtaactacttaggtatatttgtgatcgagtctgtgaaagtgatccctgttgagatcacactttttccattggcaaggacctatctttgaataaatcctttctgctggtgaagtcttgaagtctccagcactctagacttacagcattagcattatgtgggaatttgttagaaatgaaagttctctggcctcaccctggacctactaaatcagaaattctagagattgggccagcaatctgttttagcaagacttccatgttattctgacacataataactaaatggtaaagttagcctgaagaaaaactgaaaataaaggtcaaagaggtgattctataatgaaagaaagttggtgttagaagccacagactagcaaaattcaataaacatcttcagagcacctactgtggtccagaaattgagcttgtagatactaggtatgcaaaagcaaaatagatagtgtctatacagaagacataaatgtgcgtaaatgggtataaaataaatacaatgctgagtgatacttcgatatagaagaatatacaaaatatgggtgrtgatgatcataactaccatttataaaccacatgttgtctgtcaggcacagtacagtgctttatatatatatttttttggtatgattatcagaaggaatataaagattaaaaggtgctgcattacttaaataggttcccttaaacctggaaagaataaaatcctggtcacaaagttcatttcttgcccagagcacttgacccattcagggatcctgtgtttgtcatttctcttcagaaatgattatattggcacctatctcagaattgatatacagattaaatacrgtcatggatgaaattatttagcccactatgtatcatcaatattcattagatagtaatcatttttattgctactaatagtaatcatcatcatcattagaggggtgagcggcaatataagatagattctatagaggttaaaagcatgactccagccagattcagattgccagggttcagttctgtctttgtcagcttctagctgtgagactatgggcttagcctctctgtttcaattttgtcatctgtacaatggggacagtaagagtccttcacagggttgtaataactggtaaatgaattaatgtgtgaaaagcacacagcacactggcaggcacagggcaaatgctcagtaagtgctagcttggagtgttctgtcaaaaagcctaacatctctttgtggtattttgtgatttttgacagaatggtgtatgctttaggcatctatggaacaaaaatatcacccttccttaaatctgtggcgttgagggatcactacatatttgaataaaggcctttctctgatgtctaacaggaagaagaaaaccactgataccaaactaaggtttaaaaaaggccaaggggaagaaaattttaaatcaaaagtcatccattcttatttcatggaaatacgttatttaagcaaatatactgataatgatgcacagatgctgtttgtatacattactttcctcctttgaattcactaagtactgatttcttattkgtgccagcgatcttcagaattagttctgtccccttctgtatcattgtgtgagacaaatatctcatatacaacttttctaaagattagaagactaaaatatgtgtctattgcctcaaaggcagagaagaggtacacaaatgtgaataaacagttaaaacattaacagatgtattggaagagtccttgaatacacatgtgattgatatcaagaaaacattagctttgtaattctgcctagatcgaacactgatgggctggcactacagaaagattcagctgcaagtatttcatgtaactgatggtgtaacgcaaaaacatttcagtagatatctttctaataatttgccacaggtgctcaaatgcctgggagctagaatttcaaggattcaaattgctactgtgatagcttcaggctttgcttccaggtttttttttttttttttttttttttaagcaggctgtggcacatgtttttaagaatttaagtctgtttattggtgatgctgcagtttgcttgattacagtttaagagggtgactgtagtttctcaaagaacccaatgaatatgaactcagtttacatcattgaaaactcatgttcaatctctatcctgtgtgtactgtgttcagttattttctttgaacttaacattatttcatctacatttctatgtactgctttcgacccatttacgtgtcatagatgtcttctcttttgccacttcctctcctgaagtttctgtcctgggtttcttctagagttcaacgtatatatagagatgcagagaacatcttagtacaaattattttttctttttttacgatattggcgatgagtttgttctccaaagcaaaataaccaaaacaaaatcagaatttttataggtttgctgcattttgggagatcacactctagaaagatcaaactaatttaagtgccaccagcattggttatacagattgatcatcccttatccaaaatacttgggatcagaaatgttttggattttgaattttttcagattttggaatacttacatgtacataatgagatatcacagggatgggacccaagtcttaaacatacagttcacttgtgtttgagatacaccttatatacataacctaaaggtaattttatgaaatatttctgataattctgtgcatgaaacaaaattttaactgcatttttgactgccactggccacagaagtcatgtggaattttccatttgtggcatcgtgttggtgctcaaaaagtttcagagcatttgggattttggatttttggattagggatgcttaaactgtatgtgtaattttcccatagcttatacggtaccagatttttattataatttaggtgtgtaataacttcttacagtaattttaatttagatttacttagttggtaggaagttatatatctgtgagagaaaattcttaatatttataatttgaaaatatataatgcactgatttatcattttggtcatggcaaacattgggatatatttgtctgcaaataaaagaaaactcgactaatggtggttgtattagtcaggaytatccagagaaacaaaaccaataggatgtgcaagtaagcagaaattttaacatacggtagaattaaattggaaaggaaacaaggaaactcatatattttgtgatgtttactatgggttacagaatgtacagtaaacacaaaagctaatatttattcaatactttctagctcacaaaacattaagtgtaaaattttagctattttaacttttcttttatctttatttcacaggcacttacctcctgtatctttgaatcttctttatatttttatgtttaagagaaaaaagccaaaagtccttcctgtatggtgtggatgttaaataccaaacagttttattccccttaacattttgaccatcttccttcttccttgcactcttgtggagttggctgctttcctttactttggaagaagctacgtttttctgaccctgtaatggtgttcttctgagatttgcggatgaacataagatattaaacatatcggttgagttttgttcatgtggagtctgtcatcaatatggaatagaattcaataatttgactttttcttgcctctcttctgccatttcaaatgaatcataaaaattaggaaggaaatttagtcccatctcctctctcttgagcagatttcttttccttctcttttttttttaaacctgtgggagttgggaatattttagtgctccccctttgtgaattatggtgtaaatgaaactttttgcttttgtgttattaatgacagtttaaaagtctgagatggattttctcttattgttgttaatgacagtataaaagtcttaggtaaatttactcttaaggtgctaaattaaaaaaaattaataaagtcaattgaaaattttccaagagttattttaaagttgatttttaaatcaaataagcttttctattaagcaaaataagtgctcttttaattagaagctttaaaaaaaactctatggaaacaaaagactataccttcaaaagctcacaatctttacaattcccacttccagacctttttttaggaaacattccaaggctttaaactatttgtgaataatttttatcttagtcaatgtgttatatgcccctgcacagacttatatattcttcattgagatatataattgtcctcttgttggatatttaacctataagctgacactcactttcaaggattgatttgagctttgcaaattttgaaatgctcagaaacataaagtgcttggtatcttttataagaagctagtcagaactgcctgacatgaagggagtttgattgatgtgtgataatcaggtgggaaatttcaaacttatttatttaagcactgcatttattttatgtagatcaaaggaaaatattcagctggcttcaaatgatgtcacttttcataagatacacaagaaatttgatgaaatttgaaaaactgattaagacttatatttgttcatgttcattttatattttgggtgtactatcttgcaagcacaaacaccagcaggctttgcttttacacatctcataagccaagtccatggaagtataaatttttaatgagatagatactaggattctctccttaaaggaaaattggaaacttaggattcttattttgacttttataatagaagttctatttgggatataattcagacacaataaaatacactcctttaacttgcacaactctatggatttagtatattcacagagttgtgcaaccaccacaactaattttaggacatttcatcatcccaaaaagaaacctcatacctattaatattccactctcccctgccagtcctgggcaacctaaaatttactttctatctaaaacctaaaatttcctttattgaatttacattctatctagatctgcctgttctggacatttcatacaaatggaatcttgcaatatatggtcttttttgactagcttctttcacttagaataatgttttcaaggttcatccatgttgtagcatgtaccaaatgtcattttgtattgctgagtaatttcatcatatggctatactgcattttgtttacacatttatcatttgataggtattaaggttgtttctaccttttgactattaaaaataatgctgctatgaatatttgtgtgtaatatttcttcatgtgggcatatattttcatttcgttataatatataccaaggggtagaattgctgggccatgtgataagtacatgtttaactttttgaagaactgtcaaattgttttccagagtaactatgccatttcacatgcaatgtacaaggattcaaatttctccacatcctccccaatgcttgtttttatctctttttggtaatagccatcctattagatggaaagtgacatctcattgaggttttgatttgcatttcctttatagctaatcatgttcagcatcttttcatgtaattatagtccatttatgtatcttctttggagaaatgtctattcaaattattttcccgttttcataattggattttaaaattattgaattgttaaatatctttatatattttagatacaagtgccttatcagatatatgctttgtaaaagttttctcccattctatgggttgcctttttactttttgatggtgtcctctaaagcacaaaagtttaacattttgatggttccatttatctattttttattttgttgcttgtgattttggtgttgtctctaagaaacaatttcctttcccaaagtcatgaagttttgtagttttagctattacatgtaaggctatgattcattttgaaattgttttgtctatggcatgatttaagaatgtaactttattcttttgcatgtggatatctggtttgcctagaaccatttgttgaaaaaactgttctattcttgttgaactgtctgggtatctttgttgaaaatgaattggccattcctagaagggtttatttctggactctcaattctactctattggtttatgtatctatccttataccagtaccatgctatcttggttactatagttttatggtaagtttttaaatatggaagtatgagttctccaactttgttctttttttaaaattctaacttgttttgtttattttgaatgatttccatatgaattttataatcagcttgtcaatttctttttttaaaaaaagcagctggaattttgatatggattgcgttaaatccataaatcaacttgaggggcattgccatgttaacaatattaagtattctactttatagacatgaacatctttccatttatttagatctttaatttattttaacaatatgttatagttttcagtgtacaggtttcacatgttggttaaatttatttgttctattttattgtttttattatgaattacatggattgcttagttaatttaattttcagattactctttgctattgttttgcttttgcatcgttcattgctgctgcacaattgatttttgtrtgctgatcttttatctgctaaccttgatgaacttcttaattagttctaatcgttttgtgtgtgtatgtgtgttccttaggattttctatatgtaagatcatgtcactctttctagaaatttggctttgatattaaaaatacattaatataaaactaaagaattagttagaataagattttgttaaaaatattaacttactcaaaaaaaaagatcatgtcatctgtgaaaagagatacttttacttcttcttttccaatatggaatttaaaaaatttttttattatttgattcctctggttagaatctccagtaaaatgtttaataggagtggggagacaaacatccttggcttatttctgatctcaggggaaaagcattcattcttttcccattacatatgatgttagctgtgggatatttgtagatgctttttatcagattgaggaagttctctttcattagtttgattagtgattttatcataaaaaagtgctagattttgtgaaatactttttcagcatctgctgggataatcatgtggtattgtcctttattatattaaaatagtatattacatcaattgatttttggatgttaaatcaactttgtgttcctgggataaatcccatttgtttgtggtatataatcctttttatatgttgccggttctctttgctggtattttgttaaggatgttttgcatttatatttataagggatttttggtctgtagttttcttttcttgtgttgtgatgcctttgtctggttttgatgacagtaatggtggccttgtagaatgagttgagaagggttccctcctcttctattttttgtaagaatttatagaggattgttattaatctttaaatcttatttagattagttatggcttccttggtagtttaccctttgcttttataaattgcagaaggggcttgtaaatggggacaggacggtggtgtttgtgctgattggtccctttacaataattttactacagtgaaagtagaggattttaaataaaactgagtcttcattttgcctccttctataaaacaatgatagatgctccaccattggaagacatgcttagttgcagaaacaaattcaaaggtttttatatcttaaattaaaattagaagatgcctttcagtgccgtctcctcagctgagccatgggtgcatgcccggctcactgtccccactttaagaagtcttaccagtaacctataagtacaaatctgtctagaaacactacttaaaagagcctgttaagaagtgttatactgaccttctcttgggtaagagcctaagaacaaggagagtttgttgaatcccagacatcacgtaaggtaatatgaataataaatatttagattgtcttcctacatgttgcaaggtaatttttggtcattaatcactccactrgctcagtgggaaaaattaacaccaaagaagtaataacaactaatttttactaagtaattactatgtgccaaacactgtcttaaatcctttatgtatactatctcttttatttttcatagcaatattatgaggtcaatgctaacattattctccactttacaaatgcggaaatttagaaacaaagaggtaatcttagttgcaaagaatgctggagctgggatccgacctaggttaagtgaccccagaacctgaaccagaatttggaatagattatatgcatcccagggatttagactcagggtctctgtattccaagttctgggtttggaagataagtctttgtactccttttgatgaataataaaatttgcagtccaccttttcttttctttttttttttctgagacggagtctcgctctgtcgcccaggctggagtgcagtggcatgatctcggctcactgcaagctccacctcctgggttcaagtgattctccttcctcgctatacctgtaatctctggggattacaggcatgtgccaccacacctggctaatttttctgtatttttagtagagatggggtttccccatgttggccaggatggtcttgatatcttgacctcatgatccacctgcctcagcctcccaatgtgctgggactacaggcatgagccaccatgcccggcttgcagtctactttttagaaatgttcatagagggtatactcagatggtactaatcacttgagattagacagtctctgcagggataattgaataagcaagttaataaaataaatatttaaaatgcattgagtgattaatgtgtttgagggtaagtgatttagttgtataattaattatttctgcaaaataactctatgaaatggtattattatcacttccatttgtagaagacacccctgaaacaaagatgtgggtaacttgccctgggccagttagcaataagcccagatttgaacccaagcagtcttgttccagaccttctgtttttaacaattctacattgcagtttctctaagtaaatagtcaccygaaatatggctacaacaatacagtcacaccaagaatgtagttagagataagaatgcatcattgtgtttgtgcatgtggagactggagctgcttctataggagataagcaccaagctatcatctgttggagagaaatgtgttgtgggtgaaaggaggaggagggctgttctgtaaatatgagacaagctgaaacaaatatagaaatatgaaaagaaaatctgattttcaaaagtgaagtttttagcctatgctttaacagaagataggaatagactgtggcacgcacttggaagctgtgacagtttggtcctgagagcactgtggtgtgggagggttaggagccacacctcaggggtgaaaaggaacagtttgaaagggcaattttagaaaatgactttgataagctccattagtagatacagaggttgaatcaacagattaatataggcttcaattataagtgtttctatgaatataagaagcatctagaaattaacaggaaaatatctgaccagttgggatggtatttctcctttagtgccaaaagtataatagtttttttttctcttgtggcagtaaaattaaaggcctggatttattcagcaacttttctttatgagaataggaatatattcccagacattgttctacacttttcctgcgtggtgttctaccaccaatgtggagttatagatttagacctctgtgtttgggtgggaagagagtaggcccactggcaggcagtaaccacagaactacatgtatctgggccagttttattccagacatgtggatcttctggtctgcagccttgacaaacttcagagttcccttgtctccttgtacagatgtgtgtaccttttgatcatgaaggcactattaatgtccttcagagtttgtgtcaatttgcaactttgaaggatatccaaattatcaaataatttacatatgatgattattaaattgaagtttctaatttattcttaacaaaaaataaaaattacattcacatcaaaagcaagtaaatcaatacttcccacatttcctgtttcccagatgcaaacaaagataagtggaagttaaatatcaatatacaggtgctttcaaaaaagtcttttggtctatttccactttcaaggtaacctggtggcttcttctctcaagtcctcacacaggtattcaggaataccaggatggygtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggtgagtgaaggagaaggctggcctaagaatacagtttcctggtctagtttgagttattagagatagtttgggaaagagagaacgtgaaaccacctagatggtcctcatagattcrttgaaggcagaagctttatatatattttttctcatcaaaattttaccatgtttaccatctcacaccagtcagaatgggtattactaaaaagtcaaagaataatagatgttggtgaggttgtggagaaaaaggaacacttatatgttgttggagggactgtaaattacttcaacccctgtgaaaagcagtttggagatttctcaaataactgaaaacagaattagcgtttgacccagccatctcactactgtgtattgtaaccaaaggaaagtaaattgttctactaaaatgatacctgcactcacatgtttattgcagcactattcacaatagcaaagacatggaatcaacctaggtgcccatcaatggtgggctggctaaaaaacaaatatatggtcatatatatatatatatatatatatatatatatatatatatatatatatatatacatmccatggaatactacccagccatagaaaagaatgaaatcatgtcctttgcagcaagatgggcacaactgaaggccattatcctaagtgaattaatacagaaagaaaaacaaaaagcatgttctcacttacaagtgggagctaatcattgggtacatgtgtacataaatactggaagaataggcaatgggggctccaaaatcggggagggagagagggaagcaaggtttaaaaaaactacctgttgggtactacattactctttgggtgacgggttcaactgaagccaaaactttagcctcacacaatatgtccatataccccctgaatctaaagtttaaaaaataaaaaaataaaaattttagcacattgactgaagaagggcaggagtaattgaaggacagaatggtattcgtgatgtggaaattcaacctcggaacaattgagagtggtatttgtccacgtgttgtatttattccatttgaagctagcctggcatttgagataaaaccaatagttaatacttattgtgttaattatcttatttaatcctttcaaagcttagtgaatttgcatatattttctgtattagtccattctcacattgctataaagaaatacctaaractgggtaatttataagaaaagaggtttaattggttcacagttctgcaggctgtacaggaagcatggcggcatctgcttctgggaaggcttcacagagcattcaatcatggcagaaggcaaagggggagtgaggtgtcttagatggcaggagcaggagcaaaggggaggggagatgccacacacttttmaacaaccagatctcatgagaactcgctaacacaagaacagcaccagggggatggtgctaaatcattcatgagaaacagcctgtataatccaatcacctctcaccaggcctcacctccgacattcgaattacaattccacatgagatttgggcagggacacagatctaaatcatatgaagtttcttcattttataggtgagaaaacaaacctagaaggaaactcaattacccaaggtccacacagctaagtaggcagctaagaaggaattcagacccaggatcttgtgaatattaaaccaagctttaaaccacagtttatgtgcagtttccagagttcatgaatttatctgcaaataaagggatggtatgcaagtaattaacagaattattgtgaggactagattaggtaaggcacatcaaatagctttgttgagtgtttggcacatcacagctcactgaatgtaagtttcctttgtatggcatcaagtgtgcaataaacactttttataaggtttctggtgcaaatctcatgcatttgttattgaaattctagaaatggaacttaaaaatgttatttagaaatttcagacttgtattttatttgacagcatcagtgggatgaaggaaagggtgaagagtgatggcatttggtgatggagaaacaagtcttatgcacatgacttctcccagactaaggactgggagactcaggactcaggacttctcccagacttgagggctgtactgcagtaaagattcattttaagctcaggactcttttccctcttctaaaatcatctgcttcaaggacctgggcatcaaccatggcttttgccacagggatgatggaaaacaagaactcagtagaatcacagggagtcagacagctgtagagaaacggtggtttcaaatagacaagcccagccccttgtccctttaagaaactgataacaacagaagagccaagagtctatatttcagatgctaaatagtcagatgccttaaagtgtaatccttcccaggtattttccccagtcagtagttccagggtaaagttatgtcatcatcaggtagctagcccagggcttgaagggtttaggattataatactatcgctgtttggtcgagcaggctgggtgagctggcctaaggttgtgggcaggtgggtggcagggtgagagtgagttattgggatccttagtctgtagcagctatggagtctcagaatctgaggctgaagtatttaggcagaggagttcttgagagccagagggctgagatagtgctggctctgacagcttcatgagggacattaacatcttctggctaggagrgcttgggcctatttgtcagctcagcctgactcattcttttattttttaaaatcagctgaattgaggtataacttatataaaataaatcaaccaatctaatgtacaatttgatgagtttggaaaatgtataatgtaaccactactacaattataatatataatatttccaccacccaaagtttcccttgagttcctttgtagtccatctccgactctaccaccctgccctggcagccagtgatctcctttctagagctatagttgttttttaaattattatttcatatataagtgaaataatataatttgtagtcattttctgtgaggcttatttcactcagcataatgcttttgagatgtatccatgttgttgattcagttgtttcttcctttatatccccgagtaatatttcattgtacagatatatgacaattcgtttatccattcagcaattgatggatatgtgggtggtttctagtttttgattattgtgtataaagcttttgtgaacattcttgtactagtctttctgtggacttaatgttttcctttcttctgagtaaatatcttggagtggaattgctggactggcctaaatttaagtacccttctctctgtcaagatgcttcactctgtattttgtcggggtagcaccttctcccagaaggtagatggacaatttcagagcaatcatgagatttaggatgttgcctagaattccaagagttgatcataaatactttgttaccaagatgtaaaaggtagaagtttaacaaaacttcttccacaaagaagtaacagcattactttcacagaaaaaaatgaaaatgaggacagtaaagtcaagtctgtggttgcgttttgtggagggaatctgcattctagctggcctggaaccgcaggggacatacagactatgaaggcaagcaagaagcatgaagtccctctgcaggtgttaagttgactaatgagcctgaaaaagaatggccttatccccaataaatgtcgcttcttccatgaagactgctttgataacattcccctcatcccaacacttcatgccactgttatggtgtcatctcctagcagaacttgcaaatgccctgagagcaggcactctgttcactctatttcctttcttttcctttttcccgccctaatggctatttcaggaacttggcatgcagtggcttctcaacacatgttttattttggtaaaatgaaggagtaagtaagaaaaaaatggttggaggatgttactaatcttgatcctctttaaatctggaagttttactgcccttttagaataccaattgttcattggcacattgaacctcatccctgaatgtagtgcaacatgtccaaatatgaacacattggctccctcatacctgattttttgtctttgtttcttgtttctattaaatgaaccatatttatctaacagcaaagttataaaacttcaagttaattttcattccctctcctttatcactgtcctacagtcaggtatcacatcctattcagtctattttcagcatattaaaaaaaaattctgttcctaccttgcctttactgctactactgccttaattcaggccctcactatttccccccgattttttttcttctggtcttttccatacttctttgcaatgaggctcaaagttattttaaaacatttgatctcaacatggtgattccctgctttcaggtccctctctcctgtttcttataagataaaggttgtgatgaagataaatgctgaggtgagtaatcagaggtgagcagaagacagagaaaaaaagacaaagagagaggggagtcagggttagataagaggcagttatagtaagaagaaattatatggtaccattcataaatgaacagaaaatgagaatgaagaaaggggaaaaggaaatgtatgatggtgaaaggcaatgtctggtggagattcaaggtcaactgagaactgatctttcataggccagggaaggagttcagttccaaagtctagcagactttcctaaaatcattcatttttaagttatcagtaatgctaacagtaacttaaaagttggtttttataatttaggttgactaacttctgcctgacacaaccttgctactttgctccatagcatactaaagaatagtggtgctaaataacttataaaattagctgcagtggaaattatctctataaaaggagaaggtctgttgaaactatcattattctgcctgcagaataatgcaaatatctttggagacttgaaagtaggcagaggggaggaaagtgggtatcttagtctgttttatgctgctattgaagaatatcatagaatgggtaatttataatgaacagaaattagatcagagttctggagacagggaagttcaagagcatggcaccagcaatttgcaaggaactaaggaacttcatgctgcatcatcccatggcagaaggtggaagggcaagagatggtgagagcaagagagcaggaggggaccaaactcctttttataacaaactcatttttgagataattaacccattcctttgataatcatattaatccattcctgatggcagaaccctcatgatttaattacctcatattaggccccaccttccagcaatgttgcattggggattaagttctcaacacatgaactttcgggtgacatatgcaaaacattgcatggactaacactaggcagtggctaatagatattgttcagtaataacacccagtatagttccttacatctcatcaaccatgcagagaaccttaataaaagtaaagcagttagcatgtaaataatccttccattttggcccaaaacccatgggcaaaatgtggtaaatatcagctttagaaaagtgtatatgtgattgataaagtattagtacatttcaaaaccctgttgcataattcatccataagcctggaccgaattaaccacaggctttaaaaagatgccaataggccaggcgtggtggctcacgcctgtaatctcagggaggccgaggcgggcagataactaggtcaggagatggagaccatcctggctaacacagtgaaaccccatctctactaaaaaatacaaaaaaaagttagccgggtgtggtggcgggcgcctgtagccccagctactggagaggctgaggcagaagaatggcatgaacctgggaggcggagatcgcaccactgcactccagcctgggcaacacagtgggactccatctcaacagaaaaaaaaaagccaataatgaaaatactttattgggtttcactttgtgaaaatagcagaataggggtaatatatacctaaaatctaccctctttccaaaaaaccgatggtggcacattctggctcctctaagcccagaattctctctccactctgacttcctcagaaactgtactcttctgtgatttgggcatgttttgcaggacccagaagatcttggacagtgtgcatgagtgcacttcactggggctaaagcagtcctctggaagctctgacattagcctcagaactgcattctctcaagacagctttatccctgggaaatcatggtatatttaagacccatctatggttgagaataaatccgagtaggtgaaaatgagcgctttttgatttctgagctgatacttcatggtactaaaatagcaatattatttctacccccacttatcaaggaactactttgcatttgaaaattcagaggaaacttcttaccatctgtgaataggttttattttttgttaactctatagaggttatcctaacaattaaaatagtcttagaggcagagacagagagtagggatcctagagatttagtacaaactctatgactttcagattaggaaaattgaccaaggagaacttgtccaaggggacacagcaaatatgtggtacaaacacatctggaacataactctagatttctggactcccatttcttttaacctctaagagattccattatgcctgggcatgccttagttgaatggtgtataaatttgagggctatacattgattcaggatataggcagttccatccttaccaagtcatttttataggagaaattgtacctttctctcatgctttttctcctgacatcttttccctaagcacaaagagttctcatatctaccgtcctttgtcgtctcagagtttccttagagcacccctgaaggagtttcacctgggaaagtcgcctgtgcttgatccattgattttatgtatcctccctctaagtcctccttgggtcatttctttttagctccttgtcactttggaagaggatctgatgaatgcatcacttctggggtgttaatgactctttatgacgccttgttcccctgtgcctcttttcacaccccttcaccaatcagctactcaggtccatctttatcagagggcaacagaaaaagccaaaatagatgcactactaatcatattatattgtaaaataaattttttagaaataattttagactcacagctattgtaaaaatagtgcggaaagttcaaatgtatgctttgaccaggctaacatgatcagtgataacatcttacgtaaccatagtacattaacctgttgaggacactggtgagaggagactcctgagagcgagctgctttcttggaaagcgagggctgtcttgtgggcatctctgtgtagcacccagtgcagggtggacctgctctgactttagcccccttagtctttttccagttttaatttatgatgctttcatgattttccacaaacagatgaacaaataaacacagaaggaaggttgtgcttgaattgacctgaccagaggacaaactgatcctaaactggactctctctcaccagtaatggattctctaatgttgactcttggggctggcccatttcttttgatccccagcaatttcctaggtcttattttgaggtttgcttagtaaaggcaatatttttaaaatgttaatatattcatgaattattctgaagttattgtatggaaaggaaagtgtttgggattttggagtggttggcggttgatggtattcaaacccattttgataaggccttgatgcagtgaattttttttttaacatgcctttttcttacagcagttattttcatgcattcaaagaacaaattcagttttatatgccagtattattttaaatatagtacagtactgtgaaggctagtggggaacattgaaatgaaaactctagtttgttaactgaacacttcactttcttttttcagtgtggggcaggatttctcaacatcatctctgttggctctttggatcagataattctttgttgtagggggctgtcccgtgcattgtggggtgtttagcaacattcttggccactaaccactaatgtcacttcctaccccacaccacacctcctgcagtctcgagcatcagaaatgtctccagacattgccaaatgtcccttgggggacaaaagccaccccaagttgagagtcactgatgtggagtaatggaaggaagactagatgggtgttgtgaggctttggttctggttttatttctggcacaaataagctgagtggcttaatccttcatctatagaaggaggaactttgtctgaaaaagcttgaaggtcattgccagccctaaaattcctttattaaaaaaatactgaaagatgaaaaaaaatacttaaagatgaaatttatcatcacactaatggtaaattctgtgtactgttaaatagcaacaagacgtcatggaagccctttctaaagctggtgctggagaaaagcattatttacagagtaagggtgttgctgttttgttttgtttttaaattctgtgttcgaatacagttgggaactttcctattcaaaaagttaaacaggctccctttttctgtggtacttcttaagcctttaatgtgctgatgtgcactgggaatctttaagaggtagctttgcagtattctgcaaatttttgatcatggaacactgttttcacagagtatcttaacataaaacattttgtgaaacagtaggatgaggcatgagttttgctgggtagattatgttttagtgttttttattatattctttttaaattgctcttacattaattcagcatctatttatttattgggtattggtatgtgtgaggcactaaggttatagcaatagcatggggtgggcagtatgctctgagcataacctgtaaaatttgcatcctgtctcttatattttgttggtagactattttgcctttctggatgtaaacatcagcctttcctgaagatgggagaacttatgcagaagttgagaaataggagaggcccattaggagggacagcccacggtgggtctgacatgccatgtgaagggccagggctttgtcctgtaggcagcgcgaaggcactgtagagttttagcagtggatttgcgttttagcagtggattttcattttagcttactctggccactgcatacttttgagtaggcaaagactgaaattcagccagaagataatagagtttaaaccaagacagttgaaatagtgttggaaaagaggagaaggattcagaaaatgtttggaaataaagttggcaggagttgttgaagtttgggtatatgagagaaaaagaggtagaagtgcagtttgggtgagtaggagaattcatccattaattctacaggaatttattgagctcctactttgctgggtgtattagggttctctagagggacagaactaataggatatatgtgtatatgaacaagagtttattaaggagaattgactcacacgatcacaaggtaaagtcccatgataggcaatctgcaagttgaggaacaaggaagccagcagtggatcatcccgagtcccaaaacctcaaaagtagggaagctgacagtgcagccttcagtctgtggccaaaggcccgagagcccttggcaaaccactactctgagtccaagggtccaaaagctgaagaacatggagtctgatattcgagggcaggaagcatccagtacagaagaaaggtggaggtcagaagacttagcaagtctgctttatcctagcctcactggccattgcttagatggtgcccacccagattgagggtgggtctgcctcttcccgtccactgactcaaatgttaatctcctttggcaacaccctcaaagacacatccaagaataatactttgcatccttcaatccaatcaagttgacacttaatattaaccatgacaagttcaccccttgtcaacttgaacccatacacatctcctgaaatcgtatataatctccaaataaagacaataattatgcctaatataatacagctatctcttgtgcaacccggagcacactaattgttaacctaaatgctattacataaagttaacaatacttaaatactgatatgaagtcaataactcttacgtcacatgacaaaggaaaaagaaaatgaagatattttcttagtgcaagtgtatacatctacatattcttaacaaaattaggaggaaatattcacaacaattacagtcctctttctgtagctggtcacgtggttgtagctggtattgatgactacctttttctactacctattctgtattccctttgccttcagcaagcacctcagtgggtcgtagttttttacttggtgtagtgacccaaaccttcactcctgaagggtctgggccatttgtagtcatgcctggattgggttgttgtagtttcccattgaccataatcacaaggcatggtaatactaagagatgccgtaaggatctcctgtattccatgcatactcttccttacctccattatgggataatagactaattttatcttgataatccggatcagttgccccggccaacactgtaactcccttcttagcctgttgacttagaggtaggcagagcccaaagtgtccagatggcaaccttaacttccaatttaatagaatcattgttgtgcctcctggcaacattcctccctctggaactaagacttctaagccagcagaatataatgtagcaggaacagaaaacaagaattttgctagtgggtcactaggggtgatggtgagtgatgccacttccatttccaccccttgttttttggacctgtgaatcctggctatgggagaaacagtaccatgtattggatgctgattcagatcatacacagccttctggagaacttcactcgagccctgcaaagccctgcaaagtattgtcgcctagttggcattgtaattgtgacttcaaaagtcattccaccattctatcaatccagctgcttcaggatgatgggtaacatagtaagaccagtgaattccatgagcatgcacacattgccacacttttttagccatagagtgagtgtcttggtcagaggcaatgctgtgtggaataccatgacggtggataagacattccatgaatccatggatggtagtcttggcagaagcattgcgtgcagaatgggcaaacccatatgtctattccggtgcagacaaactgctgccctttccatgatggaaaaggtccaatataatcgacctgccaccaagtagctggctgatctccctgaggaatggtgccatatcragggctcagtgttggtcccggctgctggcaaattaggcactcagcagtggctgtagccgggtcagcttggtgagtggaagcccatgttgctgagcccatgtgtaacctccatctctgccaccatggccactttgttcatgggcccattgagcaatgacaggggtggctggggaaagaggctgagtggtgtccatagaatgagttatcctgtccacttgattattaaaatccccctctgctgaggtcaccctttggtgagcactcacattggatacaaatattttcacagtttttgaccactcagaggtccatccttaaaattttgtatatacatattatcccattatcaaatattgtcaaattgccctcatagcaccatagctgcatggtaagatgggcaattaaacaagcaacagtgatagaaggtggtaagtgccacagtatggcagctacatgcttctataggggctcatttgagggcaaccgtcctggtctaggaagccaaggatggctttctggagagattcagtttattcctactaaaaagaagattaactgcatgctagagattataaggatggggttgggatgaggtatattacaagctgaggaagtacatgtgaaagcctgaagagtagtgttactcttttttttaagaaacgtgatgtgacttcctttaacttctgaattcatttgctaatgaatcctgtttttatggagttatcctgtaaaataacccaaagacaaagacatggcttttttaatgtatatgtgtttttagaaataaatcattgaaaagctcagtaatccctttggaraacagctttagcattgatgctgtcaagacccttgtcaaaagaataaaccaaacctgattggcctggtggataaactcattccatacataactgaatagttagagactgtacagaaatgcagttttgcctttcatcttaatatgtagtctgatgatttgtaaaaaccttcttagtgggaacagcaggttattctgcctgggtgggagcctttttactagcttaagcagctgtttaaactttcataagcaaagtaattattaaatgtttcatgaacatattggttggaacgtttgttcacattttaaccttgagttggaaagtttcaggggggtggggttaaagagttttaagctggcaaattcattctttttttctttcttattataaactttttatggcttagaaccagccaacctaaatcatggaaggaaaaatacatgtgtggcaagcatgagacatttcattgtttatttttcaaatttctgaaatgtgctcatagctgtgcatgcctctgggctcataaagacagcaaatggaaatagctgaagccagacagactgttttagatagatagccacccaggtaggcaaggaaaaccttgtaggttactctttcctccaatcaagtcatattaatttgccaaaatgggattttcaagcaggaggatgtgatctttcataggtctgaacaccttgcctttttcaatgatggagccatttaataataatcataatcagaagatgaggaataatatacatttatagaatacttagtacatggcaagtgtatatgacacatagtagtctacgtgtttctcatacattatctcctttaatgttcaccacaaccttgtcaaacaagcaatgctgttatatccatataacagatgaagaaacgaaggcttagagaggtcacagaatttgcaaagcttctgagtggctgagctgggatttaaattcatctgtcctatccaagaacaattcattatcctgtacttcttagtgcctttttattctagtttgtgaagtgctgctacctaaagagtttcccattttactctaaatgaaaaagaaaaccaggacaaccatcagcatcaacagcaactaatgcttgttgaacaactactatgtgcaggacgctatgttataagcttgggaaatattctgggatgagaataaagaagataaaagggtccttgcccgtggctggtgaggaaaataggcagtaagttctagagctcacactgtgcagcactagtgcagggcctgcagcactgtgtccttgctggcccagtactaatgtctgcatatagtactttacaatttgtaatgtgccctcactgatattgtcccacataatcccaacaataggactgataataatgattcccactttaaagatgaggaagctgagattcagagggacaaaataattggactaaggtcaggcacacaccaaaataagtggaaaatacgattcaaaatgtggttctctataacttgctgtagtcattacctagagccctgcaattttatatagcataaaataaatgctttaaggattacctgaaacacaaccttaaaaaatgaaagcctttaaataataataattacaatatagtgaagtaatgagagcaattttagtagttttaaaatatgtccacatttttttttaaaatttctgtttaaaaggtggagccgaattctcttcccctgcatgtgtactgtacttagtgtctgacttctagtgaacagaatattgcagaagtgctgggttatggcagccaagattagaacataaaatgcagtgtagcttcctccttgctctttctcttgcatcacttgctctgggagaagccagctgccacgctgggaggagcacttggagaggtccaggtggtaagacactgacttcttctgctattaaccagtacaaactagctaacaagtaaatccaacaggtccagtctaggcttcagatgacttcaaccctggccaatattttgaccacaaccttatcagagaccctaagccagaaccacccagctatgccactcccagattcttgactcacaagaacagtgtgagataataactgtttattgttttaagccactaagttttggggtaaactaatacagcaattaaagggcacaagatacacagaaaggaataactgtgtctaagctgtcacaaaagatgggtactaaaatgtgacaaatatgagtaggaacttataggtggacaaggaatttattgggaggtgttctgggcaaagaggcaagtgtatgcaaaaaagtgtggaagtgtgccacagcaaggtacatttatgaaactgcacagtacagcacaagataaaaatcacaccaagaaatgtaatatatcataatataacaacaaatgttcttaagagtgactttgagtctgcaagaaatttagttctatatggactattttaaaagataggaaagcaattaaaacattgtttgaaatatttacttcaaaatttttttaaagtactgtataaatttttagttagagtctaagctatccagaaaagccacttccctgttttcttacttcactagaactgtctggttccatgttttgaaaactttagtttaaatgtagagccaagaattaactaatgaagaacacctggattttctgcaggatttcactgcaccaattctgttacaacaatcaggtagaaattaacattttataaccaattatatgttttacttggcatcatgctaaccaactgaatttttacaaaagagaattggccaaattgactcattattctccaccatacctcactcattgactgactatttattgagtgccgtccgtgtgttacccactgtgataggcccataaaacaaccctttatggttgcaaaaatcactttgcatcccagttgcagctctactgttttctagagttaatagaagttcctggtgaaaaaaactatgcttagtttttttctaagcatgtttaacttgggtttttaattaaaattaatacctactcatttgaaataaagagaaaagtgaaaagaagttttacttggaaatacattaattgaaagacagttgctgttagcatcttgctgcacttctttcactctattttcttctatgagtatctttataaagttataatattttatagatactgtcaaatctarttgttgtttaacatcaggcaaaatatcccttgaaacagaatttttaatgtatttaagttattctaacaaatggatatcctgcaatttacttaacctggtattagatgttttgattatacatgaatctttcaggaaaaatgatgtcatagttaaataaatatgtagctagtgaattttgaatgtgtcttttgaactgtttatgggctttgtgataattgggtaattttaaatgataatcagtaggaagcttaggaagaggttaacatggtttctctcccttccaagagaactgcctttgtaagattctgagatgaccactgtggccatgtgcccaagtgtgctgtcacagttatactgtcagttaaattaagcatgaatgattggatggagaacattattattctctgcacattcttgattcttaatttaaggttaaactaatttaatgtcatgtgaatttttagcagcaattatggacagttaatgcatgttcttccttagttatgcctcatctctttgcaaaattacaatatttcattccaaatttcttctgaccagatttggaagtagctctctcttctcttttccctcaatgtttatatcagaagggttttgagtttatactgtaaatctccatttgtgtattttcataataagactctaagaaccttgactggttatgagggcactggaatcaaagcaaatgagggcactggaatcaaagcactggacccagtgctttctccatccttcaggggatattgtacagacaatagagatgctatcttaacatctctgtttgagtttttccctctccacctgtcttgcataccaccctaaccaatactccttaagtatggctctatattactatgcccctatcaacactctattttaaaaaggcatggcttcacacttcctgtaagataatagccagtagtccttgaatctggcattcaaagctttaaatctacaagatgatatactggtcataccttttcctgcctattttctagagtcttttcccagaagactctgttccatgtatttggtgtcactttcctgtctctgtgccttcctcatactgacccccttttctaacctgactgttgaaatcttacctactcagtcttttttcatttatttgttgattgtttcaataaaattaatttacttaataagtatttactgagcactgattgctcatcagacaacattcaagagcctactgaaatggcaccttccctgagaagcctctcttaattacacacccatatacaatgtttctctcttcagaacttccatakgtctcttttttatgctttccataaaatttgtcacaaatcccataccttatttatgtgcatataggagcatctaatgggaactcaaaattgctttaaagaacataaatgaatgaatgaacatgaatgagctaatgaatgaaagaaaarttatgccttctgcaccagcagaagctaatgactaaaataaaatggttaaactggactagaaatttaagattgttatgggtttctagtctaggaaacaccctcaatgtggtttccatattggattatcccaacagagaaagatatggaatccccatcttctgattcccacaccattactctttctgcaccatgttatcacatgctactctattaaaattgaggcagtattatcatactttgttattgcttttcattattagacatagtgttttaaggacagtattgaataggaagattgttttttcagagtgctgtaacctattttagcattcaaaggggcaaatgtataaacctgagtggtgagaaaaacgtagcagattaactaattttgaaagataatttattttgaacttgagtaggggctagggaccttcattagttcctaagaaaagtagaccacaaactcaacctctatgctcttttttatctagtcatgatattagagtatgtgtggactttgacagtgacacctaaatggtttttacttgcctcattgtttccttactaactgtatgaaaraagaacacgtgttgagcccctccaatctaaaaatacaaactctggaatgctccaaaatttgaaactttttgagtaccaacatgactccacaagtggaaaatcctgacctcacatgttgggtcacagtcaaaaggtagtaaaacaattgtttcatgtacaaaataattaaaaatttgtatgaaattatcttcagactatgtgtataaggtgtataagaaacataaattaattttgtgtttacacttggtcccatcctcatgatatctcattatgtatatgcaaatattccaaaatctgaaaattccaaaatccaaacatttctggtcccaagcatttcagacaaggaatactcaacatgtgagactctggaggtgaatttttgtttgtttgtttggttggttggtttttgcagtaaattgttgaagtcttagaaggggcgcattcagcagttagagcttcccttttaatttgcataccatgccgaagaagaggaggtgtgattctccttctggagatgatcattctttcaaaaagaattatggtgaattgtgttttttaaaaatagacttctagggcagagtaggggaaaaacatagggaaccgttaattaaggtatcagggcttgagaacktttttgtctgcccaagacccttcctttggaaacagcacctctcccaacatttgtgctcctagtggactggtaacttgcactcctaagaactggaatcttgaggaagacacagagcgatagatgagattggggctgagtcatccatgatggtatcctgggcagttcagaatctctgagcctcagtttttcttccccccaaaatgggattctatgtctcactgagttatttgaggattcagtgagatgatgtctctgcaagctttggcacagagttgttattcaagtgaatattagctaccactctttgaggttagtagtcctggggacaattcttttctccccctaaagaaggaaagggaaaggaaactttctactgaggaggtagcaaatgcagaatcactgaaagtgcttgcgaagaatatccaactattcaaattatgaattagcaaaagataatcaggtgattgtgaactgtgggttgctgctgctttgttgtaatactgctgttaaaacccacgttagagatcacatggacacaggaaggggaatatcacactctggggactgtggtggggtcgggggaggggggagggatagcattgggagatatacctaatgctagatgacacattagtgggtgcagcacaccagcatggcacatgtatatatatgtaactaacctgcacaatgtgcacatgtaccctaaaacttagggtataataaaaaaaaaaaaaaaagtcaatagtactgcagaaactcaggcttcttgttgggtcggggagtggcgaaatgtaaagggagtaaaaagggtggtagtctataaaggaactagccatccagccacccagaaaccaagtccctcttttaattaatagagttatggagaggctccagcatattaataaatgtccccctatgggtggtgagaacgtcaaatgtgaaacagagcatattggattttgtaataaaaatacagagaattataaatgagatgtccaggaggcatctaagttaaggacacctaagatcaagaatttatattctagttgataaaaagttgtggataaaattagggtgctgagatggaaaaagaaaggctcctgttggcaggaggaacactgatatgaagtgatgggagagttttgatcaagcctgtatctttggtatttaatatggggatgcgtagagagtattagaagccataggtacagccacatacattgttaaaatgtgactttttgtatattatttcacgtttgagcaattaccaacttactagcagttgtacaaaaagtaagccattgtgaatttgggatgcattttcacatatacattgtattagaccattcttgcattgctattaagaaatacatcagactgtgtaatttataaagaagaggtttaattggctcatgactctggaggctttataggaagcatggtgctgacatctgctcggcttctggggaggacttaggaagcttacaatcatggtgaaggtgaaggagaagcaggcaactcacgtggcgggagtgggagcaagagagagagagtgggaggagaggtgccacacacttttaaacaaccagatctcatgaaaactcactcactattgcaaaggcagcaccaagccatgaggaatcttcccccatgatccaaacacctcccaccaggccccacctccagcactagggattacaattcaaaaggagatttgactggggataaatatcgaaactatattagacatgaagctgcaaattattatttaattcatattctagcattaggtataccagaacaaggtatctgggtaagagaaagtcgatatgaagggcacaagataatggaggaagacagtttcttctatcgtctagggactttgagccaattcttgggaaaaaaaatagatgatgttgtctttgatggtccttttgttgttgttttgatcctcttcttcaaattcctggtaccttttctttctgactaacagaactctcttgttgtaaaacagcccagtgaaataggtattatcccaatgttacagttgagaaaagggggctcagaaaggttttgttaacttgctcatgccagtataataaataggaaaagccagtttcataatcaagtatgtctggctctaaagctcaccaagtccaacatttttgccttggaatgtgtaagttaacaatgcccccactaacaacatgaagcaatacagaaggaatgggttgagatggggtttgggcaaagaaaagatgagcttggttttaggtatgttgattttgagctaccttggaaagccattttctgttttgtggttgcaagagaaatcgtggtttgttgccctgtgttagacatgggtaaacttagagtgttccatttgctgtagaattagtggaggatagatagatgggatatataggcagagatcgatagatagttgtttgtacattggttgtttgaaagttgagcaatgtctgcagtcactagtcagtatttctattgcttagcaactctatttcctcatgtagccataacaaatggaacttttatatttattttttatgcttaagggtacatagtgctgcttataaatgatgcataagtgacaattttatactgtgagcattactctgactcttggaatcatagaatctcaaggttggacgggaacttaatagttggatttgttctatattcagactgctttacacctccatgaggtcctgactgacacatactactcatttagatagtgctccctatctgaaaagtcttggttttcagataacattttctttcctttaggcaaattattcctgttttacccatgaaggacaaatccaaatatcttgtcttcatgagaactcattgcacatttagaaataggccccatgtctctgccaattttctctttcctgggctgagcttcttctccatcttttcagtggctccttggagagatatattccttgagcgcaggactctttagcccaggttctgggaatgcacctcacagaaggctccagtgtcatcccctgcaggcattgtctcactggcagagagccactcatccatggccatagccttttccggtgtagtccccatctaatgatcaattcagatggggtataaaagctcagttatttcagtccaatatgtgacaactctgacaagccattttagtctcagagctgctcatggggtcagctgagtctattgttgggctgcattgcaacttgatttgttttctgttccttcttgagtccttcccctccctttctcaggtgttcattcccagggcataaacattctgcctgccaactctgatgcagagtctgcctcctggggaaccaagcctgcaatgtatgacttcaagtcttcttatgaaaccattccaatttgtttatggacttagacttctggagtggatagatacctctaggtgtaatctcctgtgtaatcagaatacattttgctttgaagaatattttaaattaagtaagattccacaaatctaatgtgtaaagctcatgcagtagaaagttttcagtgtggatgtcttagcttaggttccccctcaaaagcagagtgtgaaacaaggacttacatgtgagtagtttatttgaggaaattatcccaaggaacagaagtgggagactggaaatgattgktcacaataatctctgtcatttcatagccatagtttttcatcaacactttcctaatgagctcatctttgggatgccaagtgacattgctgtgtgctttcttcaagagatctgagcaatgtagtcagacagccaattaacatttttatttactttgggaaagctttgagtcctgagacctgcatgagatttttctggtagtatttccaactgtctaacaaaacatgtcaaaaatttcatatttgtcgttccaggaattcagcttaataagactacacagaccaggactgagaggttggtggcaaaggaaggagctactgagagccacacatcaataaaatgagatatccaaagcatggaaggagggtcagtcaaggcaatgagggatagactgggatcagttcaggaggctcctcccagaaccaggaatctaattaggagactgaaaagaaaggaagtgaaggggccccaagccagagagccctatgtataaaattatacatgattttatatatgtaagtcgtaatttaattctcacagaaatattgtgaagaatgtgccaatattattatcaaaactatttagcagatgaagtaactgaggcacaaagaggccaaataaattgtccgatgttgcataggtagtaagtggctgagcctgacttcaaacctcgatagacttttcccaaagttcatgctcttctgaatattacttatttctcatgtacctgtttctgaggcagaggttctcatgtattataaatttccttgatgaaagaccaggactggttcagaatgtgtgtgttggagaagaggggtgtaacagatacacattttatagacctccttccatcccatccatctgggcccactgcatcttgcactgcaccactcagggaacttcccccttgcccttgtctgctactatgtatctcggtcagcaagttccaacttggagtttctggctcttcttgccacttcaggacttggatgagatactaagccatggggcacgcaatgtggccccacatgtgttggaagaagccagatgatacaccctggacatgaaggagmgttaactccttgtagggtgaaatttgaccagaggagggcaatggacaggagggaagtggctaaattccctcatcttgcactgtccaatcgacttctctgaggcatgagtttttcttctagctcattctttcccttgtcaagtggacacaccagcaaaggacctgttgcgtctctttgtggcttagtgtgaagtgataggcaggatagtgatccttcagttggcattgcttggcatcttttcttgcctcaatttccttctagctcattctttcccttgtcaagtggatgcaccagcaaaggacctgttgcgtccctttgtggcttagtgtgaagtgataggcagcatagtgatacttcagttggcgttgcttggcatcttttcttgcctcactttccttctttctaatccttgtaccctgggtttacccctttcaaagaaagcattaaaggccaagctaagaaaatgggtctggactaaaaagtggaaacaaatagagtagtaggcatagttcttaacagcacttcactgttcagagacaagaaaggacatagattctttgaaaaataagtgtagaacaagttagatgttgatattatgactaatgtgtaagttccagtacttaacaagaagttgttgtaaggtgagtatttatgaagaagggggagaagggaagaactccctgatcaggctgattttaagtcagatctatttactgcctgttatgcctgtctcctcttcctcttcatgttgctaatagcaaaaatagccgctattttctgaacacttaaatatatgtctgagaccatgctaagtgctttatgtatattttctcatttattcctttgaggtagaaaattgagactcagagaagagaagtagctgtcaagcagctaatgagtgctagcaccagatttcaaacccagggctgactaactctgaagcccatactaaaaatggatttgttctgctgtcttctgcaaagttccttatcaaaggaagttatctagagcagaggaaagccatatggagaaaaaaatatggcatgagagcatcttattcattttgttcttatttgctccgaaagcaacttctggtggagccagctgctggtgtttggagtgtctttgccttctaggaggaaatactctttcctaggtgccacactgttgatacttctcaagaccaaaataccacaggcctccagctccttgataaagctttamtgtgttgaattggcataaatcaattccctaagtctgcctagcagaaccaaactctgaatatggtgacctcacagggtcacctagctcaaggcagccagcaggcttcctacttgatactttctttgatagatgtctttaggggagccaacttttctttaacatctttcctttgactctaaagctctcctctcccaacatttccycctcagtttaacccgagttatgtgttcatgacataaatagggccacgtttgccgctgaatgatgtcacagtgcaggtgatccacagatagagaatacaaatagcatttgacatttgcctttgggatgccttatactactttttatcctcccagtaatgtttacattgttgttttgtttttgttttttgttatttaaatgataatggcaaaagacccttgttaagagtcatgagatctgggatctgattgcagctctgacttatcatctggatgtgactttgatctgtcacctggtcctctgacgactcagttcattcacctgcaaaatgggagagttgggagagattatttattcttaaaccatgctgatcatcagaatcaccacagatgctttttaaaaagggcccatctcagagtcctgaatcacacttcaggtgaagggaggagaaaggagattggggagaggagcaaaggtccagaatccataattgcaacaagctgcctgggtcattctgatgcacagtttaggacaactttatgcaatactgccagttgcacaactccaaggggtgccacttgcattctacagactccatgggcacagttcacatgaaatagaatctgaacagcccctcttggtattgtgtaatacagcagccctgtatgagctgattactgtatagggtcatttgtaagcatggatattctttgattggatgacagtagagtgctttgaggtcctcagtagacagtagccctgtattagttcattttcactctgctataaagaactacctgagactgggtaatttatagagaaaagaagtttaatggactcttagttctgcatggctagggaggcctcaggaaacatacaatcatggcacaaggccaaggggaagcaaggcacatcttacatggtgacaggagaaagagagagagagagtgaggggggaagtgccacactttaaaaccatcagatcttgtgagacctcactcactatcatgagaataacaagggagaaatccacccccatgatccaatcacctcccaccaggcccttcctctaacatgtggggattacagtttgagatgagatttgaatggggacacagagccacaccatatcagacccataagcatgtggttacagatgaaggcacagtagctgtgaccaataggataggaaagtggatggcttaagaacagctgatgaacactgccccatacaaagctgactctcagattgtctcccacattatagcattacagctggtgcccatctgacaagagggagaggtgtgtgaagaaagcaggatgttgagagcagcgtgagccaaacagcaggacctcgggtcatggtttccccaatagggttgaattgaggaaaagaaacaaggctttctcccagctaagaaaagcttttagttgcctactaatttctgtgctttggggtttctttgactttgttttccctttacacatggtgaaattccttttgaaaataaattcagccctgtcttaaccaaaaaaaaaaaaaaaaaaaaaaagactggtaaacctgtatggagatattacttgagttcctagaagccaggttttgttagtaaaaaattggataagtttgggtacttgggcagacagaaagttgaaaatctggggaaagactgttagcatgcagttgtgattacattaaatgttataaatgaatttttatcagaagctattgagatgctgctgagctgacttgaggtattccattgtctagaataatactctgcttaatttgcatgagaatcagttgaggcatttgtcaaaaatgcagattcctgccacagccccaggcaattctgagtcaccgggtatggagggggcatctgggctgtgcattttacatgagcatccaaaaatcatgctttgagaatgctgccctagacaactgatggaaagacagggaactttgttccagaatacatcctgtgttccttggaaattatattaactcctctcagccttagttttccctcatgtaatgtggataakgatacttaccctttccaaaatcagaggtcttagaaaagtattttaaaaaataaactggataaaagaggtaatgctagttacttagaataggaatttatgtgaataaaagtctatgtcttgggcttctgtaaactcacctctcaaccccagcatacagcacaagaatatggaaatagaaggaagtatgtatgcmtatatgtgtataaatatgattgagattgtgtaggagcctgtcttagtccatttgtgctgctataacaaaattataataaaataccaccaactacrtagcttatatacaacagaaacttatttctcacagttttggtggctgggaggcccaagaccaaggagctagctgactcagtgtctgatgaaggctcactttctcatagatggggcttttttgctatgtgtcctcctgtggtggaaggggcaaggcagctctctggggcctcttttataaggacactaattccattcatgaggactctgccctcatgacctaatcaccttccaaacaccctgcttcctgtcacatcacatatgaattttgggaggacacaaatgctcagaccataggagaaccttggaaagatttctagaaagtcaaacaatagatttttaagaagtctattttctaataagctattagttagtgcttattagaaaatagaatctgccaaagtaatgtaggaggagcatttatcaaggcagattgatagagacagctcagtagataaggcaaacaaatgttgaccagtgaattatattcataatatattttgtatttgtaatatattttgttcttatttagagaatgtactaattagggtaaagtatagctgctgtaacagagaaccaacaatctagtggctcaaataacaaagaagtttatttactgctcatgtagcaatcctggtatgagtagtcattgcctgatgagtaactttgctctgcatggtcattcggtgagaggttccttctatcttgttgccctgctgtcacgtaggacactgccatcatttactttgcagaagctggcttgtcacctggaaaagggacagagaacatggatcatcataaagctcagacctggaaatggcacatagaacttccattcacaaaccactagtgagcttaaaaacaccaggatgcctaagtgaaggggaggctggggaatgtagcctatcaaaatagccatacccaaccataactctattgttactgctgttgaagaacgggagaatggggttggtgactaactagcagtctctgccatgggaaggtatacagaactttgaaaatggagccaattactactttttatggcttcactaattggccagagctactactgtgctgtggagtatcagtgtttcctttgatgtgttgttcctagcctctctatgggcttatatctagyatcccaggtaaacctgagagttatcctgggcaatgtggatgctggtattccattttctcaattttagggttctcctcctgtatcctgtacaggtcatgagaaaagacttgttgagtcctatcctactgttaataaatgtgctgttgataggaaaatgttggcagaagtgccaatatgaatagtcttctagttgcttttctgatggttgtgacataatgaatctcaartgtgacttttgtcatataattggaggctctgaacattaagaacattttcttaaggatcatccaggcagaaaatgagttcacaggtttttaacatttttactgatggttcccaaggctccacctgtcccttcattctattctatactgcctctttattggatttctcccccactgcaacktgtgtgtgtgtgtgtgtgtgtgtgtgtgtgtgtgtctgtgtgtgtgaggagagagagacgagagagagaggagagagggagaagagagagagaagagagagacagaaagagaaaagattgacaatatatttcagaattcttaaggtttgctcctcattattctgtgatgtgcagtactattcataacagaaaggtctgataattagctgccttgggatgttctaaaggtgaagccactctcctgcaatgcatcttgcaagagagattagtgatgtagactggaggttggcatgtgacagagactgttaaggacaaaagcagattgataacagtgaaagctgctgcttggacaggttcatggatttagagagcgacctccccgccatgggaactggatccctatgaaactgtggcatgaactacaatgagatgaaattacctcagagaaaaatctgaaggcacatttgagggttgggacattgcttaggaagctgattaccaaagacaaaaacattcatgtgtatagtgggagaatgggagataggttactctttaaatagctagttggcattgtcattgaagtttgccttactggaaaaattatgcagctatttctcttttcagttttatacacatgcgcacacacacacacacacacacacacacacacacacaccatatattctggggaagaggtgttttattttccttttgtatcatgatttcatagacccttatattctctaagagatctgggctttcagccacattcccataggattctggaatttttccctctaccctcagcctgccccatcacccaagtgtgatttttgtgattcttgtgtttctctagtgtctcaccaactgtatttctaaagcttggtcagtgttccatcttggatttcwtgttttgccacttgtgatggcaatttataataaaaccaagatatgacctgttttgtatccagcaatgaaacaagttggaatctgcctgtgatgtgcaatgtgccttcaatgaaggggcagctgtgatgtgaatggatcttgggggagagaaaggaccttaatttctcttctcttttcccatggatataaaactttgttatggtaaactaaacctctgatatcatatgcaaccgctggcattctagattgttttaatggccactccttattgcttcatgctaagcgttaccatctgtttctttcttaattataaatgcagcaggaattcacaattacatcagtaacggtggaaataaaatggagttagaggctttctacttaacacaaggcagccttcctctaatatttttcttctgttacaggcattggtcagagaggagactttttcagtggttttcttttccctctcttcagtatacttaccatgagaatgtcatgctataaattcagcaatttccttttaatgagagggagagctgtgtttattttctgtccatggagctggggatgtgtgggcagctctttctcacagtattggaaaccagtggtgtgactgtcctgctgttattggcctctgtttttgtgaaaacagatgagttataatagcccaatgacatgagtcatgtcatcccccagaggagagctgggagtggacatctaagaaactctggtagccagcctgcctgtctgtgaatatatgggaacatttatasagggaggtgatataaaagctgaagacatgtttaacccagattacttaggcttttatttttcattaagtggaaaaactaatcaaatttcagactcatgaaattttagtgctaaaagaaacccttataaatcaccttgatcaaagctgtagtgactgccctttcctttgtgtagtgctcgaccaggttgagcacgggatttggagtcagcagaacaggtttgattctgaagccaccaccatggactttgagtcctcttcactgagtttttagtgtcagttctctttatccatgacaggagacatgatgcttcttatgaagcctatgtttggattaaatgagagggaacaagtaaatcctagccattgtgtgkccggtctgtggggtttttttccccttctttccattcacatttatgatagatgaagagatattggtccagagaggttaaatgccttgcccaatatgatacatctagttcagggtggacctgaagtagaagtagttttaaaactctatttcaaggcttttgcttactatgtcatatctagaccctttgctacctttctccatccttgtcaccattgtacaaggatatgtacttttgcacaatgaataaccacaatggttatcatgtgtatgatactttttaaatctgtaaagtaccttttaaaatgtatattcccatttaacatgaagtaggtgaaatagtgttataatcttttttttctctctctctttgagacggagtctcactctgtcgcccaggctggagtacagtggtgtgatgtcagctcactgcaagctccgcctcctgggttcatgccattctcctgcctcagcctcctgagtagctgggactacaggggcctgccaccacgcctggctaattttttgtatatttagtagagacggggtttcaccgtgttagccaggatggtcttgatctcctgacctcatgatctgcctgccttggcctcccaaagtgctgggattacaggcgtgagccaccgcgcccggctgaagtagtgttataatcttatccttcctcttattttaagttggaaattctgaaaggtcaagtatcttgttgaagtcacacagaaggctgagtcaggacttgaaccaggtttttaagactttccatatatgggcttcactctatactagatggactcttactgttacaccagtacatgtaggagaggactgaaagatgcagtaaaaagaaatcgatattattatctataatttaatagttgtagttaggactttttatgatgtgaatactataagaccaaaaccattttcttgaattatattaatattttagcgatccacgtgctttttacccaccagaaggttcccctgggtaagtaaagaggtggagcaggagagagcaggtttgcaccgaaagtagttmcaaaacaaaacaaaacatataagacatcaaccacaagaagcccttgctccaaaatgcaaatgacttatttgctacttcaaaaatgcacctcatcaatgaagggatcatttgatcatttgttcctgccaagtttatgtttagtccaggaagggtcaggctggtgcatattctcacccaggggtctgagagcacagtggcaggtgtgaaaagagtctttgggccttgcacttgccttttcatgccaatgccctcatccaaataagaagtcccctttgcactttcccagcttctaggccatatgttatgtctgtttcttagagggtgattcaatgattcctggtgataatgacatcacactgagttttacttacatcctgtttctcttgtataatgcccatgctcctcttgtcatgcggtcctgagccatcagggcccactctataaagcttcctgaaaatcaggccttcctggcaacaaaactaaatcttttaatctcagaaaccctactactgaccatgtatagaaaaccatgcaaatttaaagaatgtaaatattgacattctcaggttttcccatgtaacctgatttagtctgatttccctattatttctgccatttctgtgggcattttactgaagccaggttttataaagcagcccagaagcagcatcgttcataaggtaagggcacaggctgtagtatcggccagacctttggtcgagttctggctgtgcagcttgactgtgtgatgtcaartaagttctcagagcctccctttccccatctgtaaagtgatgataacggtgcccacccattagctggtgctgtgaggatcggatgagctaccgcatgcaaagtgcttaattacaggacaatgttttgcctttctgaccccccagaaccagatgaatgattcatttgtgatgtttttctcttattaggaagctttagctggacaaaggtcattcaggattattttaacatatgaaatgcatttgttttattgaaagagattagaaatgttattttgaaagttttataccttactttagaagtcaagtcttataacattagtaggttttcacttcaggttactttcatgttctgtcttttcactgtgagcaaggtggtaagaaagccattctttctattgtcttgtatgcgaatgtgaatatatcctctatgtgccaaatacaacttcgtgagcatattgtttgttttaatgtagccttttaatgtcagaaaaaaagtctcaaagttctagtataataataatgattaaaatgcttattaaagagcacattaaaagataaggctattttgaggactcaggggcatataaacaggttattattttttcatagatgtattaaatcagacatgtgctagccaaatgtctgaccttatataggttttcttcagagttttacagaaataatgctaaaataaaggaatgtgaattcctttgccagttctttgaaggaaatggtagagtctgacctacctcgaaggagtattaagagaaacaacctggttatattgctggaggcttagagtctttaaatagtctcagagatcaaatctccctcggctacatagaatgattccatacgctttcttctgaaacttcctctctatctctaaatggggccattttgagcccctcatgaggaggcgcagtggaagaaaaatgttctgctgagcagaatctgcaagccatgccacatgcagacatctcatctgataatgacattctcactctgtagaggccaggaccaactgtgttatcctctttctcctgctcctctcctcccacctcacacatgcacaagcacctgtcaaccaacatcctcataccccttcttctcttagaaaggaggggcttcaaataatattctagggggaaaggtcccatgactctctgataagaagaggaatcctttaattctactaaacatgcaaaagcattgagcaagcaattaggcaaccatgtatatagctccagatgtcccatacatatggacaattgtccacactgctggtggggctggcagcattttaaaaactggttacaacacatatggtcctttgctttttgctctggcatctgaagtcttgctaatccaaacacatcatcgctgtggtacttccagcacagtaaatacctatctgctctcaagttacaaatgcggtgtgcttccctagctcaaggttgtgggtaaattaattcttaaatgaaagtgagaggcagggagctttgcaaagagaagaagcatgttaggtgtaggaagaggaaattaaatggattggactctcctctatcttttcagtgttttggccctccacccattaaaagctttcaagctttattggatgatagtttctaattccccttctagccaaggctccaaggtatgatttcaggatggagagtaaattctttgtgtttcccatctctcagaaaaattgcttatcagctaaagttttcgaagagtcagtttatgggaagctattttggttgtctagctacttatgttatcattattcagtctaaagtcttgcctattgctgaaaactttatgcaaaacaagatattgtggttatttatttcttagccattgctttgttgtttacacacccacataattaccttgaacaccacaggaaaaaaattgcaaaataatatttcctaaacacactttgggtttacaaagtgattataaatggcttttaaagaaagtaattcttgttcatttcattgtattcaagcttctctacttaattgtgctgtgtgtgttggaggattgtggtggtaagttgagatatgtagacaaaacagattttgtcatttttttcagtagacaaaattataatagtgtggagatactgtcattttaaaattaatctgaaaaacatttattgagtactttcaatatgtcatcagacaacttcacctgtctttgcgtatgaagtttttgtttgtgttttgcttcgattagttttgtaaaaggagacagcaacccaaggactttatagctataaaaaggcaagggtggttactacaagctaaatatgagaaaaaaacagttttgattcattccttgaatgcctccatcacagagcagtttttagcaatggaagtaagattgtgaaaggaaaagaacagggccctttacagagctccaggaatccttttgtggtactttcagcaagtattggtggtagaaaattaatagatataataaacactgtgaggttggctggcattttatctatcccttgaacaggtttaggaaatataattgacttgtgtccacaaatctgaaatacaatttttttgtgtgtaatagtaattttccctgcagctttggcattcttttttccattaaacgtctcagttttcagtgaggggaatacatccttggtcctactttgtcattttgggatgatttattttaaaattacagtaagggactttgttcggaattccactaggctaatttcaaacccagtttgctgactccaactcgccataatgttccccacctccagcacaccgaacaggaagtggcatactcagatgccaggaacaaggcgattgctcagatggaataacacttggcagtttggaaaaatttgttgatgtaagctgaaattgtaggttagatactgacttgtgggatacatttctgccaattatggtccattgtacagtcaaaaatgggaaaaattacttactgcagctggctttttggcattgaaatcactgatggaataatcagagggaaatcttctaagttatcataaaagatggattgtgacacaggatgtcagtttccagggttatccgttttacctgcctcacatgactggaaagctttttgtttaaggaaagaatcaaagagccagagaactgttgagcactccttgacactgacttgcccaatgataactgattcctacaactagccttcctgtcctgctacttcaggggcctatgtttttaagagctgcagccttgggaagattttttttccgtgcctctcctgtgtccaaagctcctgaagcatctgtaacttcctattccaggagtgtacacattctgtaactagaagcctacagctgtaatgctgaacaccaaaataactacagttgatcactggaaacatgcctaaggctgaacataatttttcattttcattcatggatttgtacatattctaaaaaaaagttcactctgaaaataatatttgcataaaaggaaataagagaaaacatactacccacccatgtagagcaaatgagctacatctctttattgatgaattttaagtcatttgggtttttccatacttatttctcattgaatgctccttttccagaagacctcacagttgtctgactgtgtcctccatcacagtcctcccagtattcaggacagatcttaggattcctctcttgagggtcacgtatccctgctktgtaattcacctcctctgtcctctatttcaggatgctcggctctaaatacactgcttgcctcaaccttccctttggattgtaagttccttaaaggaacttaggcagccgatgtttcagcctccccagaatctgcctcctctttttctggaaatagtaccttaattactcaagagaacctcctctcccactttgcatacaggccaagtggcatcccaattaagattttcttctcgtttctgcctggaggtgatcacatgattcagttgaggctatccagattatctctgccctgagaatttgagctttgagtagaatccctgtaagaatggaaaagagagagatctgattcctcttaggagagttttctgaagagaaggcaggatatcctgctgcttgccttgacttgcctacttcccttcctttataagccccggttgagtagcttcactttagagtatgcgagttgacgcatatcttgccaatacatcttttaattttgtcccagttggcccaaattggttggtttttgttgacaaagtatcctaatacagcctccatcttccagttcctatttatgtgtcatgatgatctgaagcatttcaaaagaatagtgaaggttattgcataagattcagaaagttccagtattcaatgggatcatagatatgaattaaaccaaaaaatattctttattatacaactttatttcttcccagagttttagaaatgtgtgagtttaaaatggagagttcgagcaggaaataactggaaattcatgaccattatctttaaaaatgattttttaaaaattttagaatagttttaaatttactgaatttttgtaaaatagtacagagtttccatatagcccacacccagttctcccactattaacattttacatcagtatggtagatttgtcacaattaatgaacaaatattgaatatttttaactgaagtccatagcttatttagattcctctgtttttccttaatatccttttcctgttccaggatcttatacagggtaccacactacatttgaagtcacatcctttaggctccttttggtgtgatagtttcttagaattttcttgtttttgatggcctttacagtttggaagagcatggtcagatattttgtaccatgcttccgattgagatttgtcatatgtttttcaaaagtttagactggggtaatgtgttttagggaggaagaccacagaggtaaattgccattctcatcatcacatcaagggtgcaaactatcaaaatgcttattgctgttgatggtaactttgatcacctggctgaggtagtgttcatcagggttctctttcttttttttcctccttttacacattgcactctttggaaggaaatcactacactgtgtgtagcccacactaaagagttgkaaggtgagagacagacaggtacaaagaaagaggcagttattaattccaggatttaaaaaaacaagatggcattatactccacctctttaagggtgtagtttgtatatatatattatccataattcttccacacaggagatttatctattttccttttttattttatagcttatttatattaatgtagatacatgaatacttattctataagtactggttataatctagtactagtttatttattatgttgctcaaattgttacagccttggccatggccattgggaactctttcagtggctcttgtgtccctttggcatactcccattgttgtggggttttttggtttttggtcttttttagcccttccttactttctggcaacacaaaatgctcttggcttatctctcatacttcctgctccagtcctagaatcagccatttctccaaggaaccctggttctttttagtggagaatggcattaaaaatatgtatctggtgttagttatgctcattacacctagagtgtcattgcttctaggtcttctcagctgaaagaacaagaagatgtatgtgtgtatactaacccatctgtatacacatatctataagtatttctctgtgtaatcatttgtatctattaagataaacatgaacacatactgatatctccaactctaatctttcaccacattctaactttgtcctcttgcttttctgtaagatcccaatagtgaaaatctggttcccttcacccaccattcattgtccagttccagcatagatgtattgtttcagaattgttaactcatactcctgtggagaacagctgtatcaactagagtacagtgcttatagtgcagttactgttacctttagccgtatagagtgtactcttagtgtaccttattccaaccccctgcagtgacgttgtttcatactgttctctttaaaattatgttttaaatttatccaggggataatgcatagctaaagatgacaattcgtgctgataggcttataataaaaactagcagcccctttctctcactccttstgcacctttacctgttccccaagaacaacactttcaactcttttagcygttcacatcaatttgtctaaaatctaaataatgtactttacagcttgagatatcaattttaaacattatacattgatttcctattattgtaggtaaggatttagctttattgtacctcctttccctgacctatttctttacaacatagttatttcacattttttattaaatcaacatttagtgtttacattgctttcctgtttgtttttttaaatcctgggaccaataattgactctttctttgtacccatttctcaccctataagacttttcccacatgatcaaacttaccagacagtatccagtttcttcttactcctagttcttacttcccaggaccctctgtttactcaggctgcttcattgagtgtatttatgcatagctaggaatagggctgctggtgtctgggaactgaatggggaaggagactaggtgggtggggggttctcattgtcttctatgtaggctttcatttcacctccttgttcttagattgatgtctcacctcacctcaccttccactgtgcccaggtcactaagtcacaagcctttctgagtcacttacagtgagactgatactactatctcctggcattggaaggatgtgggtttcagttgcctcattgggcatgaagggcttagggacctaagggtgtatatgcttttcatactgctttctaaaaaactttctgctttcaaccctatgacttaccctgctttagtggtatgtggtacctctaattcctgcaccttcctaaggttcttcgcagtaatgcatttgtttctctcaggtataccctaagattgccccatgggtacataagttactctagctttactgtgctgagtcagtaagaattcctgtatctgcttgacatcttcattttgtgtggttcagtgttacagatgtctttcgcctttttttttgtgctgttggttgttgtgagaggtgattgtggaaagaaaagggtgtgccaagttaaacctgaagtcccatacctggtctacattttgtatgaccacactaaactcagctcatgcgacctctttggagaaggtactcctgaatcttccaaagtaaatttctttgtctttggcttccacgtcattctgtctgtggcacatgccatactcttgtcattttccccactagacaataaacacatctagggcaggaatcatatctaactaactaacgtatgtgtactgtgaactctgtgctgctgactctactagatatcctcaatgtgtacttacttaaatctaagaatttgctacattaattgtaaactaaaacctctgagatatattatgttgctcaggtaccatctgagaagttatgtgtcaatgttgggctgaaactagaatttcacgttttaaagccttaaactggttttatgtcccacaactatgcggcccctggaaggtattcttgtgtgacctagaaaagattggaagaaattgaggatacttcaattagggaggttccccaaataacttgatttttctaattagatagagatatctttcayatttaaaattttatttctgtgcagatttgctgtgactttggtgtggcctaatctttagcagtaatcactttakcagtgaaatttaacttagaagtccagttagggttaagataaaaaggccacatgaggtaacaaatgagaatatgtactctggagttatacagatctgagtttgaactttagctccttcacttaccaaataaataagtcatcaacttctttcagcctcaattcatctatgttaaaattgggataatagcaatacaaacattattggtctgtatgaagattaaacaatataaaatatgtaaaacagcataatgcctggtatgtggtaagctttcaataartgttaccttcatttgttatatatatcatgacagttaatacaatgctgagcgaatatttgatgattstctgaaataacttgaaaaagtttagtgaaaaaattgggggatggaggggttgggaactgggcacagacaattcagccatctaaggaagcagtggcactttcttcactgagccctattaaattgaaagattgtgttctagcaccagggaagagtagctatatgaatcatttcttatgatctaaagtccattagctactccatttagctgttaatgttgcgaggccattggcggaaataaatatgttatttggtaatggacttgttttcttaacaattataatatattctttccaaatgctgtaatttaattctgccattgtgctaattagtcagcygatcagccttcagcattgtttcaatatcccacccaccacatttttatattaaagctcatttaattggtgttgtgggttgaattctgttcctccccaaattcacacataccctaacccctagtacctcagaaggtgatcgtatttagagatatttcatcttgaaaagattaaaattaggccattaagctattagggtggggtctgcttcaatgtgacttatcagaagaagaaatttggacacacaaagggacactaggggcatgcagagggggaccaccttgtgaagagacagagaacaggcggccatctgcaagccacagaaagagacctcagaagaaatcagccctgccaacagtttgatcttcaacttgaagcctccaaactgtgagaaatacatttctgttgtttaagccaccctgtctgtgggattttgttacagcagctaagcaaactaatgtggttggcattgaggagcaaaatttagactggaatttctgatttattttattctgtatagcttataaagcacttatcacacacgccatttgaacttcacccaatcctataaagtaagtgttattattaactcccgttttacagatgaagccattgaggctctgagagtctacacaaacacatagctgctcagggggcaggtggaaattgaacctgggctatttgatttcaatccccctttctttttatgtttctcatttctctccccctttactgtgaatgtagagcatgcacctgttcttttctattgcagttcattcatttgtgcaactgacaggttaccactggtgactgtggattgctgcctaatgctgggctgaagaaaacaacaaatttgccaatctcaaaagagagcatttttatttattgctcagcttccagaacctaatgcctttcaattttctgtcattgttccactgaaagtgaagaatgtaatgttgatatacctcttgttttttctgcttttatgccactccatgtggttagaccaccttttaggtgttcattcattccacaaatatatactgagcacctgttttgagccccgagtttggatgtcatgtttttgaggcaggagttaatgtgctcagcatgaagagctgggtctgcacagaaaactgctgcttcttgagccagggaggtcttcccatgatactatattgcagcttctttgctgtaatgaaaatacagtacacctttccccaactcccaaattaagctttcagtgttcttcattctctgaaaaacttttatagaaattctaagaagtgtgcctcaaaataatatagtaagcaacctgatattactggttttatataatcttagtgcactatcttattcataattaaagttacaacggtgactatgtggaagtatcttggaggagaaagtgaatagatgaggtggggggacatttgagtaataactttgattttggatgtcttctctactatttttagattataatttaaataagttcatgtgtattatattatttcaccaaaaattttactttaagatatggagaatgctccatttttccccgtaagagtagcaataatttttaaaattgtcttttaaaattagattaaattacttaattccagagacctgtgttgttcttgtgtgacaacacagagtatgcaactttaagttactggccgtctaattaaaaagatgtttccaaagtatgaccagcattggaatttgttcagacccatatttataaacagtaactatgacaactcattcctcccaaccatgctcaacccytcatactttcccaactgtctgttttacaagatgacataagtagagggtttggaaaaaagaaaaaaaaatctttggatgataaacgctttttgcaaacagagcctataaagctgtttgttcagcagcatgtgaatcggacagtgggagttcatcagacagcaaggattaaccccctaatttgtttctctcttttggaagagaacagactgctgtgaattccgtgtactcagcctgagctgccaaacatgattgaaaactatttgactgactggtggccaaaacatgaggcagggaccattcatcattttcctgctcttcactaccccatataataagttttgttttgtttgaaaggagtaaatgtatgttacagttttcaaaccaatgtctccgacaacctaaaagcatttcaatattgtacccttttccaatagaatggaaagatgctacatatctgtagcaattttaaccaaattccttctagttacctccatttccaatgcagaaactcctctcaagtgaatacatacacaggttataatatacttgatgagccagtttctttaggatgagtacatacatgactggttttgatttgaccattgtggtgtgcagtgggcttactgtgtccataccagtgtcagaatagtcagtcctctggtgcttgattgggtggcatagcccataagattagctgacttttaaaatcaaagtaataggaggactatgcaatggagacaactcctcaacattgacccatcccctcagtccagttccatatgttccattgggaattaatttcctgcaggcatagaggagtcgtaagagttgcctctgccagagaagccccatctttccttgagccaggagtcagtagaagatagtaggctacaaaccatttgactatacctctatgatctcttgccactgaatatagaaaaggagtataaagaagcagtataaaatatgaaattgaattgtcagtggctagatagttagacatatagtctgggtattcaaagggagtgccttttaaaaatgtgctcaacccccattagcccatgaaatgcctcctttccgttcctacactggcatatctttcaccagaagcatttaaccagattctagaacctgtccattgggaataatttagtcaccttcttcaacttatttttctctttttcccctctcaaatgtcattttttttcacatggctccagtctcaattctcctcttattttatccattgtccccagtaacacactcttctttgtccatctagtcatacatcaatccacctatctattcatccaatcaactattattgagccccaattacatgcatgtgaagcatattctcaaagcaccatttccctggccaagctaggatgataatgagagataagatgctctgtttcagtttggttattcaaagcagaccctataataaggaattgggagcaagtagtttatttgttaggtaattccaggaagcaacagtgaggtaaagaaggagaggaaagggggaaaaaaaacaacaaaataataaaggtgcattaagatgtgagaaactgcttataggcaactgggtttagtcctgctgggaattttttgagaaactttgtagaacgtgcctcagaattgtgcccctgaaggatgagaaagctgagatgtttatccatttacttcagtcctcactggctaagagttatcttgggggcattaaatccctggcattttcaggatgccctcccagtaggctttgcaagccttagtactggagagagccttcaggcagaaaagcagaagacaagggcatgcatagtttctgttcacctaggctgcaggtgaactcaaaagtggatgcagaggttttggttggggtgggggtaggggtgatggtggtgattccatagcatctgcttcaacctctgtgttaccacccccaactgccttaaatggaagcatatcagagtttttcattttctggtaaagagtaccagggtgggcatttactctatgtaatgtgcagaaacacagcactgtgtttagaattggacttactcatttcctgagtatatgtatagcttccctttctctacaacctcttttcagcagatttatgcagacaagaaaaatattgtaacccaaagcgccactgcaaatttccctgtgctgacattaatcatgcccatttgatttattatctatcatttgaaaagaatattttgcaactcttgtgcattgatttttttttaccaagaatgattacatccatgcagcataactcttctaaaggctaatgcagtttgcttttatcacccattcactccctaattatggtgttttcgaaagcagacactatacctggaaagttgggagagaaatatttgattcacccatctttcagagaagaggagatggatttaaaccaggctagatactgtaactgattattgagtatttggcttggggggcttaatttaccagctaccattgaattaattgaaatataaacttctgtggatattaatactttcaagagtcaaagtttaaatgccatctactttggatccgttcaaaatattttcactaaccctttataatttaattgactttttaacttttttgttctrttttgttttaacacagcgatctacccttttatgtaaccccttctgctccacatatcactgggctggggccaaaagtaactgagtgactaatatctgggaaatatttattgaatgagtgaaagaaatccacttgggatttatacccaagaacaaatgctcattaactgtaaattctccttcttttgaggttcatatatagatgctctatatgtgtttatcaaacacctatcaggttatgaaaagaatgcaagaatgcctctcttttctctccatttatccaaatctatcatttaaggccctggcataatttctccttctttaatgaagctgcttcaatttcttccaattcagtgcttcatatacttggctgcagttggggagctgtaaaaaatcctgttgactaggctacaccctagaaccctagatgatttaaaccagagcctttgggtgtggaattcaggcctctgctttttttttttttttgagacagagtctcactccatcccccaggctggagtgcattggtgtgatcttggctcactgcaaccccgtctcctaggctcaagcgattctcgtgtctcagcctcctgagtagttgggattataggtgcctgtcaccacacccagctaatatttgtatttttagtagaaacagggttttgccaggttagccaggctggtctcgacctcctgacctcaagtgatctgcccgccttggcctcccaaagtgctgggattacaggcatgagccaccgtgcctggcaaggcctctgcacttttttttttttttgagacggagtcttgctctgtcgccaggctggagtgcagtggcgcgatctcagctcactgcaacctctgcttcttgggttcaagtgattcccctgcttcagcctcctgagtagctgggactacaggtgtgcaccacaacgcccagctaattttttgtattttagtagagatggggtttcaacatgttagccaggatggtctcaatctcctgacctcgtgatctgcccgccttggcctcccaaagtgctgatattacaggcatgagccaccgcgcccggctggcatctgcatttttaaaagctcaagttattacaatgtgcagccaaggttgagaacaccactgtacctggatgtgattgctctcttctctgaaaacctaggaaacctcgatattaaaagccacctcttaaggacagttgtaattggcctagtattctggcttaagttactctgaagatcaactagcctaaccacccttccaattccaagatacctctgacagccttctggttgtccagttcaaatccttaatactgacatggaacttattcccagtgcagccttgcccatctttgggcagctctgaccagtccagatataagtctgtctctttgtagcttcaagctattcttcctgtctctatcactttggggtggggctgggagtgagggaatctttctaacaagtgttttaaatgtctgaataatctatttattcaataaacgtttatggaatgcctcctatgtattggacactgggctacctcattgaaaagcgatgtacaaattcctaggaggatttgcaagccagtcctcctttcttctttttcttcttcttcctcttcctcttcctcttcctcttcctcttcctcttcttcttcttcttcttcttcttcttcttcttcttcttcttcttcttctcctccttctccttcttcttcttctccttctccttctccctattcttcttcttcttcttctctttttattgtactttaagttctggggtacatgtgcagaacgtccaggtttattacataggtatacacgtgccatggtggtttgctgcacccatcaacctgtcatctacattaggtatttctcctaatgctatccctcctctagcccccaagccccggagaggccccagtgtgtgatgttcccctccctgtgtccatgtgttctcattgttcaactcccactcatgagtgagaacttgcattctgtttgttgttattttgttattaagctgccacatttctgacataaaagaatatctttggctgcaatagtgaaagagaaaatgggcgtaagctgcaacatgagaaatttaggtagcagagcgatgactattaaactttgagaagttttctgtttaacgttgtgaaatctttccttgaagctttaaatatgacatactttcatgtgattctatttatatactgccttgagggcagagggcaatgccctgtgttccttctgagggttccttctgagtgactctaagtctctagatgaggtagccctgaggaagcaagaatgaatgattaagatacttcctgatgatgtttttaggggaaagataaacaaggttgcttcccctgctggctggtgttccccatcgtgcatgcatccagatgaggtctccaaggaaaatcttggtccagcaatgcttgactgtgccagttccctgatgctgatggctttgctgggaaacaaagcacattaagggtggatctaggtcactctggacttcatacctttccaaggcaaggaaaggccaagccccaggggctccattcacattattgtgctcctgaggggttgcgctcctagacttcatcagtgtcactggaaatgatacctcccacagtcatttaatgaggtagtcctgggcatatagcacagtggagataggcaccttgtcaaacaactggtgctgcagaagtgctgaaaaccctatgctgtctcattggagggaaggtaaggggtctcagagactctctcctaggaattagaacatggttccacttactccaacctagaaacacatcagagaggaattttatactccaggaaccaagctaactaagatgtttccaccacctttttttgcctgcttagatttcagatccttctttctttctaatacaccaagccctgagatgacatgggttccttctaatctcagagtgtgaaattttctctctggaatttaattctggtttattcctccaccttgccctgctttatcctgtggcatatgtgatgccacaatgcagttgtgacttccctggatgcatcagcgttaaagcagacacaagcactgaaaatatgcagggccagaccagcaggtcccgtacagctgaagttcatcatggtgttttacaaccaaccaattactcaattcattttatgggttgactgtgcccatcttttactctcatgaagcattttctatcgtaagacagaaagcgagggaaaagtgctctttcagttccaaaccctggggcatttatgcactaataaccttcctcctttgtgcttttccaaagaatgtaaaccaaagcaattaaattaaatggagttaacattggcatggtagcataaatcaaacgtcaggaaattcattattaaggggttatcgttcctttcttatgagctatctagtatctgccttctctgaggtaaaaataagccaaaaatttggtcctgatataaatgaggggactgcatgagagagagacagacagggagagagagaccttgtgtttagcagcagataggcagacttgtgatttgtgggcgaaacatgtttatcagatgcttgtctctttgcctcttaatcaggttcttcttcccatggcatgctaagcaggcaaacacagttaagcagtttacctctgtactcaacagttccagaactgaaagtaaacagccttgtgtgtttaggctgcagccaccgggctgtgctctgtagagctgccagatttctccacatcactgattctcccagtgaaaagcaaaggcttcctcttcattgtgttcacagactgaaagttgcttgcaggattggcttccgaagttcagaccctgatgaaggaaaatgatactccgagtctgagggtggcaaatcagaagaaataatttgtttggattcgggtctgattttaatttcaggagtctggggcctgaaagctttctgctgagtctgaacacaaaccccaaacttctcaactcaggttgcttttaaggaattgtaaactatttaaaacctatatatttaaaaaattataatttattcccaatgagaggatcctctccccagccaacgtctattttgcacatgactttctaatgaactgttaacaagcatttatattaagagcttgctcgggcttttgaatgatggaagataattctgatttacatgagtgatagtttaaaattccaggtgctttatttctgtttattggggtgggacaggggaaggactaaaactgcctacaaagaccctttcaaaggcaaaggaatagaatgtataacattccattttgtcagcatgaggaaggtcttatttaagactctctgaacagatgtgaccaattgtattggtgaggaggaatgttggaagataagatgttctgctctgtttgaatgtgtatttttagcagtgtcctattgtaaagaagttatgcccattatcttttgacttgctttatcagattaaacaaagatgctcatctttctaggctttctaatatgctccctcaatgcaagtctctcagctccaatgctgtgtgttagagtgtgataccccctcctgttactcctatttggctgaatttcagaaatccatttagatactctcacggttttgttcagcattgctcaaaacatggcttctcaccaattctgactgtctctctgaaacatgattaattttttctatgtctatctttacactgtagagtttaggttgaaaatatacttttactgtagtctcttattttcaggaatgtgtacgtaagcacccaaatgaattctactctgagatacaattacccatgtatgcttccaactgaaagcatccactgaaaaaatatagatagagaattcagtagctctgactgttagagcatctcagtaggcaaaagtttccttacagtaattgctatgctttggaaacagcattttctgtgtactaagaactcaagggagagctgtgttcaggtcaaagcttgggtgaggtataataagaaagaaccccagctggagcagtgaaaaaaccaagaggcgagaattttgtcctctctgaacttctcggttagaagattaagagggagatataggttccctgagacatattcagaaactataggggtttctatggcaacagaaatgaaaaatgaaaatacagtctcatcttctcttgttaagatccctcagtttcacatgagcccaagatcaaggagtcaaatacagagaaagtcacagagcaaagagggagccatgtttcttttcgtccagcagatggctagcaacaagaactgcttagaagaccttcacttgttgaggaattgagagaactgttgaatttccttttttccaggtgatttttgggaaagattgaaaagttaatccaaagagttggttgagatagagcatttatctcacttggtagctcccccagtggaattgaagtccacagaattgctgtctcagaagtttcattctttggttagctgtttccaaagtgtaagtgagtccttcacaaacatgattaccaaaagtaataaataaatacatatctggcagtgaggatgattttttttggagatttttagttttaaaccacgtattttactggaagtataatgcacccatttcccagtggttacatggaaagacttcgttcctcttctggttctcccagcaatgacttttcagtcactgaagaattcagaggacaatgacaactcccttcacaggatcatacagacacctgtcatttgaatgcctgggaaaaggataggaatggagatgtatctggttggactccaagataaggaaaaacttttgatgggcaattggaatgtcagcagatttatatctccttgaacttgggtctgtcaacactgccatgagaaggaagatgtttttcccacagagagacatttatggggcaaagacagacatcagtgtgctaaatcttataaaattcctttgcatcatccaccttgacagatggtcttcaggaatgtgctgaacctccaaaacagagggttgggaggaaacycaagagtgttcttcmcctgtcttctgtcaatgactacgacacactgaaggccacattgaccttccatcaaacatacatgcrggcttcaagccacccttccttcttccccgtaagggacaggttgaagcaaagatcatgctattaggtattaggtaacaagcctccacttacagagtatcctagggatgaaaacctttttgccttatagccatgctagcttcaaacatgagataggtaaaatcgttttgttttcaactttctttccatttacttccctttaacttttctattatgccacaaaggacaagtatgtgttttccttataaaaagaagttttggcaaaaaatgaagttttggtcctatagttyatagtggccccagaaaaaattgccttactatttccacaacaccattgcttgttttttgtttttgtttttttatatagtcccacactttcttttgctcctgtttcatttactaacttggaatgctcacgctcctgggcctgatacactcctaggatcacctaggctgggtgaagcttggccttcagaggagtagacagagcaggaaggatgaccactatggtcttagcttcctttagtatgacttccctttcttcagctggagtcccttccctaaacacctgcagccatcctgtggctttgcatagtggagcccagggactaacacgacagtggtctgagtgtctcagacttcgagactattgctttctcctctgttccaatctccaaaaagagttctatgagaataattgcccaaagagaaggtacttcatttggtagggctgggaaaagaggcatcagatagcatcttgatatggtgaaagatttgaacagacaaagatctatctggtgctagtttagttgccttgaatcatcgttacagatccctctggactatttccctttagccaatcagcaacttccccagggagaaacttgagatcttttattctagatttctggatccctaacttgttccaatgttcctttctttttaaaattatttttagttttcaatttaaaattttttcaaacatattttttaaaaatgcagaaaatcagagaaagggcagcatgtatatattcactacccagattgaacggttgttaacactttgctatgttttcatcagataacttgggaagaaargaaggaaggaaggaaggaaggaaatagtgcaaatatagttgaagttttactcagtatttcctgctctcttccctttcttccctatataatttacttaaaagtttgtatatattattcctatgtgcattttgattatttttattacatatacatgttctcataaaccacatagttattgatttttaatattataactttaaacaagcagcatcataaagtatgtatcctttttcaacttgatttttattcaacattattattacatttttaaagactcatccacattgatgtatctagctctagttcatccattttaattatacgaactagagttcgttaaatggtatagttgctctaaatgccactttactatacaaagctgattatgtttcttgcctactcataacaacccagccccaaactgcctttccagtcatcgtgaattacatgttcttggaccctttccccttggtcctcctgtctttcaaaagatgtgctacattatgtgatgaattaattgtctgtgctttgaccccagtgagtacaaacagctttgtgagcagcctctttcaggtaagagagttcatttgagatatgagattttgtttgttcaccattatctttccagcatctaggagagtgcttgattcttaataggtgtgcaatagatatttgttggacaaatgtctgcatgagtgagtagacggctgtggaattgggtttaatgctgtgattccaatgcatataataaggaatkaagttctttcctaaaatactcacatcacactctagcaaccattggcttcttgctagttgatttattctctaagaattgccacaatagattaaagagatgatgtttgtcaactctttcagatggtagaatccttgcttgcctcagagaggaccactgaatgtttgcaaagaactaccacaagccctcaccatggggaattggtgatttgaaaggcctggcagatgttacactcttttgccatctgtctcttggaagtagcttcaatttggctttcagtaggccccagcaaggtcatgaatatcagatttggtgagaaaacgccaagtgtgtagcttcagtcaaagggagacagcttttcccttatgctgctcttctcagcagcccaggcccatttgttcttcctctgtgtggaactggatgctccctcctgtagtaaatggttagagggtccagaatgaaatggaaagtggtcctgtatcatcagcagtagcttcttgtggactttgtcaccctcattcattcaacaattgtttactgaacaagtaattgacaagacattctaacaccgacaagttgtgtttaattcagaggaggagactgaacgctggtgtttccaaggcactaaataaatgctaaaacagggagaggaagcacacagggcagaggaacacttaggaggagcaccatactattctatggtgtggtggtcagcaaaagcttcctgggggaagtgaccttatctgtaaaatgaaatgggattaatacccatgttgcaagatggagccaatgtaaggtaatgtctttaagtttcctgctgcttgcttagtaatagcagtgatgaccatgtggtattgatggtgatgacagtgatagagaagaaaaaaaaatggcttcacaaccagatagtccggtttcaaatcctagctcttcttgtccttagctctgtggccttgagcaaatcacttggcttctctgtgcctcatctataaaatgcgaatagtgctaygtaccgctaccacaactgtaatgattgcagaaaatgttcacaaggaacctaacagtgcctagcacctggaaggcattcagtaagaggtgaaaatgcaacaggagcttgaagagaaggtagcagtaggagccatcagtggatatggagggaagagctctgcatgtggagtctagggacctagattctcatctgactatcactgagaagctgggtgcccttgggcatgtcatgtctggcattctctggagtctcccatcagtgcagagaggcccatccatgaatcaggtaatttttaagtgagagaaacacacaacaagcctaggattaaggatggtagagagattactgtgtgwtgctatggcatgggaagactttgtggaggagaaagccctcgggctggatgctgaaggccaagtaggtgttagactgggggagctaagtgaagagggcattccaggcaggggcatgattgagcaaaaggggccaagtcacgcattaagtatgtcagccgcttccctcatctcctcacctctggggcagccttactcgtggagaagaatggataataggaaggtcttgacttcagctcagaagtttgtttctttgatagtcaggactggttctgggaaaattgtcaagtcattgaagttagtctgtgcgaccattcatcttaatgtgagcaacccacgttttttgcctgcacattgctgccacctgggctaaacaagccccccactcccaccccactttgcaagcctacaaaatatgccctgtagagcagctcctttttgattcttatttccaccctccaaagcatacccagaagcacagtatgtcaaagcttagagggagctcggagttcattattttaagcccccttattttattatgaagggccatacccaaagataagcacttacgggcagaaaaggaacagagacagatcatcacggtctcccagttgtgttctttcttccactatgcagcctacatttctctctaccatacattttgatwacttaacctaggacatcaatacctatgtattaatcaggactcttgggattttaaacgtcaaacacctagagaaacttgtttgataagcagggaagttattggcttgtgtaactgaagagttttggtagggctgaatccargtttccagaagatgtcaggtgtttgcctctccttcacaaggcttaacttttctcagtgtggcttcattctcaggcaagctgcctacaaatagtgtccaaaaggccttaatggcaacaggcttatatcctacaaatagtgtccaaaaggccttaatggcaacaggcgtatatcctaccatcttggcatcccaagaaacatagagaaatgtctctggcataggtcctagatagggttttcattaatttggcttgagacatgtgcctactttcattgtgatggggttatagaactgtgatagtcttaaactaggtcaggtacccaccactgaaaccaagactcaaggtcagtctcacccaawccatggatgactgtggggaagaggaggttcccaagaggttaccaggtttctgtttccaaaagagagggaaatagatgttaagctagtatgtgttcactcacccacacatcaccctcacacaacccaccacaagctgataacagtttaaggtattgtattcctgatagcattagccttttgtgaaggactgtacgtgttttagttgagtataacatggaaatttggggtaccatggaaaggccagtgagggggttagagaaggtggagattttgtatttcagggttttttaggctccctcaaattatagcacaaaatatctactttgtggcatagcataaaatactttacttataaattctgtcctgatgatagccaggaactcagcctgagatgaaaaggtttccattagtgaaccacatgtagacaattgtaagttaatgctaattcattatcctcacacctgggctttccaaatttgtctacctcttttttttttcttaaccatgtattgcttatctttctcatgaacataaccaatgtcttatgagcccaagtcaagtagtgaacatcagataggaaattataattttgtgtatattctttccctcatttttgtggcctttttgtgtagttctcttgtgcctggagaaaactcagggtttgtgtgttaagaatgaagtgcttgcattccctcacccagatgcagtgcagcaatggggtacagtgggaccacattggaaggaggtaagattggtggcaggtagttaaaaggtagcattgtttactgtgggtctaatgcagtatttctggactgaatggaatggaagttttgcctaacatcttttagaaattgttttcaggtctgtttcaattcctaatgttcttttatataatttctgactcatttgcttaatggtttcatttgtgtttaaaaaagcaacatcaaaccttcattatttactttccgtgatgctttaaataccacagaattcagtaaggccatcaaagagacagagaggccaacattaaacattaatttttattactttggcaaagaattcttgagataattcagcacagaggaaccagtacaggtctctgatagctgtaccaagtgctgattaactcaacctcacaaaatctcttgcctgtcaacaattagtggaaacatacagaaatatctaaatatcccaaagatattggggagatatttggaaagtatatgaaaacatttagaaacatcagaagtttgaaaaacaaagttttccacatatatgaatgagactggggaagggagtatggtctgttttcttctcacaattttatcaccctggcagttattggtggagagaaggttctcagtaagcatatgacgtatctattactttatctttaccttgatttctccattcccatagctttaaaagtcattagaggagataaaacagggtcatttattttgtattgtcatatgtatggatttagcagcatgtgatatctttccttccttccttccttcctccctctctcctccctctctgggtattccctcctttccttcctccctttttctttccagtatttaatgactcctactctatgtcattgtctcttatgactgagagatgcataaggcttagtcttgccctcaaaaagcttacagttttttgagaggttacacacaagtaaatgggcaatttcaatatagtataataaatattatgatagaggaagtacacagtgcctttgggtcatttaaggagagcacttaaactcagggaatcaggaaagccttgtcaggggaagtgccatctaatctgagttttgaaggacaagttgagttagccagagctagttttctatggctgagtgggccagatgggaggagcctggacctgaatttaatctccctgctggggtaaggcaggtgtcggtggccacccccagcttcaggtgctcagatagagtccagtccagtagtcatagcatggtagccaaaggattttgccttgagttcataatcaagaaacgcctccaggccctggggagcaagagaggagatagtagtactggaagtctgccagaccttagaccttaggagagacacttgtatgaacatggtcaagtgaaattctagtgtctggagaccatgacacagctcagcctgcacagggcttgggacgtgagctttgtatgcacagtgcagtccaggatccagccgacagtccagttgttgcctatacccgcagtcaattgccatgttttttaggaagcctctgtcgagcgactctagaggtgtttctcccttccctcttattactaaaccttacagaagctaagcttgcttctaagatatcttttaggtttaatattcacaggattacagtgtctgcattccttagacgctcctatcatgctgtgctagtcgggcactgtgctaggcacagggaatgttgagataaaaggaasttggtttgttgtttaaactacccagattgtgcattgttaaaaattattatttttttggaactcttaaaattttgttttgcccaaaaaattacatgacactttcctcttagaaataagttagttatataatacagaaatgtaaaggccaaaacattaatattttccttctttaaattctagcttctttcaccagcgttaacaactgataaccttctcttgtgtatctttttagtccattttctatgcttgcatatccatatataattgtatcagttgagattccagtaggaaacagatggtacattcaaattagaataatttagaccgggtgtggtggcttatacctgtaattccagcactttggaaggccaaggtggaagaatcgcttgaggctaggagtttgaggctgcaatgaactagcatggtgccattacactccagtctaggtgacagagcaggaccctggtctctaaacaacaacagcaacaaaaccaaattaggataattgaggtttagtttaataaagggactatttatatgatgtagagagggtatagggaaagcacaggggatcatgwttatcaaccctaaatctgaaggggcacagagaggaagtggtcatggaaacctggacacagaaagggtgctgcagaaaggaccctctaatgggcactgagacctgtgatggagggatgcagccagttcttagcaaccacaggaaaggggctgggaataaatgcactccttcctctctgcttctaagcgcccccattgactgaaccctatgggaagccaagggaacaagaaaacctattgatgtagtccatataggtcagcccccttagccagagagctgagtggagaaaggtggagagtggatcagaggggcaaacagaaggtctccagtacaaatacatacatagcatatagttttaggagcttttactttctgtgcttccttgttacagaaatgagattgtgctgtagtacgattctgggactttttgttaacacaatttgtcttgaagcctttttgcatcagtatgtatggatctaatttaattattttattcattggctgcttagtatttcgtcatacaaggtatctgaactttttaaaattatgtatatgtaatagttggtatatacaacagaatatgtaccacctatgtgagttatgaagcctagcaataaaacagtcatctgtaaatttatctctcaacctaagatcactaataccatcgaccttagtcaatcaaactacttgacctcagatcatcaggcaatcaggcattagttagaattacctaaggagcatgcatgtgcagttcacaatagggtttgggtttctatgagaatctaatgctgccactaatctaactgacaggaggcagagctcaggcagtaatgctcacttcctgttgtgcggccatattcctaacaggccacagactggtaccagtatgctagctgggggttggggacccctgctatacagtcttcctgtgtcccctcaccccgccaatgctagtctgaagttttttgtgttaattctcttatactttttaaaaatagtttttccatattatgagtatgttgaaacaatatattatatagttactttttaaaaagctttataaaattgccgttttagttgtacatagtcttttacaatttgcttttttaacatagcattcatattgcagtgtgcagctgtgcttcatttattttcatagcttataacactccattgtgtgaatatgccgcaattcacctctccattctactgttgatggacttttgggtcatttccagtttttgctgtttcaaacagtgctgcttatgaacatttttgtccgtgtctcctggcacatacatacaagagttgctctagggtatatacctaggagtggaatttctgggtcacgaggtttacacatacttggctttgctaggtwatgccaaattgttttcaatgggattatgccaatttacattcccattagaagtatgtaagaattctggttgttccttttcctccttagtgcatggtatttgcagaaggcttaactttttaccatcaatactcttttcagggataccaagcaaaaacttaatgagagtctgactctgttatcataataaatatttttctacttttctctgtaaaaatgattttctctttcttgccctattttttttgcctcattgttccctaagtttatgtcatctactaataaattatatttaaaaataattaatacattaaaacaaatctgccaaatgggcctttcaattctttccaactctaaaataaatgtaattctagtagaaatccatatacaaatcatggttcataaaactgaaggttaacattgctrccatatggagaagttagctcacatacaaaaagagaaaaccatcagttctccaaatatttctttttaccaaatttgactttaacagcaaactggattgtgtgtactcttgaaaggaatagtgctccatcttgctctccctctctttcttcatccttccttagttttgttctttctttctttgcttcttttatgtattcattcactgattcactaaaacccagtggagaagacaaatgaattattactgtgtagcctgcaaatgggatgatgaggaatggacagatgtcttttggagtgagagaaggaaacttgacttctgtatttcttgagttcacttcagttcttaagataaagtaggttctactgagtatttgctaaatgaatgaacaaatcaatactctaaaatgttttcagctttttactcattgyagtgtaggaagagctacatggagttgaatttctatcaactagcccatcttttattactggagttagtcttctttggtaatttaatactcagagtacctcatatgatctctttatcgatgccttcaggagacattaaacgttctatcaattaattatacttaaaaagaataccttttggattcattcaagcacttcatcttctttccccaaatcttgggaactggtgtcagctccttaaaatgagccagcatgctttttcaccctcccatataagtaagagcttgtaatcacccagtgtttctctgacctagaaaagctgagaaattcacataaatgaaaacacaggggcttacaaaattgctttcggccctctcccttagaagcatatctggcacttggtaactggctggatggaatgtgggtactacatggagtgccctggtgctgctgctgctgctgctgctgctaggcttatataactttgaaatcagaaagcagattcagtggggtaggggagaactgcttttaacaagctgctgggattggctgaacttgtgctggccttgcactcttactattataaacttgatgtctttctcatttgtaaactttatttgcatgccagagctcagctgaatttgcctgggttcctagtttctttaatcttttgtcctgactggcttgcatgtaaatcagcttcagactttcagctgcccatatattgccctagtttgcactctataaagagttctttctttgtaggctcctgtccaaagcatggcagtatgtcttaaaactgtacaatatggttactattagtagtaatgagttgttattgagtgtcagtatgaggttgagtagatggagcaaccaaggcagcttagaactgagggtttcccagctaacatgctgtggaaccctggaaaatttgccaagctcctccaggtctcctattccatcctgccagaggtgatgtttttctttcctgctaggtatgtcatgaatataactgagaaccatgattctaaaacaattagaatgaaactttgtgattttatttgatgagataagcactgttttcatatctttacatacatactgcgttgttaagtcctattgtcataaccatgaattaaatgtagtcatttttatatttttaaatatagcaatgcaagaaaactgaactgatagagtgataataaggcagataagtgaaagaggaaggtgtttagccattcaagctactgctgaaatagtgaatctctttaatggtaatatatgagctggaatgtttatccttatcctttcctctagagaagattaatttatttggcaatatctaaataactgagaatggtatattcctcattcataacttagagaaacaatttggctacttttgttggcagaacctgaaatagcattgcccttccaaagactgtttaacttgatttcacaagtaaaccacaaaatgcaattatttgatattttaccatatcccattcccttctttcatccccataatgcagggggctgagtttggatttgcaaaccttactccttagcctaagcccttacaattgtttgtatgtaatgccagatgcatgttaaggaaggaatcctatagaggcaggttacttggagcgaagttttcagggtggccagctctgcccagttgccttctttggtcccagcgagatttgtagttttggtttctctgtttgaggctgggttgggtgcagggaccaagcaaatgaaaaacagacccttggggtataaaagaggtgagacataggtcaaacaacctatggctcctctagctgatacagaagatccatcaccaacaacataggtttatggctcagtcccatgacctgggtggaatatccggagcagttctggaaatataccatccattataatcatctgagtgcttgattaaaatgtatattcctttaaacacaaacaacaaaaacaaaaacatgtagattcctgggacccatgctcagattctgattcactagatctggggcgggacccaggagtctgcactgatgcagatgtcacagacaattctgatgctggtgctctaagagccacacttggaaaaattcagtttagtgcctctttgtcattcttccctttggctccttgcctttatttcaggaaataactatgaatatgactttcaatgtcacctctaggagctgcagccagacattcctatgatgtacttatagctaatctagttgagctccatttgagaggattctagatatattacttastagagatctggctttctagaaggctcccactggatccaggtaatgtccagtggcttgaacgatagaaagctggagtcagcagctggccttccagacccatacaaatcctctttctttggaaagcctctagcacttcactgtaaaataacagataatcccaggccagaattttaattagaaaagctgaatgacctgtaagtaaattattaagaatttcaatatcagctaagatcaatggaacagaacagacagccctgaggtgcatctgtagatgcgtgtacacaataattaagtttgttataaagatcctatatactattttctctgtatgtaatggtgggacctattttcatacaatccatagatacaattgaaataatacaaataatacaaatcattgataactgactaccatgggtcaggccttgttctgcacgatttctatatattctgctaatactcataataagcagcactttaagtattattactcttctccttttatagttaagaaaccaaggcacagggaagctaagtaacttgcataatgttgcacagcaagaaagtagcaggctggtcctcttggtttatttaagttaaaatgaaataatggaggaaattaggaatctgaagaaacctccattttcaaaagagtagaaaaatagatacctgaagggcatcgtggggtcataacataacaactgtgagaagtgttgtagctttttgtatgtttgtgaaatttttcaaaaatgtgtctaggtacagtagttgaagcttctaatgcatattggggttaattccaggactcttatcgtcactcagggtttgacaaagtaatagttatttgtattactaaaccttttaggctggaaggttttgtacattaatagatgttaaagatcttactgcagaaattactgtcatgattttggaagccctagtttaacccacattgatcataatatgtctctggcatggtcaagaagttcttttttcctgattcaagtactttataaagcatatttaaaggctggcttcaatctctctggagttatacagcccttctgttagtcctggtacaatccctcttgagaattttttcttttttttagtgttatcaaaaacacagtaagacgattgatattgcttagtactgaatcccggagttctgtctatgatcaaaatatcctctggcccaccagccaagattccaaaagtggtctcattatggttcatacccagttttccatcctacagccttgggttgagagctgcagcctccctccaaagtcccctccaggcagttctgggagttctgaggtgtttctagtctgttcagtccatttgttcatgaccccctgcttctgtcgtctcgttagtatatcctgatataataaaagtttgaaaatataatcaatgctagtaaggaacagagtcctatgctgtaccatttctttctgaagtgtagctttgttattaaaaacaataataaaaaaaggactggtacaaaatttcctgttctggaggtgtggagtttttcatatgtcaaccagctttaaccttttgaaggtttaatgaaatcagcaaatataatccactgtacgagagtggatatgaatcaagtctatcattgttgaacaaacggcattaatttccagtgcacatgtggatctgagttttaaaatattggtttgaaaaatgtcaagctgctcattgttttagaatatttgagcagcttgctagtatactctttttaaacagttgtacttctaaaaggttacagtgtttgcatatttattcctttcaatttaaaaaattcttccagtggcctgggtagtagggaaatacctcgaattcctttttttatggattgtacttcctagagggtattaaaaaaaactccctttcacttttagcagtagctgaagctacaggactcactttacaccccagcgctcatcatcatgtctccgggtgaagttctcttcagtgtccccagaagctgtagaattagattgcttaaagctcgtggaaaagcttatatctcctatgtccagtgtcagccccctaggaagaaaagagctctgggggaactaatgcttgttgagtgctctaaggaaccagggattggatgatgagcaggacggccatgggccctgctctcctggagatcatggttgctgttcagccagggtcagtggggcagagagcacagtcgtctcaaaagtgggtgtggggagatccatgaggatgttggaagcaaatataaaactgagggttttctcattttgaatttccattgttgcagatgtttcataatgcagatagtatattggtattttggtgcatcttttacaacaaacttaattattttgtatacacatacacagatgtgcttcagggctgtctgttgtgttccattgatcttagctgatatctttaagaaggattgacaactatattttaaaaatctaatctatctaatcaggaaattgatttaaacaaagcactccatgccatacaagatttgattgagctgttttttcttttttcccaagatgaaagagtgcctaggagcrtggttatttttgcccctatatccaatttagcacctctttcaagttaggtttgaagttggaagaattacaacatatttctataaaataatctgtttaatgatatgatgtttcatttcttactaaaacaaaacccttcccattaacttgttcgcttgtccccattttatcatatatgcctagggagaagtctccattaactggtttcttcctgctcctaaactgtatcctctttcttaagcaagttctccacactattagtttgctttcaggttcccctgtgtttgctctctgttcaaaactggtgatgctgtgaattgtagtcagctcaagtgacttccaggtgacttgccttcagcagtggctgctcatttcatgcactgcagaatccctgggtcatgctgacctgttgatgataccagcatcacagactgcacatatcaggcctgctttctatgatgctggttttccaattaactttgtgaaaaggtatatccctgcttatgtcttcctggttatccagctcctcttgcatttgatttcatcttcagcactcgtctgtttgccagttttccatagtagaaagatagattttttttcaaaaacgactcttcccttttagttccattccataggacttctaaaacagatacttgcattgctttcatttccaaaacaaaattatttgataattacaaaaataattctagaaaataattgtcatgttagtttgctatattgaatattttttgggacttctagatttaatgtatcacatttcactaattgaaagaaaattattatcagcaagataaatctgtttgggagtgtttacttatttctttaattttctatttttttattatactttaagttttagggtacatgtgcacattgtgcaggttagttacatatgtatacatgtgccatgctggtgcgctgcacccactaactctagttatatctcccaatgctatccctccccctccccccaccccacaacagtccccataattttctaaattaacatgcccctccataattctgaaatccaaattaaactagtatttctggtacctcaagattccctaaatggagcttcctgggtcagtacgccacttaatctaacttgtgaagaaagacttcagcactcaaactcattctgaccctgtggactttgcttcagctgctccctttggctgtagttctctttctcagagcttcatgtggccagctcttatcactcaagtctcaactcaaaccttactttcttggaaagaccgttttctggccgctgaggtctctgccactatctgtcatagaatttgattttattttttcacatcatgtgtcagtcyctggaattatttttgttaacttgtacatctactgtcctccaattagaatgtaagttgagaagaacagagccattgtctgtcaagttcattgctgtatccccagtacatagtatggtggccagcacacagtggtttgataaattcttggtgaatgcatggatataacatttgagaaatgctgcataaaatatcattcaatgggtttctctagagtgagatatattggtacagcattttccaaatatatttgactaagaacatgtatatatgccatgtgccacataatgcagttttgatcaatgactggccacatgtatgaaagtggtctcacaaaattataatggagtaggctatatcatctaggtttgttatgtacaccctatggtgcttgcacaacaaagaaattgcctaaatgacacatttttcaaatgtatccccattgtctcctactattggtctgtatgactgtcattatgtcagtaccatattgttttgattactgtagctttgtaatacatgttgaaatcaggaagtgtgatgtttccagctttgttgttttttcttataattgatttggctatttgtggccttttgtggttccatataaattttagaattgtgttttctatgcctgtaaaaaaacaaacaaacaaacaaacaaacaaaaaactgctattgggattttgatagggattgtagccaagcagcttggcttcaaaaatgcattttaaaactttttttctcctttctcttttctccttaatctcaagatgtaaccttgaagctaactgcagaagcatttccccttaaccttaaaataagacttcatgtccctctctttcccatcattatctaactgtatgctagtatctaattatgtgcttacttaaagttctgggacttaatcttgagacaggcagaccaaacccggaaaccctgcttcaaaatttcagataacctcaaggtagctagtcaacaacttggccattgttgagatgatgccagcccatgctccaggtggaccaagacccaatatagcaaccaaaacaagacacgcagatctagtacttagcgcgactcctgcttgccttccatatcaagtctcccctttttaaatacttagcttcttcctagaaattcaaagtggttactttggatagggaatctggccacttccccattactagttttggttaataaagtcactttctttctaccagatctctctcttgttaattggactctgtaagcagtgagtggccagacctgtgttcagttacaagatgacattgaatctttaggttgctttggatagtatgaacattttaacagtattaatttttccaatttgtgaactgcagcctgtaagttttgatatattgtgttttcatttgtttatattgaggtatttctaatttcctttttgatttcattttgacacaatggttgtttaaaagtgtgttctttaatttccatgtatctatagatttttcagtttttcttttgctattgatttctgtgtcattccattgtggtcagaaaaaatacttggtatgatttctaccttcttaagttggttaggactttttttgtaacctagcatgttacctaccttggagaaaaatttgggggcacttaagaaaaatgtgtattctgccactgctgggtgaaatgctccgtatgtatctgttaggtctgtttgatctayaatattattcatgtcctctgtttccttacttatcttccgtattgatgtcctcttcattattgaaagtgtggtatcgaagtttcctactattactgtattgctatctatttcttccttcagttctgttaatgtttgctttacatatctaggtgctctgatgttggatgcatatatatttataattcttatatcttcctgatggattgacctttttaatcattgtatatgtccttctttgtctcttgtgatagtttttgacttagagtatgttttgtctaaggatagccacccatgcattcttttggttaccatttgcttagaatacctttttctagcccttcactttcacccygtatgtctcactaagtctaaagtgagtttcctgtggagtgcatgtagttgggtattttgtttgttttccattcagctactctatgtctttggattgggaattaattcattaaaattcagtgtaataattgggaaggggaggatttaatattgcggtttcattagttgttttcttttagtcctatagtccttttgtcagtcttttcctttcttactgtcctcgtttatgttttcttgattttttttttttgtattcatatgctttaattcttgttgacatttttagtattataccttttcatgggttttggaattttcgtttgctgactcattttgagtgggatgtttttacattcactttttattacattttttccctttctctgggcttactcttgttttccttgaggttttgtgatcacttttatctggtctgaaagacttccagtccagacccaggttttattatgttctatcagccacccttgccaatggtgatattggggatatcacatactctgttatcaagcgagcaggtggtttgattctgtgcctgggtctgaatcacatctttgtcaacttttccctcacaggcttaaatttttataaaactgcttctcttagtgtgtcgtgttttttgttgttgtagttgtagttttgtttttagcttcttcttmttagcccaacctccttgtttggctttacagttaacctggcttaggtctccttatctccagtgagccaattttagattctcttatcctgtaggagcagaatgcccagcagtcagtgctggcttctaaatctggagccttgcaggttccctgacttcagacttactcactgcttgtgattctaatgcgtttctagtccacagagatgtttatctggttcttggaracaaactataaacatttttatgtttactttttatgtttcatctttaattatcacgtttggaataggaggagttttataatggtgtgaatttgctgaatcatgttgaccagaagtctcaccattacttctgaagcattttaaagcatatttctgtcctaatttcttgtccatagctctgtatgattctgacctttgaagactataataaaggttcatcattttttaatgtacttattgtttatactcatcactgagagaaaataagttacattacacagtagtcgagaataaacttctttaatgggtttatgtgactaaaattgtaaaggtcaggggaattaatgggaaatttgttttaattatgcattgatcacaaaacataatattgttttctttaaggaactgaacttgctggattctgaatcatattttattactaaacagaaacaaataaactcagattgatttattgaccctgctgtatgccaggccttgtgaggaatacatgggaaggaaataaaaaggtctctgtcattagaaaggctggtgtttctcagctgaaggctgaggttggagggtctcctcctcccctctccccagtagaaatctgtgagaatctgaaataggaggctttttaattttcaaactatgcaccctatctccatttcccagccccctaccaccaggggagtgtgtctgttgcccctcaactgcttcagaactactatcagagccacttttaccaagaacatacaccatagcaattggacattatgaaaacaataaaatatgtaattaaattctaaaatgaattaggatgctagatggattgagcatacactggatactaggcaatgcattaggaccttccttacaattgctgttacatcaactctgtggacagatgttaacatccatttttagatacacaaaagagggagcgcagagagctcaagcagcttgctgaggttcctagtaagtggcagaggtggacttcaaatcccggcctgcttgcctctgaaacccagatcttaattactgtgttgtaataagagggagaaagacaaggttaaaatatgtcctactgtattgtggtttactgaaggaatttatggagattaaaattcataaattgttatagagttaaaacagatgaaataatgcttctttgacagaccatttagttttttctttcatctttaaacaaygctgcactaaaatttgtctgtaatggcataaaaaaaaccctgatatttgccttttcttctccattccccatgcttgtcaatcgttacagagattatgctcaaatgtgatatcaggaaatacttttagtccccagcttaagcttctcatttctatgtgaaatatggcagacttttgatgctttctctaaggtcccgttctggatattctccctgtgttcaaggcccttttagggagagagccagtctatggccagtcttgccaactctgtaaatgcaatttacattcttaaaattcgctatcaccaggtcaaaactagcccctggtgcattttgggaagcttcagttcaaacacctgaattcattttcaccaatgctacctggttaccttgtaactccagagttttttagagaggttttgtatatgattgcttgagctatagctttttccctttttgyaagctattattgaaataaaaacgtaacttacctatttcacggtgtatggatgtttttaagtggaataagttcatgctgttttaacttaggttcaccaaacaacatttttagaatattttcacctttctaaataatgtgcttttgattgatactccctctaattcaaactggcagtgcatagtaccctaaaccagtgcccgcataagcagtctgtataaaacatgcttatgcttttcagcttcccaagtgaatctttcctagagagaattgtttttttttttgaatgtttgaggtcatcttacaataattatgcataatcagtaatggaaacaatttaaagagtttacactatgtgcccggaatatgatcatgataaacaagtcatctcatttatttcttacaacacactttttaagggtaggttcgtattatcattcccactttacagagagagaaacaaaggttagagagattaagtaacttgctcatgtcaaggtggtagtgagaaattattgaaagcacccattatgccatgtgagtaagcaaaaactggcagattaatttttagcatactcaaataaaaggtcatgcattagaaaaaaagcagtcaaaagtagcttctgccccatctttagtgaagcatacagagggatatgattgaaatagtcctcagctctgggtcaaactctctggcttctattttcaggccctgccacttgggcaaacattccttctctgtggaaaagtagaatgttggcyacaatctcctaaagtcattctagctttgatagggtgtgattgtaggagcctgcaaaggaatctagaatcattgtaggtttcctaatgtctgtagctctatgcaattaaaaagattgagtaaatcttgggagctgtcaagaaggttcttacagtttatatataacatacaaaaaaatgtataggatatatcatagttttgcttgctacatctccaaaatctagtggaattcaagaaagtttcagaaggaaccaccaaaatggcatgatgagactattataaggggtatagcaatctttagcctgcaaatagagaaaaaagtcttatttagaaatgtctacaaaattatgattgttatgtatttcatacttaagaaagtaattttagttgagataaaatgaagtactgttttacacagtggatgataattttgtggaactttccatctgtagaatcaaaacataaaaaataaatgtgaaaacaggcaaatgtagaaataacagtccatcatggattatcaaaggacactataaagtatggagttctcccctaaaagctggtattgatagggatcttagttattatgccttcctactgtatgtgccagggttccaatggaagttgtcaatacagcatagctccaattcaggaaggcaaattttaagtcataaaaggttctgtttaggatggcagatttccttaatcattaattttattagtagtataatataatgttaaatttttgttttggttccagttgaagagcagcatgatgataggaatttgcactagaaaacaatactaatatcacaggaaaacattaagagtttcttctctctgaatagtggtcataataagcccatccttccttttcatagaggttgatggtgtctttggagatgatctatctcacggcctcctcagggcaggtgtccattgtttacctggcaggtgttccttgcacctctgcttgaacactgcccatatttggcagcttatcctctggggagtactgttcccttgtgggactgctcaggtttattctttactgagctcaaatctatgtgcatatgctctttctcactggcctgattattccttcagggcaagtctactcttcttgcagatgaagcatctagccccttacagtcttctcttctccagtgtaatatattctgctgctcttcaagcagtgcatttctagacactggaaaatcctgwcagttcttttctgaccacygtctcttttccaaactctttcctcaggtgtcctggacggaaacaaaagggagtaaaaaagtgttggatttatttagaataaaaagggagtattacttcacataatcaacagcattattttatttttatcaatgaaccttaaaatctttaaaaacattttcccatgactgagatactgttagctcaatatgcttgtggccaccacctgagtttcctgattgttgccagacagaccgctatcaactcaccctctcaaagtgcagtgtgtgcttcagatttatccccactgaattatcttgtcagttttaagctattatttgtgcttcaggatattttacaatcttgattatttggtccaacatattaatgattcatcttatatttttatcatcttaaaattcataagaatatctccaaggtattgatggaaatgttaaacaagattgtatcaagggccgagttaagttaagcaatgctaacattcaaaacttaatgagaaatataatttagtaagaatggtactttgatgcttgtatttcctttaatcttgctctaatttatagcctattaaaatatactgtttatgctaataaatacaaattaaattttaaaatacatgtttttgtttgtattgttttttcaaaaaatgcacaattgagaaaaaaagtccacttttctttctttttttttaaggttttccacaggttgtgattattcaacacatggctacaatcgactratgagatttaactgatttaatgtatgataatataatctaatgacaagtcaaaataattagggggacagggacaacctcatgagtgttgactttaaaaatctaaatccacaacatgacaataatgtcacagtgtccattgatgaagaaagtgaacagtctttttttaatgatgttcttttattttagttgattgcatttagagagaggacaactaaactattcattctcctttgtggtatctattaagttttaaaaattaccttgtctttctgttattttttttatttatttattatactttaagttttagggtacatgtgcacaacatgcaggtttgtcacatatgtatacctgtgccatgttggtgtgctgcacccattaactcgtcatttaacattaggtatatctcctaatgctatccctccccactcccccaaccccacaacaggccccggtgtgtgatgttccccttcctgtgtccaagtgttctcattgttcaattcccacctatgagtgagaacatgcggtgtttggtttttttgtccttgtgatagtttgctgagaatgatggtttccagcttcatccatgtccctacaaaggacatgaactcatcattttttatggctgcatagtattccatgatgtatatgtgccacattttcttaatccagtctatcattgttggacatttgggttggttccaagtctttgatattgtgaatagtgccacaataaacatacatctacatgtgtctttatagcagcatgatttataatcttttgggtatatactcagtaatgggatggctgggtcaaatggtatttctggttctagatccctgaggaatcgccacactgtcttccacaatggttgaactagtttacagtcccaccaacagtgtaaaagtgttcctctttctccacatcctctccagaacctgttgtttcctgactttttaatgatcaccattctaactggtgtgagatggtatctcattgtggttttgatttgcatttctctgatggccagtgatgatgagcattttttcatctgtcttttggctgcataaatgtcttcctttgagaagtgtctgttcatatccttctaccacttgtatggccatactgcccaaggtaatttacagattcaatgccatccccatcaagctaccaatgactttcttcacagaattggaaaaaactactttaaagttcatatagaaccaaaaaagagcctgcattgccaagtcaatcctaagccaaaagaacaaagctggaggcatcacgctacctgacttcaaactatactacaaggctacagtaaccaaaacagcatggtactggtaccaaaacagagaaatagaccaatggaacagaacagagccctcagaaacaatgccacatatctacagctatctggtctttgacaaacctgacaaaaacaagacatggggaaaggattccctatttaatgaatggtgctgggaaaactggctagccatgtgcagaaagctgaaactggatcccttccttacaccttatacaaaaattaattcaagatggatgaaagacttaaatgttagacccaaaaccataaaaaccctaggagaaaacctaggcaatactgttcaggacataggcatgggcaaggacttcatgtctaaaacaccaaaagcaatggcaacaaaagccaaaatcgacaaatgggatctaattaaactaaagagcttctgcacagcaaaagaaactaccatcagagtgaacaggcaacctacagaatgggagaaaatttttgcaatctacttatctgacaaagggctaatatccagaatctacaatgaattctgttatgtttttaaaataattattccttatggactttcagtctaagctaatttttatttgttctctccagcaggtctatctttataacattcaagctccccctactccttatccttggagttcacttttatggggacaaaagatgagttttctgtgctttggaaagcatgattatgcttcatgttagctttggaattagaagaaatcattttcggaccattttttttgagttgtgatacacaaacattataaggttaatcagcattttggcttattagtggcccttgattcttaggaaactaagataattctctttttcctgcagatgtgacatttgactatgaatattgaagttaaacttcaattcattgtattgtaaatggaaaagaagagtttttcattttaggtatatrtacataatacatatattcttttccttggctctcatcatgtttatattagatacaaaactagttaacatgtctagtctggcatttttcctccaagatatataaattctaataaaaaataagacaagattggggaatggggataatagtattcttttaaacaaggatgcaagaaaatgaaatgtttaatttttgcaacatctcctttctaaaacaaaatatactgatggaaatttggcttgtttcctagagtctcaacacaggagttattaactgcgatgaccgggctaatactatgtgaggtggagtatgataaaaggattaaaagctagaggtactgtgcttggatagcaagctggatgcttgtgcaggcatggagcctttcaaagtaaagttggctccttgacactctgtcctgcagcttgcgctgatttttaagatcattgaaaatcaggtcattgagaagtcttcttttagggatgtctgtaacattctttgactgtcttatgtttaagctagaatttaagcatccaaataaaagttgttctcaggtgtcatcatcataggaagccattcagctaccctaaagttcactaaaaagtcctggaacttgaggtgattgacttctgactccccattgtcagtgtggtccagggacatggcaggcaggagccaactgcttaaggtagaaatgctttgagtaactttcatttaaactgcacagactatcatggctgggtatttttcaaagctacatagggttctggaattttagaaaccattaggggccaagaagaatctktcagcttatagatctaaatgttcaaaatttaagttaaagcctgtttcttttggtaggaagcaccttgactcccattttttataatgaaagattgatgatatctctattagcctgtttaaactgagccataaaagagtctgtaggaggccaggtacagtggctcatgcctttaatctcagcactttgggaggctgaggcaggcagatcacttgaagtcaggagttccagaccaggccaacatggtgaaaaccggtatctactgagagtacaaaaattagccaggcctggtggcacgtgcctgtaatcccagctactcaggaggatgaggcatgagaatcacttgaacctgggagacagaggttgctgtgagccaagatcacacctctgcactccggcctgggtgactgagtgaaactgtgtctcaaaaaaacaaaaaaaaaaaagtctgtagggtaccaaatgcttttttttttttggagacaggatctggctctgtggtacatactggagtgtagtggtgtgttcatggctcactgtagccacagtcttctggactcaagtatcctcctacctcagtccaccttcccctctccagtagctgggactatagacgtgcaccactacacccggctattttttttttttcaatagagatgagttctcactacattgtacaggctggtcttgaactcctggcctcaattgatcctccctccttgacttcccaaagtgctcagattacatgtgtgagccaccatgctcggccttcttcttttctaaaatcccacccacttagcatgacaaaggcctgggacataatggtaagtgaatagttgtaaggaatgagaagttttagctgtgcactgtaccatgcttggatttgattatgggaaagatgatcaatattaacatagaagttacctaaactctctgtgtcttttcccttacctcaggaagttcaaatacaatgttgtaattcagctcttctactcttcctgtcctctcaaatgagacaacttatactgtggttgctgaggctaaatagaggaggaattcaaatacatggttcttctacttaagagaagatcatctccagttgcatcaaatcatgacttctggatgcaacccagttgcctccatttcatgagaatggtttccttccatagacattctctgctgttcccctatcattgtcaaatcaatgtttaatcaattccagccatttcttgcaaatccactgcaatcacattttataaatctacctagtgcttggttttcatgcgccgcagataaattaggtccttcttgttttatcctgagctatcagtctagtaacatgctcacagcatgcaaccaggaataggcatgatctcctttttgtgagtctaatctgagtgtcctttacaagtaagaggggatagtctgagagtggaaacagctcttttcaggaccagctgggtgatccatgagcatttgaacagatggcccatttttgtgggaaaggattctgtatcctacaagctaacacccaacagcttcactgaaaaaaaaaaaaaaaaagcttgaagataagaaatcaattcaagaggaacccacatgtttgctgtgttgcctctgaacacaccctgtatgtcaagagcttagctttattctgtagaccacctagtcagaatcattggggaggaaaatatttgttcaaacatagtcccttttgtctgtgctgggcaatagcacaatacattcagcaaccaccctctgaaagccaaggctttgtctccagtggggattatgaaaacatggatttcttgagaagtgcctgcccacctgtgtttagattttaaattttaggaagatgcttgacagccagaaaagaggtgctcagggaaaagtctgttgagattatagagactttttgaaagaccattacctcctttaaaatgattagaatagaagaggaattcttgaaaactggcatggaatatcgtattagatggaaccttggaaggttttatttatcccttctcttttagctttctgtctaaggcctcagawtgtagtctattttagaaaatctccaaggcaggaaatttttcataacctttcccctgttagtcattttttttaacttcaacaaaagcctgcatcagaagcttcttgctcgcttatatgaccctaacgctcactgctgcagtccaagcctggcttcctttgcactttcttttgctgttcatattcttcacagtgggacctgtcttagctgaagcccattattaggtcactccttggcctcttctctaaggctaaataatgagttatttttttttctccttttttggtacatcatattttttcaaccatttaatgatttttgttgttgaaaatttggggatttcctgtgtctggaaatgcattaggcctcaaactttgtacccctaagacttttcctgctaccttttaaaagacaccaagtaaaattaagactaggagaagacagctgctgcaatttttaaaaaatcacaaaagcaaaaaaaaaaaaaaaaaaaccaaaaacaccgagtagctgtctttctggtttttgattgagcaagatatttgtaaaatgaagcatactttattgtcagatgggcctgttgtttactgacaattgaccaacatgaatgtggtcaggtttagatgaatatctatacaactcacataatttttaatgaagggagttaaaagctaagcatgccaagaaaataagtatgactcaaaagtggccctttcttagtatattggatgtattatggcttctagttaccaagggcctttgaagatgactgggccattattttaatactttttaatatgcttctggattcaattattgcagatttttacaattatatttgatctctagttagtttataaggaggacactatctttgtcaggttttaatatcaagattgtgatagctttgtaagtaaatgtagatattttctatactttttctttgctttagaacagttgaaatagaacaagatcaatctgacatctaatgtttggttgaactcacttgtaaaactgtctgagccccttgacttccaaaggtaggtttttgataattcttgctatagtttaacatatcacacatatggaagactttatttatctatgttcaatctagagaatagtaatggaaggattacacatgttctcaccactgagttgcagaaacagaacactatcagtgtctttgaaggtcactgtgttcccgtacctgatcacctcctcctctctgccctaacccccatttgacataaacacaatgctaactttggtataccattgctttgcttttcttcatagttataccatctttgtatatattattactgaagattatattatttagtttagttgaaatttatattatagaatcataatcttctacttcttttgtcttttttgggtttttgttttttgttgcctatttttgttttgagattcatttatatttaataatgcatcactaggtcattttcagttcactttactactttgtaatagtccattgtatgactattccacaatgtatcgattctactgatgatggacatttgtgtgttttcagtttgagaacttctgaatgtgtctgtatgaccgttttggtccatgtctcctggtattagaattcctctaatgtttacaccaagagtggaattgttggattgtggaatgcccatatgttcaactttataaggatatgtccaattgttttcccttaattattttaacaattttctgcttctaccaggagtggataagaattcctattgctcagcctccttgccaagatctcatttgtgtgattttaaattttttgccagatagttgtaaagtggtatcttattaaggatttaatttacatttacatttccctgattggtaatgaaattggtcaccttttcaaatgcttgctgtcattcataatttcttttctgtgaaatgcctctttatgtgttttgcctatttgctttttgggttgcttggcttttttattgatttgtaagaattctttacccattttgaatataaatcattttgagttatatatattgtaaatgtcttcttctaatttctagcaactcctctcattctatgatttctcttgatgaacataaagccttcattttatgatagttaaatttatacatctactattcatgctttgaatttttattctatttttaaaatctccacactgaagatataaagatatttttctctgttgcacttaaaactatcattatattgtgtttatttattttccatcttcccaccagaatctaaattcaattaaggctagaatatttgcttgttttactcatttcggtatctctagcacatagtgggaactcaataaaaattgttgaaggaaaccatgactgaatgccagagagggtgaaatgttcttcagtatcttgcattagctcattttcctaagaatgcacatcctctgaggctatttcctctccctagtcctgccatatttttcatatgtctcattttcatctcataatcaggtggatccatttggactcagtgtcttcatatgcaccagtaacagaggggcttgtcctcaggctgctgtctgcacatctttgatttcgtccatctccactctcagacctacagctggcctgcaggtggatgtatgccgttgtcattctggttccttctcctagcaggctttcatccagtgcatttctgttcgactgcggtgtattcttcccctattcccaaggccctcattcccaaggtagtcagggctaatttagtctgcctcgcaaataacaaaccctacatttcaaagaactagagttcccattctgcctttctagttgttttgttacagctgctactgctgttgttgttttcagagtaactttttactctatactgcatttggaaaagatgatggtgaaaaggaagttgggggaaaggaattggtcagtgccttgagtgcctcaggatgcagaacacaaggggtagatgggcaggtgcccacttctctgttgattctaggccatgcttttgctcaaaggaatccagatctggcaacagaggcagtgaagggactgtgcattttcctagcatttatcaggtgatatttttcatgaaactgcagtttactgcatttctgggtagtctgtttttgtttgtttgtctaactcagatccaagtttattataactaatgttcttttatgcctgaccctgacataagggagattttcagtagccttgtgcattggtatatttttctgggttatcttttgtgaggtaacattaaggaatgctagccacattccattttgagtgaaacctcctgcactgctattttctaagtgtatgcagaagctcatatatttggaaaattcaagttcattcaaattgctactgaattagaagtatctttttgtcattacctagttttaaatcaatagatattaaaattactactactatttcattgttgccccagtttttttttctgatttaaaaaaatatactaaaacaagctctcataatccagagaatatgtaatcattcttctatagcactataccaaagaccttatcctatgggatatcgcttagtttcctatcattcaaaaaccatctttccaattttttaactaccagtttaagtaacagtaagtagattacagaatggagaaaacataaagaagtatgatcgtaaacaacttcaatttttctgaaagaaatctgaaggataaaataatagcttccttgacttagttgttcctatatattatctgagaaaaagtttattgaagcacatttttacacttttaatccactggaacgtcactgagaaaatgttctgagagtcataagaatgttgactaattgggctgtttgtcccacatgggattacaccactactttctgaatcagaagttcctgctattgcaacatgaattattctttattttttatttttccctcttagaaacaatccatttgggttcattacatagccatttgttagtttgggggattgtgcttgtttgtaactacaatgaagtcatactagactgggtccgtatgtaagtcagtgggagatcgtgcagctgctcagtgaatcattcagtgcaaagggtcaccctaatattttaaccccaaagtcctgctttcccaaagtcatgggtaatttttattttaatcatcaagaagattggttcaactttggtttacttagtacatgttgcacatacatatcaatctgtaaaacttctaaaaaaattatattgaagtataatattctcagagaaagtgcacgaatcctaagtgtatatggtgaacttttacaaactgagtacacctgtgtaactgcyacccagatcagaaaacagaacatgaccagcaccccaaaaggtttcctctaccccctttttgtcacaaaccctcctcaccaagagtaatcactctcctgttttgcgtgtttttatactttatataaatggatttatacatcatgtgttattttgtatctggcttctttcattcttcattatgtttatgagactcatacaattttatcatgaattgtgttttttcattttccatttctatattattgctatggagtgtcctattgataaatacaacacagtttattcattctattgtcagcagacatttcatgagttttctttctttttttttttttagaagggttaggcctattatgaatactctgttatgaacattccagtacatcttttttggttaaagtatacacacacacacacacacacacacacacacacacacacacacatcctgttggatatataacgaggagtagcattgctgggtcatagttttgtgtatgttcagatttaatagataagccagtttttccaggtggttgaatgtacttacactagcaatgtacaagagttccagttgctctacctcctcaccaatatttggcatattttgtctttttcattttagccatctggttcaatatgtattgaatgtggtttaatttatatttccctaatgataatgaagctgagtatcgtttttatgattattagtaatttgcatatctttctttgtgaattgtctgttcatatacatatatatatatgctgaatattttctgtttttcygtgggttaccttttcactctcttagtggggtcttttgatgactagctttcctagtttaaaaaaaaacactctcacatattaaagatcttagtaaatatttagaaaattgttaaccaatgtgtgaggatctcagtagtgacatgtttaactcaaaatgtaatttattatttttttcttttatggcttataatttttgtgtccagtttaagatatctttgcctactccaaattggtgaagttattctatgccttcctctaaaatctgtgtttagatatgtaattcatctgactacatatttgtatgttttataatgatcaagatacattttttttcaaaccaatattctatataccccagcatcactttacttggtttataacttgtttgaaatgtgtccacaaaatttagtttcagtgaatttttaaatattttcttataattactaatatttcctaagaagaattttaaacctgtgatgatttcaaatgtgtaatataatttctagatttatttaatactaatgtcagttgaaatttcccttaaaagttctcctgttcaattggatctagttttgaaatccagctatttatttattcaacatcaatctataatgcataaaacaattttttaaataaattattgttctcattttctcatttaaatcaattcaacacatgtttattacgtttcttctagaatttgggacagttacgaatgtggttgaagtttcaagcttcatttttatatcctttaggttttaagccatataataaatttatcaaatatctgtcagtaataagccaatttcttttcttttttttttttttttttgagatggagtcttgctctgccaccccggagtgcagtggcgcaatctcagctcactgcaagctccacctcccgagttcacaccattctcctgcctcagcctcccaagtagctgggactacaggcgcctgccaccacacccagctaattttttgtatttttagtagagacagggtttcaccgtgttaaccaggatggtcttgatctcctgacctcgtgatccacccgcctcggcctcccaaagtgctgggattagaggcgtgagccaccgcacccggccaagccaatttctttagtagtcaaaattatattaataaagaaaggtacaaagtgaggatttttattactattaggatagacttagaccccttatacaattcctcaataccaagttttccactaataatgacacatatctttaaagacataaaaataggaaagaaaatataaaagtttcatttttatattttgaatacctataaatgtttactctttgatgtcatttttgcttagttttattttttaactttttattatttgttctaggttgtactggtcagtggacatctggacagctgggatgttgggcagggtgccatggatgatggcggtggagcctttatatcatgggaagcactctcacttattaaagatcttggtaaatatttagaaaattgttaactaatgtrtgaggatctcagtgacatgtttaactcaaaacacaaaatacttaacagattagttactayggtatgttcaaagatcctcttgaggtcagttgattcccagaaaagaaacaacttatgctcttaaagaaatttttattcatgtgtacgccagacatctaaagtgtcaaatgttattatcagccactggggaaaatgaacaagcaaayaaaactgaagcaaatgtaaccacaccagctaaagaatatgcaaggaaaatatgatgaaatgcaaagaaaaatcagcagcacctcctacttcctttcccttattcatcttaacacattatcagactattaggacaatggataaaggctggtcgtctttccatcatagaaataaaagagtaacctagatagaaagaatgatttccatagccacaataaggaatccaggcagataattctttgttgcaaggtctgtcccatgcatgataggatgttttgcagcatccctgacctcttcccactagaagccagtagcaccctcccctaacctcaagttatgataacaaaaatgtctccagacattgccagatgtcccctggggggccagggaagcagttgccccattttgagaaccactaatataaactaataaaaatatctaggtaacctgaatacagggtcattttgttaaagaaaacaaactaattggaaatcttacattgtatatacacttttaccataattaccatacatgacagaaaatattttgaccacctactttgctttttataaagcactttgtaaaagctgggcatataggtttaaaggatgtcccctgttcttaagactcttagaatggagtgggtaaccttcacacatacatacacacatagttatcaatatagacataatttcaacatctaattttagaattggggaaggtttgagagagaagttatccagcaaataaaactgaaaatcacacattccttcacagaaaatctgggagacgctatgttaattctctcctcctcttctcttaaaaatattcccttggctatctcttctttctgtttctcatatcattccagaaagaagtgggttctagaggaaagcaggaaaaagtcgaacatttttcctcttcaaaaatcaccgataatgattttggacattaattttatttcagtatgttcaatcagcttgattggaagcacagtggtggagtaaaaagagaaattttctttagacccatttgaattggactttaggtcactttactatattttggtccttaagcaagtcatttgaatgctctggacttcatttttctcatctctattaaactgtaagcttcagagtatttcatttgctctagattggaataaaaattgtatcttctttaagctttgaatcttacttcttcggtattcagcatgggaccctaaatcactgttaattgaattgaattcagttgcatggacaaatgttaaataccatgcaaaagtgaattgagtatcttttaccagttctcaaagtacatcgacttcagttgcttttgatagctagtgaccagtctctttaatttgggacttaaatctccaaaagatttctgaaagtctatgtaaagatatgaatagaactctaaaataaagagtaatatttcttttgagtaggcattatgaggcaccatagtatactgttaaaaacataggattctggagccagactgccagggttcaaatctcagctctgcagtctgctaggtgtgtggccttaggcaagttactttgcctctctgtgcctcaattttctcatctgtgaaatgggataataatagttcctatctcataaagttgctttgaaaattaaataagcagagtatacttagaacatgggctggcccaacccaagttatcaataaatgttaacttttataacttaacttaataagcatgattctgacagtaccatttttttaatataagagaagatgataatttagtttacctccatccccattagtgattgctttgcctcctaacttttagtatattagctatactaatgtaactttagggccagttgctatgtatccctaaaatatcctttccctttactacttaagtcaccatcccttgtatgatagaaacccagtgacccctccactttttttcatttcacactaaatttttagaagtcttaaatttctcctggttacttctatatcctgcttatgtttaatgcccagtatctactctgcacctcactttccatgattgcacccattgagtcttactctttaattttgaaattgtggatttctatttgtagattgcctatgtattttaacatgaagagctaggttcagcatgtgatgtgtatgaattctggatgaaaattgctgatatacttgaactagaaatatgcccttgggcttgaggccaagaaataggttcataattatattacttaattacatggaatccaatctgtttaattggtaaaatgtgaaagctctgtggcaatctctttttccaagaaaaatgagactccttttggatgctattccttggatgatgtgtcatgcagcatgtcagagtccctcagtggagcgtgttaacttgaagagctggtccagtggggatctctgatatttggaaatatttttctaagattcatccttctggtatcttcttctttgtcttcccctctyaccactcttatagattcacttttttgctcaagccttcagcttaaattatattcaattaatctaacagaagagttatttgtgctttgtaaatataatcagtctttccygagtaactgtctacagaaggctgtttgctgtgaagcgtcgttgaatacttttctgtgtctgtggtttactggacttgaaactgtttatttgaaatgttattttctggaatgttctggtgtcagtggacaaagcctatggccaatgatgctccaaaatgctcatttggcacttagaaaataaactaccatccatcccaaattcttccaactgtatcattttctatgaagttagaattttgagtttccaggtctaaagaaatgaaagatatgagaattaacagtattacctggttgttggaatgtggaatatataagaaacatttttccagaaaaaatgtaaatgttgagcctcctgactgtgattactatagagcttgaaagtctatgtcttagaaaaatattttattggtatgtttcttcattcattcactcaacaaatacttgtgcattgactgctggttcatgtatcagatgccttgcactaaagaggaaagagaaatggccctttaagtccttgaagtaggagagacatttaattcaaaaattgcaatgaaattgtggtaagttctctgaatgtaggatgtacaaattactttgggcacctggtaaagaaacagaccaacatgscttggctgggtcagagcaacttcactaagatgttatttgaactttctttcataaagataaatagaaattcctgagatgaacagtgcagaatgaagtattcccagcagagtacagagcttccagttctgtgtgtcattaaaaatgagaagaaaattgttgacagtagcagtcttgggattatagggggagacaggagttgtggaattacaggagaggttcactttttacctgatatatttgtataatgttagatttttgtgtaataagtatgtgttacttcagtaatcaagaaaaagctatcaaatactcctctacccctactcccaaaaaagaaattaaaaagaaaagaaagagttttggtattgtcattatcataaacaccctgttaacagaaacaacacagcagaggtaaggagttggaagagttgtccaggagtcaccaagcctccctggcccagaatacaaccatgaagacagccaaaggcatgccagggctttgatgcaagttccactgtagctagagccttatgcagccatttccaatgcagtgggttctctcttagaaatggggacccatctgggaagaaggttttcttccctaaggctctggtcaagactgtcttggaaaagccccaggaaatgtaattcagagtaacagagaagaaaatgaacagcctccagtgaaatggaagcctaaagggtagagctagagatggctggtgtcctgaaacgaatctgggactagcccagacctacaaaagatatctcctttggaaaggacctccccactgggtttagccataccgctgggtataataaaaatattgagagctagcattgactgaagattactattgtaagcattgtgctaagcactccactgagtacatattctcctttattcctgaaaataaacccaagcagtaggtaactcgtgttatattcattttacagaagaggaaaccaaagcagagaaaagctaagtaccttgcccaagatcaccagctattatgtgaaaaatttaaatctaggcagcctgacgccatgcccaacactcttttttttttttttttgagacggagtctcgctctgtcgcccaggctggagtgcagtggtgcgmtctcggctcactgcaagctccgcctcccgggttcacgccattctcctgcctcagcctcacgagtagctgggactacaggcgcccgctaccacgcccggctaattttttgtatttttagtagagacggggtttcaccgtgttagccaggatggtctctatctcctgacctcgtgatccgcccgcctcggcctcccaaagtgctgggattacaggcgtgagccaccgcgcccggccactcttaagtactttataatattgttttaatggaaaaacactgccagtctgtttctaggaacactcatcctcaggataaaaagagatattataaagaaaggggggaaaagtgtcctatggtcagataagtttgggaactccctcttggtaatttctttatttgtaaataacatttgttgggagagtattcactccgtgggtatagcgtactttggaacacaatgccctgcggcattttttgaggtggcagaactgagtaaggatacaagaatccttacacagatgcacttctggaagtgagtacaaatagccttggatttgttttcattctagattttctaggctacctttgggagcctgagattgccagaatattgacaagctagaaccatatgatgattccttaattggcatgatagagcctattgttgtgtctctccctgaagaacatttgtatccacccaagtgcaaactctagctgacaactaactttttatccacactatctgagtctattttttcaaaatgaacgtagtattattggaaatatttgaaatatgctaatgactctatcaggtttttcatggccccagatgaatcagaatttgtaagatttttattttctagaaggaatttttattttaaaacattccatgaactctccctattgccatgttggatacgctttctgcacaattatttgggaacaaaggaagggagactaatggccctgggaaaggtatcctattaaaatcactggtcctcaatatgtttagtgaataatacatctgcttgtgaagctgtccagtctgaagctgtgttttaagtcttaaatatttcccccaacattaaattttatttttattaatttaaatgttaatgcgtagatgctgcttgcttctttggttctgaattttggtcttgatgttttataattgcacttatcgatgaaagtacctaaaccagtagaagaattagaaacttgaagaaattgtgaagaaggattaaaatggcagataggaggcaggactagtttgcagctcccattcgaacagacagagcagtgtttggagactcacatagtgaacttttgctctaagaactacctcaagaacatatcaggaaagccaagagaatccacagaccctttgaaggaactggatcaccrctgcaggcttcctgagatgccaaaaaaaactatgagtctgtttgctttctcaaaggagaggctcttggtctggggcaagttctcagccctagttacctgttgcctggaaatagattcagtgctgttatgggggcactgtgggagtgagaccggccttcaggattgcaggctgcatgggagcagggtaaggcctgtgactgccagctttcctccacctccctggcaacttgtatgactcagtagagacagccataatccccctgggaatataactccattggactgggatccacaccctcatagcccacagcagctgcagcaagccctgccaaaggagaggctgaactcagacatgcttaccccttcccccacctggtagtctttctctacctgccctggtagccaaagacaaaggtcataatcttttgggagctctatggccctacctatcacctgagaaaccacttaaccaagtgttcctagggcaactaggaacacagctgatacactcttgtcagtgccacctcctggctggaggccaaccaacacaaaaccaacactctaaacaaaaacacaaccaaggaccctcgcagagacgacttcactcccctgctaattccatcagagcaggtgctggcatccatggctgcaagacctgaagacagatcacatcacaggactctttgcagacactcyccagtaccagcctgaagcccagtagctcctctgggtggctagacccagaagagcaaaaacaatcactacagttcagctctcaggaagccccattcctaggggaagggaaagaacatcacatcaagggagcatcccgtgggacaaaagaatctgattagcagccctgaatcccagaccttccctctgacctagtctacccaaatgagaaggaaccagaaaaacatctgggtaatatgagaaaacaagtttcttttacatcccccaaaagatgataccagttcaccagcratggatccaaaccaagatgaaatctccaaattgccagaaatagaattcagaaagttgattattaagttaatcaaggaggcaccagagaaaggtgaagtccaactaaaagaaataaaaattatgggatatgaaacaaaaagtcttcagtgaaatagacagcataaatgtaaaacaatcacaacttctagaaggcaagaaatgcaaaatgcactggaaagtctcagcaatggaatggaacaagcagaagaaagaaattcagagttcaaagacaaggctttcaaattaacctaatctgtcaaagacaaagaaaaaagaatgaaaaaattgaacaaagcctccaagaagtttgggattatgttaaacatccaaacctaaaaataatcggcgttctcaaggaagaagagaaatctaaaagtctgaaaaacatatttgttagaatcatcaaggaaaacttccctggccttcctagagatctagacatccaaatacaagaaactcaaagaactcctgggaaattcattgccaaaagatcatcacctaggcacatagtcatcaggttaactaaagtcaagataaaggaaggaatcttaagagctctgaggcaaaagcatcaggtaacctataaagggaaaaccccatcagattaacagcagatttctcagcagaaaccctaccagctagatgggattggggtcctctttttagcctccttaaacaaaacaattatcagccaagaattttgtatccagcaaaactaagcttcataaatgaaggaaagatagtcttttccagacaaacaaatgctgagagaattcaccactaccgagccagtactacaaaaactgctaaaaggagctctaaatcttgaaacaaatccttgaaatataccaaaatagaatctccttaaagcataaatctcacagaaactacagaacaataacacagtggaaaaaaaggtaatcaggcaacaaatagcatgatgaataaaatagtacctcacatgtcaatactaacattgattgtaaatggcctaaattctccacttaaaagataacagaatgacagaatggataagaatgcaccaaccaagtttctgctgtcttcaggagactactctcacacataaggactcacgtaaacttaagatgaaggggtggaaaaagatactccatgcaaatggacaccaaaagcgagcaggtgtagctattcttataccagaaaaaacaaactttaaatcaacagcagtttaaaaagatgaagagagacattatataatgataaaaggactagtccaacaggaaaatatcacaattctaaatatatatgcacctaacactggagatcccaaatttatgaaacaattactattagacctaagtagtgagatagacagcaacacaataatatgggggactttaatacaccactgatagcactaaacaggtcatcaagacagaaagtcaacaaagaaaaactctacctaaatgataccctacaagtgaacttaacagatatttacatgacattctacccagcaactgcagaatatacattctattcatcagcacatggaacattctcctagaccatatgataggccacaaaacaagtctcagtaaatttaagaaaatcaaaattatatctagtactttctcagaccacagtggaataaaattcgaaatcaactccaagaggaacccttaaaaccatgtaaatacatggaaattaaataatctgttcttgaatgatcattgggtcaacaatgaaatcaagatggaaatttaaaaattttttgaactgaataataatagtgacgcagcctatcaaaacctctgggatacagcaaaactggtgctaagaggaaagttcatagcattaaatgcctaaaccaaaaatctgaaagagaaccaatagacaacctaaggtcatgcctcatggagctggagaaacaagaacaatygaaacccaaacccagcagaagaaaatgacgaagatcagagcagaactaaatgaaatttaaaaagaaaaaagataaatgaaacaaaagctggttctttgaaaagataaatgaaacagatagaccaacgagattaaccaagaaaagaagagagaagatacaaatatgctcaattagaaatgaaatgggagatattacaactggtaccacagaaatacaaaagattattcaaggatactgtgaacacctttacacacataaactagaaaatctagaggagatggatatattgaaagtatacaatcctcctagattaaaccaagaagatacagaatctctgaacagaccagtaacaggcagtgagattgaaatggtaattaaaaaaaattccaaacaaaaaaattccaggaccagatagattcayggctgaattctatcagatgttcaaaaaagaactggtaccaattctactatttcaaaggataaggaaatagagaatcatccctaactcattctatgaagccagtatcaccctaataccaaaaccaagggaggacataacaaaaaaaaaagagagagagagagaaaactacagaccaatatccctgatgaacgtagatgctaaaatcctcaacaaaatactagcaaactgaatccaacagcatatcaaaaagatacttcaccatgatcaagtgggtttcatactagggatgcagggttgatttaagagacataagtcaataaatatgatacatcacataaacagaattaaaaacaaaaatcacatgatcatcttaatagatgcagaagaagcatttgacaaaatccagcatcgctttatgattaaaaccctgagcaaaattggcatagaagggacataccttgaggtaataatagccatctacaacaaacagataacattatactgaatagggaaagttgaaagcattccccctgagaactggaacaagacaaggattyccattttcaccacttctattcaacatagaattggaagtcctagccagagtcatcagacaagaaaaagatatcaagtgcatcccaatcagtaaagaggaagtcaaactgtcactgtttgctgatgatatgattgtatatgtagaaaaccctaaagactcatccaaaaagctcctaaaactagcaaatgaattcagcaaaggttcaggatacaaaattaatgtacacaaatcactagctcttctatataccaacagcaaccaagctgagaatcaaattaagaactcaacccctttcacaatagctgacaaaaaaaaaaaaaaaaaaaaaaaaaccttaggattatacctaaccaaggacgtgaaagacctctacgagtaaaactaaaaagctctgctgaaagaaatcatagatgacacaagcaaatggaaacacatcccatgctcatggatgggtagcatcaatattatgaaaatgaccatactgccaaaagcaatctacaaattcattgcaattcccatcaaaataccaccatcattcttcaagaagtagaaaaaacatcctaaaattaatatggaaccaaaaaagagcccgcatagccaaagcaagaccaagcaaaaagaacaaatctggaagcatcacattaccctacttcaaactaaactataaggccttagacaccaaaacagcatggtactggtataaaaataggcatatagaccaatggaagagaagaaagaacccagaaataaagccaaatacttacagccaactgatctttgacaaagcaaacaaaaacataaagtggagaaaagacgcctattcaataaatggtgctgggataattggcaagccacatgtaggagaatgaaactggatcctcatctcttaccttacataaaaattaactcaagatggaacaaaaacttaaatctaagacctgaaaccacacagattctagaagataaaattggaaaaagtcttctagacattggcttaggcaaagacttcatgaccaggaacccaaaagcaaatgcaacaaaaacaaagatagacatatgggactcaattaaactaaaaagcttctgcacaacaaaagaaatcatcagcagagttaacagataaccacagagtgggagaaaatctttacaatctatacatcttacaaaggactaatatccagaatctaagaactcaaataagcaagagaataacaaataatcccatcaaaaaagggctaaggacatgaatagacaattctcaaaagaagatatacaaatggccaacaagcgtatggaagaatgctcaacatcactaataatgagggaaatgcaaatcaaaaacacaatgcaataccacctcacacctgcaagaatatccgtaatcaaaaaaaaaaaaaaatagatgttggcagggatgcagtaaaaagggaacacttttacactgatggtgggaatgtaaactggtacaagcactgcggaaaacagtgtggataatctttaaagaactgaaagcagatctacatttaatccagccatctcactactaggtatctacccagaggaaaagaagtcagtatatgaaaaagatgcttgcccactcatgtttatagcagcatgatttgcaattgcaaaaccatggaagcagcccaaatgaccatcaatcaatgatgggtatatatatatcatggaatattactcagccacaaaaaggaacaaaataatggcattcacagcaacctggatgtaattgcagaccatcattctaaatgaattaactcaggaatggaaaatcaaacatcgtatgttctcatccacatgtgggagctaagctatgaggatgcaaatgcataagaatgatacattggactttggggactcaagggaaaggatgggggacagcaaaggataaaagactgcacattgggtgcagtgtatacttctcagttgatgagtgcaccagaatctcagaaattaccactaaataacttactcatgtaaccaaacaccacctgttccccaaaaacctattgaaataaaaaaaawttttttaaaagaatttgttcctttcctttttttaattacatgtaaaactaggtttatggccatggggcatctgtgactcctcctctttttctttagagatgatcttctcattttttattctgatatgttatttcctctagcggcaacttatgttagtgaatggcttttctgtaagacccatggcagatacatatttttttttctgctgggaattgctgagagcttttcctaaggtttgaacacatttagaagcttcactaacacactcaacaaccttatgtctcatcagtttacatagacatttctactaggatgtgtaaaaagacaaattgtgtgtaaattgatttgcaaaatacatctgtgagataaagcaagatttgtttacaatgagtcacttagaatgtggtctaccttttagtctggatttggtatgagagattccatagtcattttagagccttaggctacatgaatattgctgttgttattgtatcatttagttagaatatacaatttctgtgcaaaagtagacaccacccagggtatacagcataataatgaccagttcttttctatctgacagtctggaagggtggcagatgaatgctatgagagggcccccttttctacagcatgcttagcttcctccccgatgtatgctttgatttggccttagaaagtgaaggcatgtggttgtaaaggaagcggaagcttaagaaattggtatcatttatcctggagaataagggccatagaaaatcttactaatggtatccttagtgccccagtggatttcctcccacccaagaatggaatacatacaaatccatggtagggctgtctggaaaacctaggctaccttattgcaatggtatcatcactgtatcacacacttggctcacaaggagacgtcttatttcaataagaagctttgactgcccacttcatgtcaggcaaataatatggacaggacacagttccttgcgtcaaggagctcatagtcaggcaacaatggcttcacatggatagaggcatttaaaccaggccttgaaaagttaggaagtggtaaaaaaaaaaaaagaacaaattagaactcatgaaagtacatagtttgaggagtagaagatgtcttcataaatctagagtaatgggtgagtgaggagggggtgggaaacgagtaaagtgaaggatgagagtttgtgaagggtactggatgcaaagctaaaggttggagttggtgctataggcagcaggcaccactgaggattttaagcatgataggacttctttctaaaatagggatatcacattgactattttaactgctaaagtactatgataaatagaatagagatacagaaaaacagagtagggagatcccagttatactgagcctagagaactacagctttggagttgcttagcaaattttatttgctgtggtggatgagccagcttctacttctctatgttaaatataccaaagaggaagtgatggggtttccagggatgctgtgttcttcgcctacacgcttctctgcatcatgctaatgctgcattttgcaaaagctgtggtttacccagcttccaatgaattttgttccagtaaacttgcctaaaaacagaagtctgcaaaaaataagaaaatatgctatgaacatctgatcggacctttatggttaactgggtttttttaattgccgtggaacgtaagggtttagttagtctattcttaggctcctcgactcctgcaaacattctcaaaaataagcactaggaaaagaacgtttctactgggtatgtgacaggataaagaaagtattgagggaagttgattattataagagtacttatttataatcctgctcgtgccctcctcatattagataatcattatcgatgagctgatgcttggcccatgtgcttgcctgacactagcattttcagactacatgtgacccagatctcactgatttttcaacctttaagtcctcctttcttaatccttaaataattcaaaatctctaggtaagtgagaggcagcatggatagtagaataagcatgtgctctatgttagaacatcttggattccaatccttctgtgctatctagtagttgtattttcctggacaaattatttaacattctatcattatatatagattttgaaacagagtctcgctctgttgcccaggctggagtgcagtggcacaatcttggctcactgcaacctccgcctcctgggttcaagtgattcttgtacctcagcctccagagtagctgggatttcaggcacacaccactatgcccaactaatttttgtatttttggtagagacggggtttcaccctgttggccaggctggtctcaaactcctggtctcaagtgatctgcccacctcggcctcccaaagtgctgggattacaggcattagccaccgtgcccagcctaaattatttaacattttaaatctcagttttctctttttacaatgggaacaatttatcttcagttcttgataggataatttgaaataatatacacagtaactggcccctgctaagccatcaataatagtaactattattatcagattctaattgccaaaacagcaggttggatgttccaggagaggttataatcccagtatcaactctcagctctcgagtcttcatgtctgtatcccattgcaaagttcagcttggtcaggggaatcctcacagtgaggaggccctcataataaagcccacatgtgagtttggcctggataagttaactcacaaaccttcaccccagtgtagccaccatccatgagtatacatgaggctagtgtataaggctaattctctcctcactgttgtagtgaagagcacttaatagatgtgtcataaatgttatgcagacttaacactctgaggacatggggatgcacagatcatttttcccatcccttttgctctctctgtgatgtccttaacctaaataacagtgtgtagagaaaaatttataatattcctgaggaaaagaatagtagaaacagtaaatagctgttaaggtcaatataatttactacaaaataagttgtttgagatacagaaaaaaatcaaggcagagaaaacacaaccaaatctagtgcttactatttacaatttaccctggggcctgaattttcaagaaatctttctgttttttaatatagtcacaacaccacaatttttaagcattttcagaagatcctcatgcataaaaaaccaaggatggtgaccactgatgcttgtattattttcctttctctgaaataatggcatcttttaaaaggaatatatttaaaatgtaattgaaattattgagttgttgctctgattaatgtatgtgggaaaatagaagtcaggaaatgtttcaaaagctatatttctgttctcatcgccaatcaccatagaccctagatccatttagccatcccatattcacttgttttaggcaggatgttagaataaagaaatattttatgaagtgcttcatactggaatttactccttttctgaaagagggaagtgtgaatttatcttttatagtgaaataattttacctgaagtcatttcaatgtcatttttggtcataaatgaagagtttggtagaggaatctttgaactaattacctttctgaaaccttacagtattttgttgcaaaaaacaatggttaaacttataaagcagaggtttttggtaaagatgcaaaacatctacctaagaaagccccatgtcctatattttcatttttataatctataaacattaattgaacacctgggagaatggaggagagaaccaatatttacctcctatgtgacagttacttaccatgatctttttaaatcctcaaagccgccctgtaaggcatgtattattaccactggcaggtcattgggcctgtctgggactcagttccttatcagtaaactagatggtaacatgcttgcaggactgttatatggatcaaacataatctaggaaaaacacatgtctattagagttgcaaagatggaaaatacatggcacatgatgttaaagaaaactgtagtggcagtgctgctactaatggtgatcatctcatggcttgaattgaaacagagcactttggtggagcagtgatgtgggatatagagtgacaaggcaatgttcatagtggttgtgataaggaagaacttcaataatgtcctacagcgttttataacagaagcatcattttactaatcacaaatatataacatttcccgatttttttaaataaaagaattggcagtgaatactcttgctttaggacttaaatgaagtagagtcaaataagatttctcatccaggtcttttattttttttctttgatatggagtcttgtctcccaggctacagtgcaatggcacatcagctcactgctgcctcaaattccctggctcaaatgatcctcccacctcggcctcctgagtagctgggactacaggcatgcaccaccatacccggctaattattaaaattcttttttatagagacagggtctcactgtgttgcccaggctggcctcaaactcctggactcaagcaaccttcctgccttgacctcccaaagtgctgggattacaggtgtgagctactgtacctggcctcatcccagtcttcttaaattgatgtgaagatggtagtagattatttcagattttaggatgaactaataatagcagttagcatgcttgaacagactgtatctagttctgagctaaatgctggatatgtgattctcattgagtccaggaggtaggaaccactattactcctttgacagatgaagggactaagactgataatctcacaacttgcaaaactagaaaatctcatatttcttttttgtaaggttgttttttattctttgcccttttttaaactaagaaatatttcaaatattgaaaaataacattgaatatcctccacctagatttcataaatgttaacgaatctggatatttgtttcagatccttagttcagaagaaattaaaagttaccaatacagttgaaacctgttttctacctctccacaatccatttccttctccctctgcagatgtaaccagtgttctgagattgttttaaactcactctagaatatgtatataaaaaatggtatcatatagtttttgtgattttgaatttacataastggtattttcttccatattcaggtttatccttttgtttatttcttctatctttttgaggtaaatatttagtctattaattttcagtctttcttattttctaatgtatacacttaaggccatgcattaccctctaagtactagtttagctgcattttgcaagtttgaaatagtgccttaaagtttccaaaatagagagttattactgcgttactgagctccaattttgttgcatatgagttgtagtgtggtctatagaataccaactttttgttatttattgagagttaactttggctcattactggtcaatatttttttaaatgattatattgacttgaaaagaagatatagcctccctttgctgggaatagagttctacatagttcattagagcaaacttactaactattcaaaagtactgtgtcatttgaaagaagtatattaaaaggccccattaggattgtgattttataaatttctcctttaatttctatcagcttagctctatgtartttggggttttattgctttatacagtttagccaaaagaccttctttatccttaatgatgaattttctctgcaagtctattttatcaaatattaatatcatagaaccaattcttttttggttacttttttttttttttactattccttttctgacttacctcggttgttgtgttttagttgattctggtatattttaaaatatccaatctgacaatagcagttaacagggaagtttgtcatgtttattgtgattacttacattttgtgattttctaacattttctattaaagttgctattttgctcctttttttctccttgtttgctttctattggattcagtggtttttcttaccctctctcctcattttctctccactatttagaaacttatacattccctttcttttttttagtggttactattaaatatcacatgtatatttgtcttaattaaataatatagtaaccacagattgcttcaatatatccccttccatcatatatattattgttgattagtgttttagttatgccttgtttataaactgtccccagatttgttataacatggtcattattatctgctgtggtctgaatgtgtctcccaagtttcctatgttggaaatgttggaaatcctcaatgcaacagtgtggggaggtgaagtctctgggagctgtttaggtcatgagggatctgcccacatgaatggattgatgccattataaaagggctggaaggagggagttcaccccatttttcccttctgtcttctatgtgaggacagtttctcccctctggaagatgaattgttcaatgtgccattttggaagcagagactggatcttaacctacagtgccttgatcttgaacttgtcaggctttagaactgtgagaaaataaattcctgttctttataaattactcagtctcaggaattatgttgtggtagcacaaaatggactaagacattatttgtttggctttgccacttactggctgtattactttgcaagttttttagatgtgtgatgcctagtttcctcatggatatactggggatcataatagtatctaattataggtttattgtgataattagatgagcttcatcagttcctggcacataactgctcagtgaatttcagctgttatgatttagttagtacttattagattgtcaacatgttcactgatatgtttatgaactattatttctttctcctggttcagttaccttcttcctgaagtaggactcatagtagttcctttaatagagttctgtgagtaataaactatcagttttatttgaaaacacgtttactttgttccatctttgaatgatgttagttgaatgtgaaattgtagatagcagttatttttttcccagaatttggaagatattattttattttttctggctcttatagttgttcttgaggaatctagttgtatcagtgatgatctgcattttcaccatgatttgtttagggacactttaaaaaaatatttccttgctcttacttttttttcttcttcaatctgagaactgggagctcttatgttttttttttaattcagtaatgtcataagctattattgcctcaaatattgccttcctgcattctattctgtccttctgtaatccatacagaataaatctatcattttgtctcccatgtctctcaatctcactctcaggttttccatctcttcaacttgctttacaactttctgtgtgattttctcaggattcatcctttcaatttatttctctttggttgtgtttttaattctatttaatccttccatttagttttttagcctgatgcttggcatctggagaagacaagaacaggaaaatcaggacaatgacctgactgtgtcacccattggcatgaaataatgaggaaggggtgaggagaactatgaaaagcatgaatggcatgttcagtgatcctcaatcagtttaccaacaagttttcttggtattttaaccttttgtgtgtgttttcaaaggcgttgtaaaaaacaaaacaacatataaatttgttaaataataataatgtatctccagattttgcttatcacaaaaatttataacaaccatactttaatttaaatgaccagtgttactgtatcaaattggtattctttcaactaagagaaaagaaattaaatttgccaatttagtttatttggggtaccatctcacccataaagatataatttttctatgttttttagaatacttgaaactggttcatagagtccctttcgtgatcataggtttgtaaacactggcataacattactgattggagctctagaaagcgggaagtcattcttgcctaccatcttttattcagcatttagctactggctgatctagaaactgcatctacagccactgctcattaccttcttgacccaagttgcagcatctacagaagatggagatgcagtttgtaagtggtccaggaatgagtgttggttagcttttagaggatgttgcttggactagcacaaggagtatcatacaaaactctcttgttgccacccttgacaaatgaccctaattttcatatcggattagaaaattcgattggaccatcaaagcaaatgtgttcttttatggtttattagtgattcttcccagctttggtaagtgcaatttatataatcagctctcaaagattttcactatgggtttttatttattcttgcagaatagtgccttagaaaattttatacggatttttttttgcaactattaagcagttttcccttattcccactctctcaaaccccaatgcccagcatgaagaagaaacaaatctctattttcaaatctaagccactcatgacacacccagctgggcttactctgaaattggatttccattgaaggacagtgggcagaacactaatcacttgggggcctggggaaacagtgggagggtgaatcaggaagccatcaggagatgcagccctcttgctgctttatgtagttagagagagagcatatttttagaatggactttgctaggaggataaataatacagttctattatttggacgtttgaatcacacacgtctagccctttaactcatctgatatacccctatgtactattatttttccatagggagaaaaaggcattaagtgagggataggtatattaatgaatatacttagagttactatattgaaatctggggaatatagatacagagaccaaaatggggagtggtgttgatcattgttggctagtggccctgaatggagcagggagtaggttcctgaatgggcacaggtaggaatcatgtgggaaatgggcacrtgtgcatctttcaaatccctccatagggctgctgcctactgcttgtattaaaaggcattttatgttgcatctacttgaagatgcctaaatatgctatactttcacctctcctcattcaacatatgtccatatgttatgtatacttccattgtcagatttgagctcttgaagcatgatttttaatctgtgcatgcccacatccagtgcaaagtaaaaaccaatagtgtctttcaggtttagaactgaccacagtcaagtactttaggacaggaaagtgagagggccagagggaagcttcgctttggggagtaaaagaaccaatctacagaggcccttggtctcccacagaaacacagaaatgataaggaagtataactatgactaaagagaaaggaaagaagagagagagaaagtgaagaaacacagccaagtagaagcagagcctgctcagggaagcatagatgggttagaggagggacatttgggatgcacatcagaaaatcagatgagaagtccgcgtttgtctgttttgtctggtcaccataattgtgctggctctgagtttcaacctttgttaatcatacagccttgtttaaatatggaatcatttttcttttgtccttccttgactccatcttaaacatcacattactgataactcagagaacttttaacctaggcaatcttcatgtgagttccattcagttccttttgatatacacatatttaaagtgacagttatttcctcttatggaagatagattttatttaataattttttcaagcggagagattagttgtggtcacagtagaaaatttttcataattctccaagtactataaaaagtaacttgatggcataaagtgaattsccatgatgagagtcatcctgtcactgtgaattgctgtgatcatctttaaagtgatatatctttccacactgtctgtcagcaactatgtagggtttgttttagattcaaaaatgtgtgagattagttgatctatatccaaagaattcagacactttttgttgtttttggatctagtcactgttcactagttcagttgtggggtagttttcttatgtttatctgtcctgaagttttatattcagaggcagtttttacatgctctttttttcttacccttcacttaatgaagcagggttataggagaaaaataaccttttatctttcctcagtgatattaacttcattgcatttaactttttaataaatcgtatgcctactaatttacagaagccttatttctaaaaaatgtaatatatatgacttaagactgatcaacatcttcccctttctactacatacatattcggagtttttattttgttttctttctgtatatttcagactgggaaaaaatgtactatttgtaagcagatgatttaatttcagtaaatgtttttttatttctctctccctttgatttattgcttggaaaccatgagaaacatccaagtgcagatgctgttttcccactctgacaaaacattgcttgttgacctcgcaaacttagaaagatttatctcctgtgattcaatggtggaagtaataatattagcagttaaaattttctaagacacgatcaggaaaaggagacttcggtcgttctgcttcttgttaagaacagctggcaatttaaaaagcagagacttgctaagggggaaggaggtaaagaagatcaaacagaaatgcctccccctttagtgaagtatgaactgaggrtgctgcatagtagcaataaaatcagattcttaaatgctttcccttgtttagtgtgtatatgtgcttatttttatttagtcttcaaagatgactttccttatatatttattctcttcgcaggaaatacatcttgaccaaatattttttgccaaatacttgttgtatattaaagccagcttaaaatgtcatatttgctgtggctatgttgagactctgacaagattatctgcagtgtgagtgatgtctgcaagagtggcctctcaccatgccttctgcacattgattccactaatctgccaggaggcagaggtgattcctatcattctgagagcttcctatagaaggcagggcctctgcagtctctagaactgaggaactaaatgaaggccaccaaagtgaccattaagttccttaattgtgaggaagcatctttaagaggaaatgattctacagccagaaatatgcgtgaccagttctacaggatgtgatgtcatgtgactggtggagcttgtctttctatcaaaggcttgtacagaaaagggaaaagaaatgggcatgtttcaggtcagttctgaataatggaagaaagaatgaaaggaaggagaggggaggggaggggacaggagcggagggaaggggaggggaggggaggggacaggagcagagcggaggggaggggaggagaggggagtggaggagaggagaggagaggagcggagaggagaggagagaggagaggggcatgtgagctggatttcttcaaaccccaccaacctggacagtgagtcctggaatcaaaataatggtgagcctcagcatctaacatcaaacacccagacttccttctggtttaagaaattccaaaggctctcagctgtgataaaattaaaaggacatattcctatttgttctttttgttattggttctctgtctccccctgaacctttagccagaaatagagatgcaccctttcttcttcagtagctttgaggatcaaagaatcttagttgccagagctgggaggggaatctcaaagattgcctagtggaacaatatgattgttcatgtgaataaactgaaactcagagagaatgtggtctatgcaagacatggcccatagtctgtgtcaaaagccaggttttctgacttgtggcccagggctctctgtagtattctgggccagcaaaatcccgtgtctctccagacacatcttctcttgcaccaaatgggcctccttgctgtgtcctcctcaaaccaccctcactcccacctctgaacctttgctgatgttcacaccctgcacagagtgcccttctcctccaactcctctgctcagcacatcacatcccctaatgctcagcccgatctcatttccaaagttaaggctctgctactcttccagcccaaattgatgtctcctctccctagaccccttcaggtcttttttcattccctgtttcatgtttgattttaacttctcaaccagatgatactttcccaagcctatgtttttgtcttttccacagcagtcctcccagcacctactgccaggccaagtgcttttctctacttcagtcttcttctctgttaaatgtgaataataacacctgctctaaatctaagcctagtggactcccagcttgttgaagggcatgttgaatagtcttatgtactggaagtttgagcttttgggagggtaaaagaagggacagggatgcctaggcacacagaactcaaatgcagttatttgggttttcctctaacttagcctccactggtcaaatgtttttagcacctgcaccagcagccatttccatgtatcccttctccctggagacagtacaaacaagagataattcctatcattgttgggacagaagtctctcaaagcccttaccaatattatagttttgagattcacagtttcctctgaaacttcccctttaggagggatggaaaccacaggatgggcattctggtaaatgctcaacatagatacctatggactgggtagcaggygacccctaggaaaacctcaaatatcctataaggtcctaataagggccagttattctaagcaaaggagcttctgtgagtcatagtgcaatccatagatatgcttgttagctccttatttaaacccttcctgaaacaacagccaagaaaggaaaggactcaaggtcacctctggaatcagaatctactcagtcttttcccatcctagtttgtattcaccatattcagccctcagccaacttgaggcagagtgccttggtagaaagtggttcttagagacaggcatccaggcaatgtagcaaagtagaaagagccctagactagaagtataaagacccaggtttgaggcctgactctgccacctgctgtctcaaaaactgcaataatataaagtctcttaccaattctagcttcagtcttctcctttgttaaatgtgaataacaataatgccttccctgccagtcatggtggctcacacctctaatcccccctactttgggagaccgaggtgggccaatcactcgaggccaggagttcaagactagtgtggccaacatggcaaaaccccatcctactaaacatacacaaattagctgggcgtggtggcaggtgcctcttgtcctggctactctagaggctgaggcacaagaatcacttgaacctgggaggcagagcttgcagtgagccaaaattgcaccactgcactccagcctgggagacagaacaagagtctgtcataataataataataataataataataataataataatgctttccctacatctagctataattatttctttaacatttccttccctgctacattgtcagctgcataagagcagggtctatgtgtatcttgtttaacactgtatccccagaaccctagtaggacatgtactgtattaactggttggttgactgagcaatagggagaagtttagagcaagtgcaagctattattatgatccttattatgtttgatgttgttgttatgtctccctagagtttggtggattttggtttggatttccattccactcyccatcattgagaaggaactgagtcaaaagacccatagtggatcagcagagaccaaccactcaccatggtcataagtaatttcagagcccatagtatctctctgtagattcttccctagtctcagtacttggccacagagtggatggctttgatcttacacagattgattctatatcccttgatgggtgtgtggcagcaatcatcaacagcaaggtgaccttctctgcttatcatgactggccccttttcttctataattttcttctttggtttttgatgtatgagtatttttagtgacaaagataattaggtactttagtgacaaagataattccaatggtactgtactaaatgtggcttctgcctgaggatgcacttgtgtctgaggaggatctagactgtccaagtgagctcttattttaaagcccctcttacaggttggctcttaaggactgaggagaaagcagggcctttagcatcagacaggtctacttttggaagcccatgtagttgacaatctagctacatgggacaatgtagctacagggaaggaaatgttaaagaaataattatatgtgtgaagaatacctagatgtagggcagatattattattatcatttaacatgaggaaaacttagtctgagagaagcaagaagctttgctccaagtttttgagacagtgacacagataaggtgtctctccttattgtataatagggacaataataaagccatcttcaagggatgttgtgatgaatcagtcagaaaatgtatgtgaagttaatgagcaaagagtctggccatagtattaattagtattaatactattaataagtattcaataaaggagagtctcccactttctttccttccactctgttttccataaattaaccagagataaaagtggtggaattagacttcagtcctgtaatggtgcacctgaagtgcttcctctcaattcatatccatcttccagattgcttgttgtacccatattttctgttaacacaaattggagggagtatcatgactttcatttgttgacagatacacaaatgggcagaacacaatgatgaatgtctcaattcagacaggaattgaatgttgcctgtggggtaggctggctctgccacctgcactgacaatacatcatccctggaaattaacccatcttcaccatagccattgaaatggaaagaagtgcttgttcattaaaaacaccttcaaatggaaaggatgaaggtctagcgtagtatatatggtgcattaatatctataatcatgtttaatttgcattagtctaactctgccacttggaaactgtttttaagatattgtgttgcctgaatgggtttgtgtatgcattatttgcttcttgaataagagctgaacagaagctaatagctttatataaaatatagtgattaccaaattcaagagtcaatgtcctgtttcacattcattcttgctcacttttagtacaagcttatgcatcatcaggcatgttgtatacaaaaataatgatgtgggtcctggtctttataggtctaatgggtggtagttccatatttctgtaaattttaaaagcattattactcactaaatatggatcattttaaaataattagatatatgtatgaataggcttcatatcacaaagttttattttctttgttaaggatatgaatcctaatgtctttactattgaatctgctaattcaaataatatctatcagtaggtagatgagctaaacactaagcctgtatgtcaaattttatacacgatattatgcttagatgcatacatagcaaaaccaatatttacaatatattggtgtacaaacaatatattggtgtaaaaaaatgattagtgcttcatcaagttaatacattcaggtatcataattatgtattatttcatagtgtatcaacaaggagaagagaaactagttatttcaagcaggaagtgatttaatttagggaaatagattctataacagaaagaattaatgtttaccaaacactatattgttctcccgttctctcttgctgttaattgggaccctgtgatagtcctggctgaaggactgtgaaggggagggaagaattaatatcccagggcctaactggttaagagcttgtgtgcctctttcaaccctcactttccctggaataaaccttggagctatatgttgaaatagaaaataaaaatatggatgaatcttggtcgtctgagtcaccagatagaggagatctcttgccaatctgcacgggattttgcatgaacaaaaagtcaccttttactgggataagccacagaaatttcagagttttgtctattgagacagctagggttagttactgtaaaaatactagggcctggaaaaatgttggaaggattgagagagggaagatcaggttgcaactactagtatgcagaaaatcataaagcataggaactgcaggaaactgtcaccaatgatctcagctgtctacagcaccaaagtgagtggtcagtaggaagatacttggaagctgttagcaaaagctcacatctggggtctacccaagtccatgtgactgcctgtctcaaaagagtaataatagttctatttatcttttgtctttgaaaccttgcatgaatgagtctaattgtcttaatttaaaccataaccctgctggcagagattctaagaaatgtagttctcatgcttccaatccctataatactaaggagagcgtagaaggagaaaatggtgtcaaattgccaaaaaaaagaacctggcatatagaagtagcccaattattaggtgatgacatgccccagtttgtctgggacagtcccaatttattcctgttgacctagagtaatttttgatagtaccccgtttcaatctcaacatgttccctgcttggacactaaattatatggacatcgacctattaataacatgataaaaatactttatttcatcaaaaaacacttattcaggatatgctaagtgctaatcattgtgtgggacattggtcaacagaggcatttatgaccttggcattcatgaaacttagagtcgaatctagtgaatgatgggagcctaaacaaggcaatagctatgaggatggagcagaggaggcatactcgaaagaggttgaagaactaaatcatacaggtcttgataactagcatactggttaagacccttaggctcttacgtcagactatccaggtttgaacaccagctctatcacttgttgggtattttaacttgggaatttaccaactaatctctgcctcaacttacaactctgttaaatgggaattataataatacttataagattgttgtgaaaattaaatgagataaaaatttataaagtttataagagggcctaaaatatagtaaatgctcaagaaatatcattatagtgaagaaattgtggtggttgttgttttataatggctgaatatgagagaactgttaagaaaatcctaggtttctgacttgaatatcttgatggatggttatgtaaaataataaatgcagaagaagctgatttatgtgggggaaaatagtgcatatagtttgaatggattgctagaagagtaaacagaggaattggcattctaatttaagtgggggaagtaatgcatttggtttgattatgctgagtttgagggactggtgggaaatccaaatggcaaggtctgatagcagctgaatagttagaattggggctcagataaagatctgagctgaaatttagacttgtgaggtttttttttttttwaaaaaaaaacacttctattttaagtttaggtgtgcaagtacaggtttgttacacaggtaaacttgtgtcatgggggtttgttatacagattatttcatcacccaggtattaagcctagtacccattagttgtatttctggatcctctccctctttccaccatctcacaccagtcagaatggctgttattaaaaagtcaaaagatttgtgactttctagatggtagctgaagccaaggaaatttgggagatgaattagagaaggtattcagagtagaccagaactttaaagggcagaggaaaagaaacatatgagaaagacaagaaggaattgccagaaaaatagaagagaagcaggcaagtgatgtgaaggaaggcgaggaaggagagaaagccagaaagaacagggtggacgatggtgttaagtgtcaagcacaaatcaagaagatgagaacagaaatgatttccacagattcagcaattgagggcttttgctgattttagtaagaatagattcagtggagtagggaaggtggaagtcttctcaggtcaccaagggtagaggtaagaatgagaagagagaacatatagatcatgaaatattaatcttcagggtgcttggctgtgaaggaaaggaaagggtcaactggtggctagaggctttttaaaagcacagcctacaagatcctttggtcctagagttgcacaaaggatttgcagaccaggaaaggtttagataacatgaccaccaaagtcttccccatttcaaagtgtttattatttcatgattctctgcttaataagtaccaaggttcagcttttattttcacaggttgttacctgtaaagagggtacaaaatctgttttatcctaacaaatttaagttagaatttagtttgatcttacgagtctttagggaaatatattttaggagtcaaaatgtgtatctgtacatagtatatttatgaatattgttcttaatttttaattcagtacctttacaaattattttataattggttcctgttttcaaccagttgcttgtgcttatatatgcaatttgtctatttttttcatatctgttttcagcttctcccaaagaattatcattaggtcataacaytgggggaggtttactgaatgatcattcttttcaaagactttaccatttcccccagagccttggttggtttattgactagagcaaagcagttagtttgctattagtggaataaggtaggcaaagcatctggaaatgttctaccaggaggagccagtggccttgttttcgaaaagtcccaggtctcccatcactccctccagtcttgctagggcatgaaagaatcagaatttataactgcatcataattctgtactacagcctttcatctgggatcttctgtttggaaagtctcttcaaatgttttcttagcctcaagggaaaaatttctcccagagatacctcaattttgatcaaaagcattcacaagtccacttttagttttttctctaccaattaaagtcctcttagcttggtagattaaagctcataaaactggttccactggtttattagaaaactcactttagctagaagagtcgaagttttgatatacacagaccctagagagctaggaaaatcttacttttctccaaaggattcaagtcctattatttaattttcatctgattttggccaagttcagatttttgctgactgtgtaacatagcctattcatttcagctacaaatagttctcttttgtttccatttacttagaaattaacaaaatattgccatcattttatgtgttttcataaatgtatttaaagccttttataattatgatatttaaatattctgtttttaaattccaaataacattagttgagagatgcatctttgacataaaaaaaaatttcaggagaaaaatttcttgtaaaagcttctcaatgagtgtatacattgatcataagaccattctaattctagaaacattaaatatgaaaaagtatacttttggaattgaaaagatatggcattaatggtcatttcacttgacttgaggcttcccatgtgtgggattcatcattacttcatatgcatctatctaatcttcatttatccattcagctcacagttattgagaacaatattaagtcttaagctcttttgctaagcaacggacaatgaacactccctggtgctagttagcatccgaatttgtaaagtgagccatttgttgtatgttttaaccttttaaaaaattcagcatttttctctaaatattttgaaatctaactcaagaaaaataaaaatcacccagtggctttttcacataattttaatcacctttattcttctgcttatcctgtctcctcagtcttacattcccctacactatgcagcaacctgagttgatagctatcataccacgccatgctactctcatcatcatacggtggcatgattaagacagagaagacttgaaaataagtatgcttaaaatcttcagaaaataaaatgtgaataacatccactaaaaaataaaaacaggagtttatgaaataacaattaagtggtaatcaaattagaacatgcagattcaaaagacaaccgattgaaatgattagaaataaaaatgtatagtcatttagaatttctagaaaaaaatctaaataaaaggaataaataaagagaatgctgtcaaagggagactttataaattggatcacggaaattagaaattaccaaactgtgcaaaacagagaaaagagaactgaaaatataaaagattttgtaatgcaagaagttctattatatataagtaaatagttccagtgggagaaaatagagaaaattgctgaacagtttctagaattaaggcaagatgtgagtattcatattccaaaaaggacaaatcatgccaagcaagatgaaaattttaaaacctctttctatatttacattataatgaagctaaagaacatcaagggcagaatatttgcttttctgaatggggagatatgaaatatcattgaagctttccttgattactagaggtttattcctgcattctgttgtgataacactttcttctatgttgatttagttatttgcctgctgtaacttctcatgcagtcattgtactggcctccagctcacttttgtttactgctgttctatgctatttgctggacaaaccaaaaaactgcctttgttaaaagacttacaataaacaacaatagcttattaaacgaagaattggctttaaagaaggtacatgatactagcgtagcaaaagctaacattaatcaggtgttttctatctactagacatttttacaagatttttctcacttaaccctcacaatgtccccatgaggctggtattactctatcacccccattttacagatgaggaacctgaggcttagttagagaaactgattcacttgcccaagatcatgtggctttagcaagtatgttaagtggtgcctcctagattttaacaaagtcaaattctaagcccaaaatttttaaatactcctttttcttatcctttttttttttttaacttttattttaaggtcagtggtacaggtgcaggtttgttacctaagtaaacctctgtcatggggtttgttgtacaggttatttcatcacccagctattaagcctagaacccattagttatttttccttgtcctctccctcttcccagccctcatcctccaaaaagccctagtgtattttgttcccctctacatgttcatgtgttctcatcatttagctcccacttataagtgagaagatgtagtatttgtttttctgtttctgtgttaatttgctaaggataatggcctccagctccttccatgtccctgcaaagaacatgatctcgttcttttttatggctgcctagtattccatggtgggtatgtaccacattttctttatcgagcctaacattgatgggcatttaagttgatcccatgtctttgctattgtgaatagtgctgcagtgaacatatgtgtatgtgtctttataatagaatgatttatattcttttgggtgtatacccagtaatgacattgcttggttgaatggcatttctgtctttaggtctttgagtaattgccatgctgtcttccacaatggctgaactaacttacactcccaccaaaagtgtataagtgttcctttttctccacaaccttatcagcatctgttatttttgactttttaataacagacattctgactggtgtgagatggtatctcattgcagttttgatttgcatttctctaatgatcagtgctgctgagcttttttttttttgtatgattgttggcttcatgtatgtcttcttttgagaagtgtctgttcatgtcctttgcccactttttaatagggttgtttgttttctttctgtaaatttaagttccttatagatgctggatattagacctttgtcagatgcaagtttgcaaaaattttctcccattctgcaggttgtctgtttactctgttgatagtttctttggctgtgcagaagctcttaagcttaattagatcccatttgtcaaattttgcttctgtggcagttgcttttcatgaatcttcatcatgaaatctttgcccttgcctctttccagaatagtattgcccaggttgtcttccagggtttttatagttttgggttttacattgaagtttttaatccatcttgagttaattttcatatacggtataaggaaggggtccagtttcagttttctgcatatggctagccagttattccagcaccatttattaaatagggaaacctttccccattgcttgtttttgtcagcttcgttgaagatcagatgattgtaggtgcatggccttatttctgggctctctattctgttccattgatctatgtgtctgtttttgtaccagtaccatgctgttttggttactgtagcctgtagcatagtttgaagtcaggtagcatgatgcctccagctttgttctttttgcttaggattgccttggctatttgggctcttttttggttccatgtgaattttaaaataaattgttttagttctgtgaagaatgtcaatggtagtttaataggcatagcattgaatctataaattactttgggcagtatggccattttaaagatattaattatttgtatccatgagcatggaatgtttttccatttgtttgtatcatctctgatctctttgaacagtggtttgtagttctccttgtagagatctttcagttccctagttagctgtattcctaggtattttattctttttgtggcaattgtgaatggaagtttatttatgatttggttctctgcttgcttattggtggtatataggaaggttagcgatttttacacattgattttgtatcctgagactttgctgaagttgcttatcagcttaagaagcttttgggctgagacaatggagttttctagatataggatcacgttatctgcaaataaagataatttgacttcctctctttctatttgaatacactttatttctttctactgcctgattgccctggcctgagcttccaatattatgttgaataggagtggtgagagagggaatccttgtctagtgaaatctgattttcaaggggaatgcttccagcttttacttattcagtatgatgttggctgtgggtttgccatatatggctcttattattttgagatatgttccttcaatacctagtttattgagattttttaacatgaatcgttgttgaattttatagaaagccctttctgcatctattgagattatcatgcggtttttgacgttagctctgtttatgtgatgaatcacatttcttgatttgcatatgttgaaccaaacttgcatcttggggttgaagcctacttgattgtggtggataaactttttgacgtgctactggattcagtttgatagtcttttgttgagaatttttgcatcaatgtttattaaggatactggcctgaagttttctttctttctttctttctttttttttttttttttttttttgtatttctgccaggctttgttatcaggataacactggcctatagaatgagttagtgagtagtccctcttcaattttttggaatagctccagtaagaatggtaccagctctttgtacatctggtagaattcagctgtgaatccatctggccttgagctttttttggttggtaggctatttattactacctcaatttcagaactcattattgttctattcagagatccagtttattcctggttcagtcttgggagggtgtatgtatccaggaatttatycatttcttctagattttttagtttatgcgcatagaaggttcataatattctctgatggttgtttgtatttctgtggagtcaggggtaatatcccccttatcgtttttgattatgtttatttgaaccttctctcttttctcctttgttagtctagctagcaatctattttattaatttcttcaaagaatcaactcttggacttgttgatctttttaatggctttttgtgtctctatctccttcaattcagctcagattttggttatttcttgtcttctgctacctttgggatttgcttgctcttggttctctagttcttgtagtggtgatgttaggttgttaacttgagatctttctatcttttggatgtgggcatttagtgctatagatctccctcttaacactgccttgtctgtgtcccagagattctggtacgttgcatctttgttcacattagtttcaaagaacttcttgatttctgccttaatttcattgtttacccaaaggtcattcaggagcaagttattcaatttccatgtaattgtatggttttgagtgaatttcttagtctttatttcaattttgattgtgttgtggtccaagagactgttaatatttccgttcttttacatttgctgaggagtgttttactttatgtgatttattttaaagaaagtgccatgtggcgatgagaagaatgtatattctgttatttttgggtggagagttctgtagatatctatttgatctaggtccatttgatccagggctgagttcagatcctgaatatctttgttaattttctgtcttagtgatctgtctaatattgtcagtggggtattaaactctccagctattattgtggtgcagtctaagtctccttgaagttctctaggaacttgctttatgaatctgggtactcctgtgttgggtgcatayatatttaggacagttagattttcttgttgtactgaacaatttactattatataatgcccttctgtgtctttttgtttatctttgttggtttaaagtctccttcgtcagaagttagaattgcaacccctgcttctttctgtttcctatttggtagattttcctccatccctttattttgagcctgtgtgtgtcattgcatgtgacattggtctcttaaagacagcataccaataggtcttggttctttatccatcttgtcactctgtgtcttctatttggggcatttaacccatttacatttaaggttagtatttatatctatggatttgatcctgtcatcatgttagctgattattttgcagacttgtttatgtggttgctttatagtgtcactggtctgtgtatttcagtgtgtttttgtagttctaaacccaaattcttaatgactactctatatcttttttagtggaaaaaaagactttatttcttaggaccccacacactataagcccctatatatttctcttgaagcctgaaagtcttgacttattcttcagctgtaatcagctgtggtgtactttggggacccatcactagatttgcactgtgaggttacctatgctccatttctccagtggcctggtgctatctgactcaatctggagtaatatgcatgctttgccaagtgaatttgatgactgaagggttccataagggtctaagataagcatagatgcatattggcatcatctgcttggaaggggcctttaaaatgtcaccattcctcactatgctacaccaaggaagkggggataattatcattgcttgtggtaggtgaggcaggatggtcagagcacgtactttgaacctcatcattctgctaagtactactatacgttatttttttgactatcattatcactgacatctaggatataagcacctgtctttactaatcagacttagtaagacattttggtatgtgttgagaaacagtaatattgaacatataaccttacagatggaattacattttggatttaactatcctgacatctttttctttaactctcctaattgatttccattatgttgaaatccaagtccatcctttgaaatgttagcgggaagactgaggattgaaatgtgtagatagaaaaatcacagaatttaacttaaagtacatgaaaaaattccaatgaaattataaccattaatatccttaatacataaaatattcatacaaatcaataataaagaatccccatgactgcaataaataaataagtaaaggtccaaaataaataatttgtaaaaaaaaaaaaaagtttaaaatgttaaatcccagtagcaatcaaatacatataattcaattcaaaacactgaaatgacacttgtastcttttaaattagtgattttaaaaaaacaaaacaacaaaaaaacagaatattggtaagagagcaatgaaaaatgagttttcatacactgtgggaaaataatttggtaccaactatttaaaaagcaatttggcaatactgtatacatcaagagctacaaaattaccctttgactaattttacttctcataaattatcctgaaaaaaattcaaatatctggaaaagctttagttcaaagctaatcattacaatgttatttgtaatgttaaatatcagaaataaatgaaaattactaaaattgaaaaacagttaaagtttacttcatccttaaaaggaatatttcacagagaatacaaatagaaatacagagagactgtgaaatagcacagataaatgtctaagctttaatgtaaaatgaagaatatacatatgtaatggatcaactataagaaacttaaaaatatgattaagaaagaaagattaaacaaaaataccaaaatttcaacaaagattatctcttgttaatggggtttgactatttcttttctgtgtttcccaaatttttatgatgaatgtgatttattctattttaagagggaaagaaaatttttttatgaagaaaaattgaattaaaataaatttttatggggctgaagaaaaggcctctataaatgtgacttgattgggaagcttgtgaattttttctgtaggaactgagtatttatgatctttttttttttgagatggagtctcactctgttgcccaggctggagtgtggtggtgtgatctcggctcactgcaacctccgcctcccgggttcaagcggttcttctgcctcagcctcacaagtagctgggactacaggtgtgtgccaccacacctggctaatttttgtacttttagtagagacaggatttcaccatattggccaagatggtctcaatcgcctgacttcatgatctgcccacctcagcctcccaaaatgctgggattacaggcatgaggcaccgctcctggcctatgatcattttatatggactgatttaaaatctgttttgaagccaggtgcagtggctcacgcctgtaatcccagaactttgggaggctgaggtgggataattgcttgagcccaggagttcgagactacccaggacaacatagggaaattctgtctctataaaaaataaaaatacatttaaaaaatcaaataaaatctgttttgaatagccatcaaaaacaacttctcctacactaacatttaagagcgtgaaaggtggcaagaaaagttctatcatagcttagatcctaaactattctacgcaagtttttgatgggctctaacatgttaatagcatatatgtaacactaattacaaagaaacctcatttcttcattgaaaaggttatcagtttaatgcagtgaaatctgactatgtgagtgtgagtatatacagttgtgctaatatcagtttgtagtcgttcaaggctaatcttcccactccagaggaaatttttttatcatatatgcatacattgctgcactgaataatgggaacctaaaataaaaaagatcattgcctattttatatgctccataaaattcactgacagtaaccaccaacatcccaggtatcgtctgcagtttagaatcctgaatattttccccaaaaatgtccgataagggaagcaatttaagcaaggcagacagtgctgctaacagagaccatacagtttcagccagcgagtctgctgactgaaatgaagtccttggacctgtggtttttttgtggggttatttgctcttgtagaataaggctctcagaatttcaataaaagggtgaaaacagttttgaaactgagaagactgttacactgcctaagaggaatagaggtgtgattgagatgtggtgaaagaatctgaaagttgagttgtttttttttaagtctcttcccgtgtctatgtcctgccatttcttagatttatacaaacccgacccaaaaaagggtgtcaggggcttgaatccagcaggcactctcatacaggtctgttataccacttcaccttttatagtcagtcgacaggacagggggaattacttagtatacaaagaagtgcaagggaaataaaacctatgcaaatcacatttgtagccttctaaatatttgacctatatgaaaaattccagctttgatttcttagtccaaattgcaaatcagccaaacgtagctgattctgtcctatatgaattggttattactgtctttccctttcttagaacccctgggaacaaacaagaaaaagtaaggaaaacaaaatacttattaaaatgtaaatacagtggctggttccctgatatgttatgctgacaacccttgctggcaacccaggaggacccaggtgcaccaggaaccgacttatctggtcacagaacatcgggggctggaaattgacagcctctgaagggggccttttgttacttgacttctgtggcaggttgctggctcattctcctgcatggaagagttgaaactcgtctttcaactaaatggagtacatgagggcagagattcttttttggtttggcaacccaagtatattaggaaaaaataggcactgcaaaatagcaggaaagcatgaagaatgctttatgaagaaacataaaagaaaaccagaggaaagcatattcagcctcagtcattaaaaagcacactactgttcccagtcttgccttctccaaaagtttgtttgtttgaagtttcttctgcagaactctaagcaggtctccaatataccgacatctttaacagcattctggaatgagaggagtgtctattaagggagacatactcctctatttcatttggaattttacacaacagttttctgtgtggcttaatttttggcatcaaattgttttaacagaagctgtgcttttcagttagatctttatctttgagttctagtgtcctcccacgatgcccctaggagcctatcaaagcaggccaaccctgcagaaatgcctagaataaaataacatgcaaatgccactaagaacttgcttccctcctgactcatattttagtttctataaagtgtctgttttcaaaactgacagtgtctgtagcctgttaatggaagataatgatttgcacaccaaaatgggagtaatcacagggctatttgacactgtccttagaaaaattccttacttactcaaaagccaaagcaaagaactatttctaaaatgacaaatgtgtgtaaattttcaaagtggattgtgatttcacccaggaaaacacaggcagccagaacacagttatgctttagtgtatatggtgatctaattcttgaaataaaactttattctgggcaatagcatgcatttctagatgagaggagaaattgttattgctcataataaaggacgaaatgtttttcttatttgggaacttcagggggatgaagtaaggaagtgggctgcagaacactgggataaatcttatttatttaacatttaatgctatagtctgttaggaaacaaactcactgcggtataattatttaatactggacagtaaaatcatctgctaagattagattaagtagttgactcaaagtactccccaggttcaaggctcaaaaatgaataaatcaacatgcttactgtacagagcccttgaacattatgtgtgctgggatggtggcttcctgaactatcgcctcttgtttgggtctgttgtgaagtcaaggcttgaggacatgacctgacctctttatttaaaaaaaaaatccatttaatatcagttatcacttgaagaatttaaagacagaattatttgctcagaaaaatttgatgctttgtgctattaaacmctcagtacacagaaatagatttaagcaacatggtggtgaatcaagccaaggagagctgggaagctggaattgatggctcagtattctctgtaataatgtgtcaatttatgcctggacattttaggatgtctgtttatacaaatgtgaacaaatgtacctttgacttgtagccagggtgaacccagtgccaaaagaatagctcttctcttagactgggtttctcatttttttcagttttgtgactggcctagggtgtattttccttattggagccttgtgttgttgtcaccttcatccatgccaggttctcataggactaatccccaaggaagtcatccccagtctactgggcacactgagggaatccacgtgtacaatggaggcttaagctgtgagctttgctatcaggagaacctggctttaagtcctgtttctgcccattattatatatgtgaccataagtgagttgcttaacctctctaagcctcagcttcctgatccatacaacaggaaaagtactagtacctgcatcctgtgttactgtgaggttcaaaaagtaaaggaactaatgcacataaagtgtttagcatattgcctggcacaggatagggactccataaatgccagctttctttatacaaagaaaaacgtctttgccctttagttaatgttctcctgtccatgtcaaggtcagcatgacaccatggtagtctgtctagcttgtatttgtgtctgctgctcacataattgtttcttcacttgctgacctggttggctgaagttttggccatgggccaccctgtctgtgccccctggctttggatcccatctcgtcctatccacaatgtcaggagcaaagccacttctttacatacgtggcagaatccagccagacactctgcatcagcaacgtctccacagccagttgcttggtcttcagcctgtcaggcgctgagcacttgttctccatctgaaccagctctgtgctggcctctagcaattataatgcacctgctgatgcctcagagagccaggccagactgacactttcctctcggtattctttaattctatgcttgaccagttccagcattctttcttcttggtcccagacactttccacctcatctcctacatgtcacatctgatttgtccttattgtagaaggtaggtgtaaggcctaaagagtgagtgtggtttgttgtcagctgctccaaatggggcagcattggcaggaggtgcaggaactgatagaataagatttctatatcttttcttgagtttgtgacagtgctgtttatggtcaccagtttttatttgaggaattatccatttatgcaaaaaatgttttttattctatatatcctttaaaaagacatacaggttgccctctggaaatgagtcttaagcatgtctatagtatagctatatcatccacatcttgagtcattttgctcagtggattttcttaattctcaattaatttgtattctgtcagacagtctagtgagggagtaacgagtggtaagttagaaggtgacaattttatccgaggtctgtgcatagggtacagtggaagaatggagacggtgatgcctcatggcctcagcttacagtgtgatttgtacattttctgtgatttctataagtaacaggctgacagtgttggatttgctgtgttgtgctttgtatctacctttgtactgcctcttttttcccctcccacgctgactttatctcattccttgttttccttgagaagattgcactggaaaacttgaagaggggttagaaggtggggccatagtagataccagtaggaagacttcagaacagaccctgtcccctgctgtgatgatgccttgtgacttaacactgatgaccttacatggaggatttagtgaaagttatattagaaagcaattcagttacttccagattgttattgaagtccagcctctgtggtctayctatgccattagtatttgtcctaggttatttttgctttcgtatgtcagagaatggtctcaacgtaagggggtctgagtcagggtggtctagttgaaaaggtatgggcattggagtaaaaatataaaaaatctggattcatatccagcctctagcactgaatagctctgtgacattgtgcaaattgcttacattcttttaacttttgtttccttatctgtaacttggggatccagatataataatactgtcaggtattatagaattattgtgaaaattaaatgagataatgtctggaaagaacttagcacagcgtctggcatagtgttaagtacccagtaaatcctgattctttctctcccccagcctcactgcctcaccagctgcccagctgtctctaaacacagcatcagtggaactgtaaatactttcacagttatgtaatcgctctccacaaattcactctttgatcacctttctgccctccctccagatctattcctaaactcaattttgactctccctctggtataatctccttctctctgcagagaacagtaagaccttaatgtttaaaaaaatcatttcttcttaaaacttaaaggccctaaaacatcattttgagtttttgtctccagcagggtttatttctgacaacaaaattaatatatttatatttaatatttggagcttttattttacaatcatcttgacagtaatatttttctgatatttgaaaagccccatgatttttctgtgcagagaatgcattttgttaatttatctaagtggctgctaggcttttaaggttttaggttcattttttatttttctggagctcagtcccctaaaatgcaaatgagtcttgagcagctcttccagaagataaattattcttcttttctgtctcctactgttcaaagttagtgataatttttagacccagcagttgaagattttgacattcctgttgatataaatgtggacattccaatgttgttcaacttctgactgtcttagggactgattgcttatctctatcagccaagaaaatgccctttgcattggtctcatctctcacccacaccaaccaaacacatatatgcaatctaatgtctataggtcacattcttgccactttatctctttaaaattggatagttttagatggaatttgcaggtgctaatatggaccactgggtaacagggatagatacagtagcattgttagattatattctctaagttgagatttttcacctaaaaagagacagaagaagatggaggttgcacagtactggtcagatcttcccatgcagtttatcttttggaagggcaacagtataaagcagttaagagcattaattggacattaggcagtcctaggtttgaatcctggctctgacacttattggctgtataatactggtcaagtgacttaatttctctacctctcagttttattatttgtgaaacaggatgacaatattacttgctttgcagaattaaatgaggtaatattttgaaaattatatgagctattatctaaaaacatttagcacagtgactggcacagcayagagtgcccagtcaatcttggtcccttctccccagttttgccctgaatgttggccagctttgctgcagatgctttctccactatgccattactctcatccaatcctttcctttattagctttcttccctagccctcacttcttctcttggacccagtgtgcgcgctctctctctccagaaaaataataattttaaaaaaatcagttcttcacatgaatgcaaaacacctactacaatgatgtgggtgatggtgatgatgataagaataatgtgggaactttttaccctttttgtcctctggattgtaagtttcatgagttcaaagataatgatttcttcagcaccaaatgccttggttcctggaccaggaatagttggtgaatggatgaatctgatattcagagttgcaatgattgcggcatttaatcttttttatttctgcacagttaatccaaatgagtatttattgatttgtatatatatttactacttctattgcaaaattttagtttcttcttttatgaaatagaattcttaaatgcatgcttgtgcatccaagaaggacagtgatgatgtgtttcaatgtattaaatgttgaaatttaaatgttggggcatgttcttgaaatggtgactacacaggggaaaaaaatttaatagattggttttaaggtttgaggacgggggtcctgggaaagtgctgagaatggaggcatagcattccttcccacactcagcacataactctgcatggatttggtttcatttcaaaaacggagtgttcacagactgaatacacctctgtacacttgaccctaggagggcagcagataaacttggggagtcttttttagacaatattcccctgaggttttaagtaaatttttacaagctcctagaaatacttttaagaatctatataaaatttctcccttaccttaacagcttttacttagaagatatatcaaaatgaccccaaaaagcaaaagctctataaggtcagctaatccattaccttagcaatgtgaggtgcataaaatgtgaaccactgaaatttcatgtaaacacctcgcagtttgctctaaattttcttttatctcaaggatgcaaatgtgtcttgtgcttcccataattgaagaatgaaaatgtttgagataaatagcccttcccctgagaggccaaatactttccttgaagaaatgccagtcctatgtccctgtgggtagggttcagtatttgtagagtcrccaattataatggcccagatctaataggaactcaaggattccagcctatttccacctaccccacctgcccaagaccagccttatttccaggctttactctcccttaggcatatgtggtggcaggcacctgtaaccccagctactcaagaggctgaggcaggagaatcgcttgaacctggggggcagaggttgcagaaagccgagaccatgccacagcactccaggctgggcaacagagcaagactccatctcaaaaaacaagtaataacaataataataataataatattaatgatttaatgttcaaaaatatcctatgtccaaaagttctttttataaatctgatccatatcgctattgttgcagcttaaaattctgttacacgtggtaatacatacattaacaaatacgtatagggctccttgatttaccaggggctgtgtgtgaaaactacattaatcataattaactgccaaatggttagaacagaaaataacagctttgaagtccagagaaaggagagagtggagcaggaggaattggagctggatcttgtaagatagttgagatatgcataagttgagagaaaaagaaaggacaaaccagatggcataaatggtgtgaggaaaatcacagaaatggaaagaaagtgaggaggccaatttacatggaaatgaggcttttggaaaagggagtagttggaggtaactcttggaggcagatcggaatctatctacatagggccttgaatgctatactaaagaggatggtctatcccatagaccagtggtgtccaaagttaggaagtgtgtaggaaaatacatttgtatatagaaaaagatgtattctttatatagaaaaagaaatatattttactaataatttcttgtattgacaatgttgtatatgtgtcatttatatgtaaatatgctatgtggtgatccacactcaaaattgttttattgatagagatacatgttcaaaagaggttggaggcagatgactgctataggtgataagggatgattaaaggttttcatgcagccagtgacatgttcaaagcagtattctaagaagatgaatctggcagcagttataccgagaggattggtggaagcagttagttggcgattgcaacaattcaaagggcttaaattatgatagccacagtaggaatgtaaaggagggggagagttccagggatgttcggataatcttattatttgcatggtgagattttcctttagcaagagtattcagcaatctctttgggggctgagaatagagcagtgctcaagaaggtgagtttttgtttgaaactgatttcaaaagtgggttagtggtcaggcgcagtggctcacacctgtaatcccagcaatttgggaggccgaggcgggcagatcacttgaggtcaggagttcaagacaagcctggcaaacatgacaaagccccatctctactaaaaatataaaactagctgggcatggtgacaaatgcctgtaatctctggaggcagaggcatgagaatcacttgaacccaggagtcggaggttgcagtgagctgagattgcgccactgtacaccaacctgggtgacagagggagactccatctcaaaaaaaaaaaaaaaaaaggattagtactaccccaaatgtactatggtctgaaaacctaaacttaaatgtgaccaataattaaaaattacattaattactggtcaaaaacaatataggattaatcctttaattgagtatagataacttcataactaattttatacacaaggaaaatctttgaaaatgtagataacatcttctccaccataatcataaaaaggagcatgataacagaagtagcttaataatggttcctgcattatattaaaaaaaacttatgcttcatatttgctgtttggtgttgaaaagggatcccagaaattttctcatctcagttgcttgttggagatgcattacttttttataatacatgattcaagtacaaacagttgtttttcctcacacagcttgatcttcacaaaaaataaaatttawaaaaccattttggtaaatgtaaatttgtaaaaggaggttttggtacttgtacttgatttaccatcattttctttaaaattgtactgttgtttaacttctcaccagttgatgtttttgtaaggtagaactcttaacaaaagtgtgattcagagttcaaatctattattagccaggcttctcaatttctccttgcacataaaaacatggtaaataatgatagagaaaaagaaatagcatgtttgaaaatgccaactagatcaggcttgtgattcctacatgatactagcattatcttagacatgtgttgataaaagagccctactatcaggcaatttaaattaaaaaaaaaaacaaattcacatattttaactcttgccaggcatcggatataaacttaacaattatctcaatcaaggtaaaatagactatagattgtgtgtgcatatgtgtgaaaatgaacagaatatagtgtagaaaaatagatacaatatgacacataaaaaagaagataagattttaaagttctacattaagcaaaagtaacttttctcaggcattgctggtagaaatataaattggtaacctttctttagggcattggtggcatgtgtcaagagccttaagaatgtttatactgtttaaactcagttctatatttctatttttaagaacttgtcccaagaataaaatccttaaatgcccaataataagggagtagctaaaataagtgaagaaccatttttgaacattattgattataataaggaccatatgtgccctgactttaagtggaaagggcagtagaaaactactattgtttacatacatttataatttttgtacgtacatatttgtatacatacatttgtttacaaaaaatgtaaagaagtataacaatattcttacaagttgttttggtttctaattttttgtttctctcaattttaaattttaaaaaagatatgttgctatatattgtatttatattcagaaaaattatcaaaataattttaaaaataaaataattaaagagagctcccagagtttaaaatgtaaatacctatcatttaattcagttagctgatggaaaattttggtgaccattacatatttatttaatgacttagtcaacaagagctgttgatgtattaaattttgagtagacccagctgtgctacaaaagtaggtaatgtaatggcaactaaagcaaatgtcaaagctgaagcacatttaattatcttggctactggggtgttttaacctgtgttacttgtgctttggtctcacaaaaatggcatcttttaccaactttctaaactgagtaggcaatgcatgctttagattaaatgaaaaggtggtcccttttatttatatttatacaaatatattcattcagtcaatcaaataaacaaacatttattcagcaattgtcaaatgtcaggtattgggccagattatgaaaaagggaaatgagtatcagaaaattaatggtctaatgggaagatcaacatttaagggtggctgaaaatgaaaatagagttatgcatgcagttctagaggaacattgagaaaggggcagccaactctgcctttgagttaggggagccttcccagagaaagtattatagagataggctttgttcaatgaataggagtttcctagatggaaaaggtgaagaggtattctagataggaagaagagcatatacaaaatgtcaaaactctgagataacatggcctgttcagggactggtaggaaatatggtatagctagagcttaggatgagaagcagaagcagatcatgatggcagaccagaagcaagactagattgcagctgtcactcggatggacagaacagtgtgtggagacttgcattgtgaacttttactcaacaatgactgcaggaatacattaggaaagccaagagaacccatagaccctctgaaggaagcagattactcctgcaggacctgggagacaccccaaatactgtaagacaccccaaaaaactgtagaagtgggaaaaggagatcatctgcccctgaacatatatccccactggagagggaacctgaagttctagagtacgggagaagattccgaccttacatgcagctgagtcaatgtagagggccgagcaaaatatggggttagaggaagcaggagaaaagtccctgtgggctcgctggctcccctagcaagccacttctgcctcacctcacaggggtccttgaggaggggtgctagaggcactgggaaaaggccacagggagaaggaaacctccagctgaactttgtaacaatttgagctgatcaaaaagtctcctggccagaactggggggagggcatgaatccagtgtgcagactccacaggcaagggaagaaggaaagccctacttacttttgcagctgggaggcaagtagcctggggcaagttctcagccctgctcacccaccacctggaaacagacttggtgctgttgggaggggcacagtgagagtgagatcagccctttgggttgcctgggagctggatgaggcctgtgactgccggctttcccctacttccctgacaacctgcattacacagcagagagagccataatccttctaggaacataactccattgacctagaaacttcaaccccatcctccacagcagccatagcaagagtctgacatgcctagccctgcccccacctggtggtccttccctacataccctggtggctgaagacaaagggcatatactcttggcagttctagggacccacccaccacctgttcctccccatattaccacagatgatgctctcttgaatgtgccacctcccagcaggaggataaccagcycaaaaatagtgcactaatcaatcaaagctaaggtatcctcacagagtccatttcacctccttgccgcctccaccagagcagatgctaatatccatggctgagagacccatagacagttcatcacaggactctgtgcagatgaccccagtaccagcccagacctggtagacttgctgggaggctagatccagaagagagataacaatcactacagctcagctcttaggaagccacatccctaggaaaagggggagagtactacatcaaggaaacaccctgtgagacaaaaggaactgaacaccagcgttgagccttagaccttccctctgacagagctgacccaaatgagaaggaaccagaaaaccaactctggtaatataacaaaacagcgttctttaacatccccccaaaaaatcacactagctcaccaacaatggatccaaaccaagaagaaatccctgatctacctgaaaaagaattcagaaggttagttgttaagctaatcagggaggtaccagagagaaacaaagcccagtgtaaggaaatccaaaaaaatgatacaagaagtgaagggagaaatattcagtgaaatagatagcataaataaaaaacaatcaaaacttcaggaaacaatggacacacttatagaaatgcaaaatgctctggaaagtctcagcaatagaattgaacaagcaaaagaaagaacttcagagcttgaagacaaagttttcgaattaagcaaagacaaagaaaaaagaataagaaaatataaacaaagcctccaagaagtctgggattatgttaaactacaaaacctaagaataattggcattgctgaggaagaagagaaatctaaaagtttggaaaatatatttagaggaataattgaggaaaacttccccagccttggtaaagaactagtcatccaaatacaagaaactcaaagaacactgggaaattcatcacaaaaagatcaccacctaggcacattgtcctcaggttatctaaagttaagatgaaggaaagaatcttaacagctgtgaggcaaaaacaccaggtaaactataaaggaaaacctatcagattaacagcagatttctgagcagaaaccctgcaagctagaagggattggggccctatcttcagccccctcaaaacattttatcagccaagaattttgtacccggcgaaattaagcttcataaatgaaagaaagatacagcctttttcagacaaacaaatgctgagagaatttgccactaccaagccaccactacaagaaccgctaaaaggagctctaaatcttgaaacaaatcctggaaacacatcaaaacagaacctctttaaagcataaatcacacaaaaatacaatttaaaaacaaaaagcaaaaaaccaaagtatacaggcaacaaatagcatgatgaatggaatggtacctcacacctcaatactaatgatgaatgtaaatggcctaaatgctccacttaaaagatacagaaatgcagaatggataagaattcaccaaccatctgctgccttcagagacacacctaacacttaagtgctcacataaacttaaggtaaacggatagaaaaagagattccatgcaaatggacatgaaagtgagcaggagtagctattcttttwtcagacaaaacaaactttaaggctctagcagttaaaaaagacagagggtcattatataatgataaaaggccttgtccaacaggaaaatatcacaattctaaatatatatgcacctaacactggagctcccaaatttataaaacaattagtaattgacctgagaagtaagatagacagcaccacagtaatagtgggggacttcagtactctactgacagcactagacagttcatcaacacagaaagtcaacaaagaaacaatggatttaaactacaccctggaataaatagacttaacagatatttacagaacattctacccaagaactgcagaatatacatattctattcatcagcacatggaactttctccaagatagaccatatgataggccacaaaacgagtcytgataaattcaagaaaattgaaattatatcaagtactctctcagaccacagtggaataaaactggaaatcaactccagaaggaaccttcaaaaccaggcaaatacatggaaattaaataaactgctcctgaatgatcattgggtcaaaattgaaatcaagatgaaaattaaaaaattctttgaactgagtgacagtagtgacataacctatcaaaacctctgggatacaacaaacgcggtgctaagaggaaagttcatagcattaaatgcctacatcaaaaagtctgaaagagcacaaattgagattctaaggtcacatctcaaggaactagagaaacaaaaacaaaccaaacccaaacccagcagaagaaaggaaataactaagatcagagcataactaaatgaaattgaaacaagaaaatacaaaagataaatgaaacaaaaagctggttttttggaaagatagataaaattgatagaccattagcaagattaamcaaggaaagaagagagaaaagcaacataagctcaattagaaatgaaagggacatattacaactgacaccacagaaatgcaaaaggtcattcaagggtactatgaacacctttatgtgcataaactagaaaacctacaggagatggatacattcctgaaaagatacaaccttcctagcttagatcggaaagaattagatattctgaacagaccaaaaacaagcagcaagattgaaatgataattaaaaaattaccaacaaaaaaagcccaacaccagatggattcacccagaattctaccagacattcaaagaagaattggtaccaattctattgacactattccacaagatagagaaaaagggaacagtccctaaatcattctataaagccagtaccaccctaataccaaaaccaggaaaggacataaccaaaaaagaaaactaaagaccaatatccctggtgaatatagatgctaaaatccttaataaaatactagctaaccaaatccaacaacgtatcaaaaagataatccaccatgatcaagtgggtttcataccagggacgcaggaatggtttaacatacacaagtcaataaatgtgatacaccacataagcagaatcaaaaacaaaaattacatgatcatctcaatagatgcagaaaaagcattccacaaaatctagcttccctttatgattaaaactctcagcaaaatcggcatataagggacatacctcaatgtaatgaaagccatctatgacaaacccacagccaacataatactgaatggggaaaagttgaaagcattccctctgagaactgggacaagacaaggatgcccactctcaccactcctcttcaacatagaactggaagtcctagccagagcagtcagacaagagaaagaaataaagggcatccaaattgggactcccgctgtctgctgatgatatgattgtttgcctagaaaaccctaaagactcctccagaaagctcctagaactgatacaagaattcagaaaagtttccggatacaaaattaacgtacagaaatcagtaggtcttctatataccaatagygaccaaactgagaatcaaatcaagaactcaaccccttttaaaatagctgcaaaaagataatataataaaatacttaggaatatacctaaccaaggatgtgaaagacttgaacaaggatacaaaacactgctgaaagaaatcatagacaacgcaaacaaatggaaacacatcccatgcttgtgaataggtagaatcaatattgtgaaaatgaccatactgccaaaagcaatctataaattcagtgcaattcctatcaaaataccaccatcattcttcacagaatttaaaagcaaacaaacaaacaaacaaaaccagtcctaaaatacatacagaaccaaaaaaagagcccacatagctgaagcgagactaagcaagaagaataaatctggaggtgtcacattacctgattacaaaccatattataaggccatagtcaccaaaacagcatggtactgacatgaaattaggcacatagaccaatggaacagaatagagaacccagaaataaacccaaatacttacagccaactgatcttcaacaaagccaacaaaaacgtaaagttgggaaaggacaccctattcaacaaatggtgctgggataattggcaagccacatgtaggagaatgaaactggatcctcatctctcaccttatacaaaaatcaactcaagatggatcaaggatttaaatctaagacctgaaactataaaaattccagaagataacattggaaaaacccttctagacattggcttaggcaaggatttcatgatcaacaacccaaaagtaaatgcaataaaaacaaagataaatactgggatttaattaaacttaagagattttgcgtggcaaaaggaacagtcagcagagttaacagacaacccagagtgggagaacatcttcacaatctatacatctgacaaaggactaatatccagaatctacagtgaactcaaacaaatcagcaagaaaataaacaatcccatcaaaaagtgggctaaagacatgaatagacaattctcaaaagaagatatacaaatggccaacaaacatatgaaaaaatgctcaacatcactaatgatcagggaaatgcaaatcaaaaccacaatgcgatactaccttactcccgcaagaatgaccataatcaaaaaatcaaaaaataattgatgttggcagggatgcagtgaatagggaacacttctgcactgctggtgggaatgtaaactagtacaaccactatggaaaacagtggggagattccttaaagaactaaaagtagaactaccatttgatccagcaatcccaccactggctacgtacccagtggaaaagaagtcattaaatgaaaaagatacttgcacacacgtttatagcagcacaatttgcaattccaaaaacatatatatatactgtatatagtatatatatacagtatatatatactatatatagtatatatatacagtatatatahagtatatatatacagtatatatacagtatatatactgtatatatagaaactgtagtgtatatatatacactatgtatatactatatatatacacactatatatatatatactatatatgttactcaaccataaaaacgaatgaattaatggcattcgcagtgacctggatgagactggagactattattctaagtgaagtaattcaggaatggaaaaacaaacattgtatgttctcactcatatgtgggagccaagctatgaggatgcaaaggcataagaaagacacaatggactttggggactcagagggaaagggtgggaaggagttgagggataaaagaccacaaattgggtgcagtgtatactgctcaggtgatgggtgcaccaaaatctcacaaatcaccaccaaagaacttactcatgtaaccaaacaccacctgtaccccaataacctatggaaataaaaaaataaaaaatataataagcagaagcagaggatgagagtggaaaactgggctaggccagaaatggcctttatgcacttggagtcataatgtttctgcttcaccaatgattaacagtgattttcctggctaatagaatcttaatcattataatgaggtaggactgttgcctttgaattatggaaattatagctgttaagacctgttccacaaacacaggttatacatattatcacatctctttaatcttctttacagttaatcacccaagtctccacrgggcttattagcaggaaggctattatctcctcttgagatccctcccactgcccctgaattgtccatgaatcctgactttactcaggccaaatgggtcagtcctcctgcagaagcccatagctggatctgtctgtgactgctgccctctctggtgtctgctatatggcaccatttgcacatccgtgtcacagggtacccattttgggtgacaaggttacaactctctttgtttacatttccatcctcagccattgttccctaaatcataaccactgtgccaggctggctggtctggaggcgcttctggagttggcctcatgctagtctgaaattagtccttctcctagaatctgaggccattttgttgagcccagatcaacagcccagattccgcccttctttaggatcactttatttccatggcttccaggaccttccctgctccgggaccttagtcagtgtcatcctgacccaatagatctctcatccccggcctccagttcgaggaaacggggatgaagacactagggcttccctccagaaggccctgggctcctttttccacacagattctcctcctgccaagtgtgcagattgtttctcggggtggctcaaaaggtagcagtttgcaagatggagtttaaaaaacagtttgttgccctgccctaatgctcccccaaaatgcctaattgctttatatttacataactaagaaagacaccaagggattcttccaaaaacaaagatcttcttcaaggtgatcttctgttctgcctttaaagagaagtagttgcagtttacttcactaaaataattaatttttgtctaaccatgtccctattttatcagtgataatgtgctcataaattatacgacagattatgtaatttgcccaaagcagaaagaggtctcagaccccaaacccatgcatttaaccactctgctttactacctcttgtcattcaattcacatgctaccatgtcattatttacttttatgtctcggatactgtactcttattagttaagtttattgcaggaatataaatctctttaagtgtaggcactctcttctgggctgttgctgaaagagagtgggacaacaggtgtatttgtgaactagtagaaaatgagtatatttactgcagaaggaagttgtgttttctctgcaaagttagatcacagaagggagaatgatacttatctatagttctggagggttgaaaccgaatagtaaatgggtgttaggatcaatacatattgttaagaaacagtgttctataaatttcatgatttaggaaagctgtctacaaagctggattaatctttttctgctgagggccaagtttactttgctctgcccctctctgtgcaagtgtaagacagtcaactgacctttcagattatcagcttaatgatagttctctctcagaattctttaaatttaagaataatgaaaaaaaagtccaaagagatctttttcatcatttctcttctccctattattattactctcctcaatgaaatgaaaatgaaatgcctgtgtatcctatttcataaaccaaaaccaagttctgacacattattggaagtttatgttgctttagaggaaaaccatgttggctataaactgttgcattatctggaaatcatactgtagattccaggaggtcaaggcgtctctggcaacttctatatatttataggagaaccgactgcctctcctctaacaaaacctcaatgagacctgactcctagccagctaagactcggcatggtcctccctgcgtcttcaaattctaggactttccctcatgtgcttgccttggactggagctgcaagctaccaagccagtgccagactgggggccaggcttacagcagagcttccacttaccccaaatctgccacagaattaattccctacgtttgacctcatattactttgttttgttactatcattgttactgctttagtattgttgttgtcgttgctttcctgtatatatttaagacttgtggcttttaaaactagtttggatttaagatacacaataagttctatcatttgaaaatgataaatatagatgtccttacatcaattgtcttcagatttcggatatatttagccttttgactttatccaaaaactaaacattctgattggccctcattttaaaagggaagaacctgtttctatttatttagatttgtatatgctctatattgggatgagggagctttttgtactgaaagaagttatgtattttcctacaggttagataaaatctgtgttttcccttggctaggtttatgcatgctgtataaacaaaggtgttctggggctcctaaggaagcggtctgaggaccatgtgtctcacctagttctcccacatgctctccctggtgactgttggcactgaccagaaaggtctagagtggtggagagagaagctaataaacaattcttgaaaacctactatgtgccaggactatgcttgatatacatttgctttgttttatttaactttcataacaatcccagcaggcaattaccattttccttattatatagatgaagagattaggtattataattaatctaatctcacagagccagaagtggcagagccaggagtaaaacacagctcagactccacagccaatgcctttctgtaccctacaccgtccatcatggatttaggtagcctggggacctgaactccccactaggtttaaggtctaattctygaatgaaacctcacgcatttctcttaggttcagggacaatcagattgtcagagtagaaagagactttggattcaacatttgctaacccactggcttcctaacttcttcctaaggccttcactctgtgaagtaggtgctagggttccctgctaatgagtactaagcttctcaagggcttgagcaggcttgttagtctttttagggccagctgtgcaccaactatgctgttgttgtgttgaggccttagcattcctcacttcaaatcaattacttctttattaccttaatacatcactggccatgtggctgatttggaatgtaaaggagactaaccctgtaggataataactttcacttggcacacaaaatctatacggatattcagagcatttgcttttaaaaaatgaatattctgtagcctgtgctgcctgtttattcttatttagagaatttcgtcattttaataatttggtaatattttactggtaggtgcggagatatgtaaaaaaaagtgtatttttttcttttcttgtggatttaaaaaatgtttagaatttttatttgcagcctataaacaataatagtactttatcctttcttatttttgcctatattacaagcaagtaatttcatttaaattgactttaagcacattcctttgaaagaaaccgaagattgttatctttggcaatcctgattagatttcttcctcagacaacagtttattaagtttgtgctatgaatgtgggcaggtggtttgactcggtggagcaagtagtgggcactctagaattctttttctccaagtactcaaaggcctttggaagaatttcctctctgagcatttagatgttccttctactctgtgaggtgaaagtgtgttatgtggttttatttttcacttattgaatgccaattacatgccagccccagggttgtcttacatgtgttatcatatctcatttaatctgaaaaaggattatggcataggcacataatattatcttcatctttcagataaagaggcataagttcaggtaaatacatatcccagtagttacacagctagtgcctaatgatagcaggatttaccagatctgtctgcctttttcaaatataacaccttgcctgggaatgagctagcagaagacttttagaagatgagactggagaagtggcttcaaatttcattctaatcaagacactaagctttgcatttatttattccttcattaccatttattgggcacctaatgtgtgtcaaacaatctaggaattggcgacattacaatgaataaaaagcatagatccctgtcttccagaagtttacttctggttattggaggttttgagccaagaaatgacatgatctggcttagcttttacaaagaccctcctggctacagtgtgaagcatcacctgaagagaggtgagggcttcagcagcaagcccagttaggaggccactgcagcaatccagacaactgcggggcttggaccacagtagtggccaagatgagaatttggattttatatggacttagatggaaacaccaatgggattgctgaggaactgaatgtagaaattgcttgtccatgttttaactgcaactatggtcagcctgcatcctaaacctatgctttttaagttatgttaacatgctgaagtacaaagtgacttcacaactatattcaatttcatgaaaaactgtagctcctccttttcagctccttaggcttaggaaaggagagtgcctcttggagcctggaagaggcaggagagagctctgtgtcccagaagcatttgtcatccaggctgcagttagccagctggctccttcaaaagccacacacctgggtggcagcacatatgtggttatacctgagatatgtggtgtgtccatctcagagccactcaaagtccattttaacccttccctatggctccccatgaggaggtgggaaaacgaatcctcttaataagatttaagcacagcttcacatttttctgtctttgttatttctcagaaatgccattatcagtctgagtcagaacagatattaattcttggtcacaaagtagcacttttggcatactctcaccatttttttaacttcagaaacagcttccttgtaggtaactttcactgagctgacattgtcagccaaaaatggttctggagccacttcatctgccataaaatttaataagtccaggatacaaatttgtgtatcacaagtcaataaaattgccaccaagctgtttgtgtagtaataaggtcaataaatgtcatcctcattcaattaattttcattgaccttaaggaaatgaccttctatttccaagtaggagaagaaattggccatggagaagcataactgttgcatctgcttttcagttattacattactgaagatagcatgggcatctagctatgcttgtatattcagactaaaaagtaatctacatggcttatcctgaagtagacccaaatgatttaattacaattaagatcattgaaagaccccacaatatgcttggggtcatcctaactgcatcttccagatatgatctaatatctcactgatcttggccatccattgggttctgctgggcaggatatcaagttaaggatgtgatgagaggctctcactttctggcctgcaaactgcatttgtcacaacccctttctccattaacctggcctggagatcagccctgaagttgctcctttgctgtgctggccataccctgaaggagacaaccacaccagtgagagttgaatgcctctgatttcctccttcctccacaaggcagatgagggaccctgccatttttttataaaattcaaaatcaactaaagtatcacttttttattttattattttcccagggctgcgtccaaagaggactctgcggctggtgctctggactgcagaagaacaaggtggagttggtgccttccagtattatcagttacacaaggtaaaaacccagctgtggattgctaagcatttgtacatgtaatatacaaaaatccctctcattgtccatttaagacttcaataatactttctggtcaactggccctaggaaacacccttgtatgagccttctccctccagccctgtgaatgagaatgcactggtaaaccaatgatgctgtggtgtagagctgagggcttttcttcttctacaccacagtctgaggccaaagaaaaattccaattgccatgctgccatttttttcaagtctacctagttctgctgtattcatgtatgtcagagaaatagttataggcaaacattccctctccccaccgagcctatccccatacctcaatgcccgccatattcccagaagccttggcatttgagagccaggttccaagtcattgagtctgccaagagcattgccatgatggtggtggaaatggcagcagccacaggcctctgtcccaggaatgtggaggacagcttggtttgacaccagctgtcattacacaagtgtgaagcttgaagcaggaaggttattgtggatggtcatgattagaaatacaagaccacatggaagagaggggatagggagattaatatcaagagcaaattttgagacagcaaaatatacaagctgagaaatactctagatcaagtcaaatgttagttcaaagaggaactccaaaatcaacgcgcatatgctggcaagcagtgatggttgcccagagaggagcatttggtctgctgctgctgctggatggtttcccctgaatgtccagatgagaagaagcagatcttgcaagcttaaattatccaaatcggagaagggtttcttttgtgaattgtgtgtatgttatttttgaccttttttttttttcaaagtcagtctctattaccctatttcagtcagttagagtataatgagttcaaagtcatgaatttggtcactgaatacaattatttactgtacaaaggacaacttatgacctatgccctactctttcaccactttagttcttttggcctcaggtgatcctggggataacataattcaagacaagtgtcctttggttggtaggtcagtaacatcattttctatgtgttgtggtagaccacaacatcatataagggttgttctagattcagcaacattcaattaatattttctgaacatgtactatgttccatacaytatgttatgcattaatgttagcatcaaaaagatctaccctgaccttacaaagcctacattctaaaggacactgacgattaacttgaattataaggtgttaagtctttctgggaaagaaattacatctaagctgagacctgaagactgagtggaagtaagctaaggaaaatggagagggagggaggaggtgrgtactgcaccttggcagagggacctgtgtgtgcaaaggcaggagatgagacagaggaaagcacaccagagaaatggaaaggaattcagagtggctgctgcatagaatgcaagatgcacagtggtaggagggtggaacagagacgtaaacaagagcctgaacaagaagaacatatgaatcatatttagacgtgcggactttatcctcgaggcaagagagtaacttatttttaagaagaagctctaaaattctatacatattggactttatataaaaaaaagaatagttaaaagaactattctttttttttttttttttgagatggagtctcactttgttgcccaggctggagtggagtggcaccatcttggctcactgcaacctccgcctcctgggttcaagtgattctcctgcctcagcctcccaagtagctgggactccaggcgtgtgccaccacgcccagctaattttttgtacttttagtggagatggggtttcaccgtgttagccaggacagtctcgatctcctgaccttgtgatctgcccgcctcggcctcccaaagtgctgggattacaggtgtgagccaccgtgccctcttttattctcagtaatacactctactccaagaaaaatattggatttaaattgcaattgatctggctaaaaattttatcatcactgaaattcctagaatgtgaaaaaagaaggtttatttttctgtaatgtgagtttcactgtagcctatcaaagcacatggatgaaatcggaaatgcctaaaattctgaggttggcagaaatacacacactcaaaggacatgcaatcacataaacagaactactttatcttgacagcatccaggctgcctccatacaaatgtagcttcatgttggtggctagtctgcattgcattttcagagatagaaagaagaaattccagaaagggaaaacattggcattttgttttacagtaactctttacctcgcctttaaaaagacattgtgcatgctttacatgatacagccaatttcaaaggacttattctggattcttatgattagcatattgatattgacattactaagactataatcatttcaaaagtggctgagtttaacttaaaagttaatataataagcaagtcacaaaccacaagggtaaattagattgtctttagacttctctgtggcattactgaatgccagcagacagtccaacaatatccagttcactccagtcacaacagagagatcatctgttccaaataaggttatgctaactgctgaaacaaataataggtcaaatttcaatgacctaacataacccagaaatatattccttgctcacttaacatccaatctacagtagggctctgctttatacaggtattcagtgatccaagctgacataccctttaaaaacatggctttaatatgcctttgagtattgacatccagctggcaggcagggggatagtaggaggtttttatgggacagttctagaagtggctgacgtcatttctactcacactccattggcaagaactagtcatgtagtccaactgtgtgagaggctagggcatacaggcactggctgagcagccacttcccaacaacagctctatactgtaggctgggagcattctatagctatattctctatctttggcagaaagctgacccactctagggtcttcctttcacttcgttctggctttctaaacactttagctgcacaagaggccaactgccctgaggtctttacctcccatggtgctcaaagttgagatcagctctgtgagctgcctaaaagtactcatcttcaccactaccaggatgcctttgtctagcaacacacaaaaagaaaaggagtcacagtctttgaccagaaggaccttacattttacttcaaaaataactttaaatgcacacataagaaagttagtataacaaaccatatataatgaagttttaaataatgtactaaaagtattttatttttatggatgatgctatcattgacaaagtgccaaatggtgtaaaggctgaacagagtaaatggaaaggatttagaaaagggagaaatcactatggcatgttagtcgtgaggaaggaggcaacacctaatccttgcagagcaagtggatttcagccagtgatcaagaggggagagaagggacagcagctcccctttagatggatgataatggagtctcgaggtctgcctttggcattggtgtgggtgataccaaataagaacagaacttttatggcgggggtggggagatctattttagtgattgtagaaataaaaggtgtgaactttttaaatgactctgctaacatttttatgatacagttatggttattagtgatctatgtcaggaatcagaaaattatagctgatggaccaaatccagcctgccacttgtttatgtacagacttcaagctaagaagttttttcatatgtttagctgattatgctacagagattgtatgtggcccacaaaacttaaaatattaactatctgggtctttacagaaaaagcttacctacttctggtctataatgataaaagtcataaaatatcatcacattatttgtatacaatgatctctttctcgtttgtatgacctaaaatataattttgtaaattttgtttcgagcctaatattagcctatgtaagtatattgtaggaagatattattgtaatgataaaagcttgcatgcacaatctttttttttttttgcattcttatctggcagtctttaataataaagttggctaaacctacatggcactagctagggagaaaaacaatacgtagattattatttcttctttttgtttttctgaatgtaacattctttcttccccctcacaaagtcttttcaacagcgaaagttctacaaaggctattttaataataaatcagtttgtggaataatgaattattaatattcattatcctttccttagtaaatatatctttgtttacactgtactctaattaatatatgcagaaaatataaaatagttattttaaattgtgggtaaaatgtattgctgaactaattttcaaaattgtagttggattaaaagctacctttacttcataattatgctttcttatgacatatcagctcaattattataatacgtgctagaatttactaaatttactaaacaatttattaaattataaaggatgtgaggctatttatagcttgtgtatacattttgaaattcatatgcaactttattataatgtctaaaacacttcaaggaaacaaactttggcaaaaatggtctataagcattttagtagcagttactaagtaaataactcaaacaggaagtgttgaatatctcactgtagtactatacactagaatataaatcattcctgagatccattcagcatgcctctaacagttcatagcggaaagtcccataaaagatttctcttcttaagaaaatgcaagttcacatgtttcaataagttgttaaattttctctccttattttaaagtccttttcaccatgtctttgattgtcttggtattagcacataagcttgagaatgacttatatggacagtatattgtttgtgctttatttagaagcttcttttagaagcaactcatttttcttgctgttttattgaagtttaattagcatttggtaaatgcacatatcttaagtacacagcaaaataaatttggaaaatgtatacccctatgtaatcatcccccagatcaaggtatatagcattcctattaccctagtaagtttccttatgtccccttcaaatcaacttctgactctaccaaagacaactactatgctcctttgtaactccagattggttatgtctgttcttaaacttcatataaatggaaccatacagtacataatcctgagtctgacgtctttcactaaacagtatggttttgcagtttatccatgttgttgcattaacagtagtttgtccctttctattttttttttttttttcgagatggagtcgtgctctgtcccccaggctggaatgcagtgtggcacgatctcagctcactgcaacctccgcctcccgggttcaagcgattcttctgcctcagcctcccaagtagctgagactacaggcgtgtgccaccacacccggctaatttttgtatttttagtagagacagggtttcaccatgttggtcaagatggtctcgatctctcgacctcgtgatccacctgcctcggcctcctaaagtgctgggattacaggtgtgagccaccacgcccagccatccctttctattactgggtagttttctattgtgtgaatataccacagtctctttattctccagaacgaatgaagcaagaatattctgttgatggacatgtgagttgtttccagttttagctattataaatgaagttaccatgaacatttatgtacaaatctctgggtggacctatgcatttattttcttttctgggagtataattgctgggtcatatgataggtgatgtttaactttaccagaaactgctgaagaggtgggaagttgtaccattttacatttccaccaacaacatgtgggagtcctagttgctccctatctttcccagtatgtggtatcattagcctttttatttttagccattcttataggtgttatgtgtttwtatttttcaaagtacagttctgaagagttacaagaaaaatcctgactcctctcctaatggccactattcttttgccctccctgcttcttcttgccttaagactttttgtttgtttgtttgtttgttttgttttcttttgtatttgagacagagtctcgctctgtcgcccaggctggagtgcagtggcgcgatctcggctcactgcaacctccgcctccagggttcacgccattctcctgccttagcctcctgagtagctgggactacaggcgcccgccaccacacccggctaattttttgtatttttagtagagaccgggtttcaccgtgttagccaagatggtctctatctcctgacctcatgatccgcccaccacggcctcccaaagtgctgggattacaggcgtgagccaccatgcccggccgccttaagactatcttcatttcggtgttctgctttatgatttcagggagaccaaaggcctttttaccctgcatgaggtttgtggggctgttcatggttggagggaccttatttcaatttagagaaacatcttggcaagaggaggacatagaaatgccgtcctgctcataaccacggccgactcccaagaacacatgggggctgttgaaactcaactggagcccaaaggggaggacgattccctcaaagggcatgaggaggaagatttctcttttatgcccagaaaagaggttattctagggagaggggaaaagtccagaaaatgcctttatgttattctttattgataaattacattttttaaaaatatgaactctattggttaaatttaactggcattcacttaaaaggaaactttaccacatagagaagcatgttattgcactctagtgaataagagtttcattataggagtggaatttgactttgaaatttgaaaatatagatgagtttattgaattttcaaatcagtgaataaagtgagggttgtccaggtaccatttgcctaatctgcttttcatgggaataatgttgctgtcttctcttctcttctcttggaaggagaacaggatgtcatttctcatgtcctgaaatggacaaaggagaaaaaacatacctagcttcaactggatttctggcatttgttaatcttttccattttaaggaaaaatatgatctggcataattataatgagtaaggtaatctggccttgagaaagcctcattacacaaggtaatcaaataaaatagattgatatgtcttattctggcatgaaaaatattttaaccttttcctgatttattgcacaaacttctggcaattgaattacagggataatgaacactgttgtgttctggtagtcattaataagggcaatattttaaataggctttattaaatgagggatgggatgtatggtcattccaaatacacgaatttatctgaactctagccaactctaaaactgaaaaagcaaaattgaatattttgtcacaatttcctgttttgtcatactgaggaacaaaaattcctctttatgtatagaaatacactaaagtgttagcttcttttagcagtgaagttcttgccagcttcccaacctgcattaggtttcatgtttcactctaaaataaaagaatatgttagaaatgcttttgagacttcttcgtgctatctgggcaaatgtgtttctttggcatttttattttactaactctatttcctctatatgatgctaatttagatagagtgacactgctagagtaagggtattatactcatgttgagctctggttatacaaataatagagctgatgtactcattcagcataattgtgtccggactatgtctccagcacagcctttcttatatctttaatgttctgtgcagtatagacgtactaatcagaggtgattgtctcaatcattactgctgggcctttatgcatcctgtatttttctttcagtgcctagatattgcattagtctctcaagcacatcacaaaactggtttaaatttcatttgtctcagtgttttcttggtctggagcctttgtagttcctatattcacatgatttatactgcacacctgggagctcttaagggtcttattagaatttgtggattttatttttgtaaaaaaaggaaaggattgtcttttgagtttgctttctcctgtgtagaattccattatgactaggggacttctgaatcttatgtacatatggtaattatatatcaatgtatgccagtctaggcagagctatcaaaatatcccctttgatactaggagaatcatataccaccttgcgaataaacatgagtaggtttcaactcatctctttgctttatcgctctttagaagggatccttcttaactggcttttattatatttttctatataagagaaaacagtttaaagtaaaaagactatgacaactagaatggaattttttcatgtttctgggagagcaagaccttgcctaccattctgagataattttgtttaattcaatgccttatggtttcagattatagtgaagtttgacttgagtgttggttttagcccagtacctttaaagaaaagagaaatatcccaacttttctgctaccattactaacctaagtaaaacaattgccttttaaagttactcctaagaatgttgtgccaaaactttgaggtttcttgtcaattatttggctggcatttattctyccctcctgaaaccgtgaagaatggcttcagcttgtatctagtctgttttaccagcttacaggagagtgccttctggcacaaatagtttctgcctcagtgcctccctactcctaaccaggtcatgacctgacccagaaggacccataggatatctagtgcatgaacttcctgaggaaatcaagttggcacaccaggatgcacaaatctgaactgaggcatcatgccttgggctcacaagtgaactgcatgggtcagaggctttgggactaaattatctcattacatgtactggggccttactaagttacagagtcagcaaaccacttttcaatcaccagcactattttatttggcctgaagttgtcttctgcccttttgttttctaaatcaggggttggcaaactttttttttttaacagtccagataggaaagattttaggactgcaggtcatatggtttctctactcaactctcattgtaggcagtcatgggcaaaactagacaaatgagtatggctgtattccaaaaaaaccgtatttacaaaaaaaaaaaaaaaaaaaaaaaagaataaaggcaggtcagatagtttactgacgcctgttctaaactgttacaaggcagaagtttagaaaactttcttctgaagccttttcttatatcacggtcacagcttttagtgaaagagatttgtagcacatagtggaattctaacgtttagagattatgtcttggtaggctaataataggactgttggtaagcttagcatttacaaggttgcagttgtttccctgtaggtatttggccaacagaggccaacagaacacaccatcaccagatcagtctagtgccttacttatatcccactgagccacacaacaggcataattaccttgttggaggaagaagttaatgtacttcccgagtatttctaaaagcaagaacagaaccctttataaagatagctaaatgtgtactggaaaatatattttaaaggatatctattttaaatgtttacacatatagaagggtcttttagagaaatgaacattccaatacattttggcaatttcactgtttaaccacatcctagttttgtccattggtttgcttacactatttcttttttattttttttaatatttcctttcctttttaatattaaacaattgtgattcttttttttttgagtgacttcttttattattattattattatactttaagtttagggtacatgtgcacaatgtgcaggttagttacatatgtacacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtaagaacatgtggtgtttggttttttgtccttgcgatagtttactgagaatgatgatttccagcttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttgtagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccaatgatggtgagcattttttcatgtgtctgttttctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcctatttgtcaattttggcttttgttgccatcgcttttggtgttttagacatgaaggccttgcccatgcctatgtcctgaatggtaatgcctaggttttcttctagggttgttatggttttagttctaacgtttaagtctttaatccatcttgaattaatttttgtataaggtgtaaggaaaggatccagtttcagctttctacatatggctagccagttttcccagcaccatttattaaatagggaatcctttccccattgcttgtttttctcaggtttgtcaaagatcagatagttgaagatacgtggcattatttctgagggctctgttctgttccattgatctatatctctgttttggtaccagtaccatgctgtttgggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctataaattgccttgggcagtatggacattttcatgatattgattcttcctacccatgagcatgggatgttcttccatttctttgtatcctcttttatttcattgagcaggggtttgtagttctccttgaagaggtccttcacatcccttgtaagttggattcctaggtattttattctctttaaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatatcacctgcaaacagggacaatttgacttcctcttttcctaattgaataccctttattttcttcccctgtctaattgccctggccagaacttccaacactatgctgaataggagtggtgagagagggcatccctgtcttgtgccagttttcaaagggaatgcttccagtttttgcccattcagtatgatattggctgtgggtttgtcatagattgctcttattattttgagttacgtcccctcaatacctaatttattgagagtttttagcatggagggttgttgaattttgtcaaaggccttttctgcgtctattgagataatcatgtggtttttgtctttggttctgtttatatgctggattacatttatagatttgcgtatattgaaccagccttgcatcccagggatgaagcccacttgatcatggtggataagctttttgatgtgctgctggattcagtttgccagtattttattgaggatttttgcatcaatgttcatcaaggatattagtctaaaattctcttttttggatgtgtctctgccaggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattactgccacaatttcagagcctgttattggtctattcagagattcaacttcttcctggtttagtcttgggagggtgtatgtgtcgaggaatttatccatttcttctagattttctagtttatttgcgtaaaggtgtttgtagtattctctgatggtagtttgtatttctgtgggatcggtggtgatatcccctttatcattttttattgtgtctatttgattcttctctcttttcttctttattagtcttgctagcagtctatcaattttgttgatcctttcaaaaaaccagctcctggattcattaattttttgaagggttttttgtgtctctatttccttcagttctcctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttggatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttccagtttgattgcactgtggtctgagagacagtttgttataatttctgttcttttacatttgctgaggagagctttacttccaactatgtggtcaatttttgaatcggtgtggtgtggtgctgaaaaaaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattaatgtgtgggagtctaagtctctttgtaagtcactcagggcttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggagaatttagtccatttacatttaaagataatattgttatgtgtcaatttgatcctgtcattatgatgttagctggttattttgatcgttagttgatgcagtttcttcctagcctcgatggtctttacaatttggcatgattttgcagtggctgctaccrgttgttcctttccatgtttagtgcttccttcaggagctcttttagggcaggcctggtggtgacaaaatctctcatttgcttgtctgtaaagtattttatttctccttaacttatgaagcttagtttggctggatatgaaattctggtttgaaaattctttcctttaagaatgttgaatattggcccccactctcttctggcttgtagagtttctgccgagagatccgctgttagtcttatgggcttccctttgtgggtaacccgacctttctctctggctgcccttaacattttttccttcatttcaactttggtgaatttgacaattatatgtcttggagttgctcttctcaaggagtatctttgtggcgttctctatatttcctgaatctgaatgttggcctgccttgctagattggggaagttctcctggataatatcctgcagagtgttttccaacttggttccattctgcctgtcactttcaggtacaccaatcagacgtagatttggtcttttcacatagtcccctatttcttggaggctttgtttgtttctttttattcttttttctctaaaaatcccttctcgcttcatttcattcatttcatcttccatcactgataccctttcttccagttgattgcatcggctcctgaggcttctgcattcttcacgtagttcttgagccttggctttcagctccatcagctcctttaagcacttctctgtattggtcattctagttatacattcgtctaaatttttttcaaagtttttagcttctttgcctttggtttgaatttcctcctgtagctcggagtagtttgattgtctgaagccttcttctctcaacttgtcaaagtcattctccatccagctttgttccgttgctggtgaggaactgccttcctttggaggacgagaggtgctttgctttttagagtttccagtttttctgctctgttttttccccatctttgtggttttatctacttttgttctttgatgatggtgatgtacagatgggtttttggtgtggatgtcctttctgtttgttagttttccttctaacagacaggaccctcagctgcaggtctgttggagtttgctagaggtccactccygaccctgtttgcctgggtatcagcagcggtggctgcagaacagcggattttcgtgaactgcgaatgctgctgtctgatccttcctctggaatttttgtctcagaggagtacccggctgtgtgwggtgtcagtctgcccctactggggggtgcctcccagttaggctgctggggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcagggctccttgagctgtggtgggctccacccagttcgagcttcccggctgctttttttacctaagcaagcctgggcaatggtgggcgcccctcccccagcctcrctgccgccttgcagtttgatctcagactgctgtgctagcaatcagtgagactccgtgggcatagtaccttccaagccatgtgcgggatataatctcctggtgcgccattttttaagcccgtcggaaaagcgcagcattagagtgggagtgacccgattttccaggtgccgtctgtcacccctttctttgactaggaaagggaactccctgaccccttgtgcttcccgagtgaggcaatgcctcgccctccttcagctcgcgcaygacgcactgcacccactgtcctgcgcccactgtctggcactccctagtgagatgaacctggtacctcagatggaaatgcagaaatcacctgtcttctgcgtcgctcatgctgggagctgtagaccagagctgttcctattcagccatcttggctcagtatttcttttttaaacctgaattattttctgggagagaggctcttcccaagtgacccaaagatcattaggtctttgggtattcagtagcccttctggaagttcatcttctacttctggttactgtgattttctgtgcttccacgacactaacacgtaaacatcaaagagtggtctctctaagacagcttgaggagtgcacgagcagaagtactggcagggctgttcataaagccaatgccagaaagcagctcctcgctggcacatccactttgtactttgagacgcagtatccagaagccaggatgggcaatacccaaactatgttactttaagggctgaagatcaggcagggaactgagccccagaattgttagacattgttgtgagtgcaaagtgagcacttttgtctttctttctgctactcatcttacttgatcattcctgagtatattaaccaaatcctgtggtgtcttaaagataccatgtgtgccctgagaggctggtctcggtctagctttctgatttccttatcaattgggtcacatctgtattttctgctgactcacttatgtgtgtaaaaaacacaaaggcatacttttttttttcctaagcagatcggaacttctattccttttttttttttccagaagacctctctcgtgtactctcatcaaatgcttgtcctacatttgtaattattcattctagaagctgaggttgcccctagcaaccagcagttttgtctaaactgttttggtttcagggttgtcttaaaggagagtttctcaaaatccatttccaaagagcttttataccccacacagcaaaacatgtataaacaacaattcaaatttagggagcttaacaaggcctttcaacaaaggtttaaagtggtttcatcatatgatttatttaagattaaacagaatttctgttactagttaaaacgggagtgtaatttgcttttatggattcctatagtttcatttaataaaactcatccaatcagatgcactccctcccctgtgaaatcagaggcagtgccatatttgtaaatgtgtttcaggcaactctccaggtagtaactgagggctggaagaacgtacagcatccacctgccctcactgccatagctggcagtgttttttcccctccaaagctctggaaaatactttattataactcacagagccaaatgagaggcaatcaaactgttttgtcatttgaattaggaaaggtcaaagggaaaggaacataatagtagacagacagaaaagtgctttgtgaaaattacccattttttccamgtaaggaaaagtaatttgttttttttcagtgctagagatttttgttttgatagatttacagagagaaaagaaaccaccaagaattttgaaaggtcccatttcccaaacaaatatgtaacaagttcttaccatttaaaagatggcattataatctcttgcatctatgtgatcatttataaattacgctttcgtggacatcaagtcattgatgatagtaatgaccctggtggttgccagaccatgtactgttttccttatttcacacatgaagaaacagaggctcaaagaagtgaagaatgtacccaagtttgcatagcacagcccataaggtgcagagcctgaacttggacttcagccatgacttctatgaccacatacttctctgtcaccatcttaaatgtagatatctactaatttgtcataaactgaaggacatacatagcagcatatttaggaatgctggataatcagtaacatataaatagatgaaaggagaagttgcttcaaggtgcttagtttaaaacacatatagcatggtatcaattctatacaatggccaaaggatattgtgtaaccatgcagacatcagttgtcactagtaattctcaatgttttatattcacactttcttggtataaaaataaatatttgtatttgttcacgaagttaattctataaatcctgctacaatgagttttaaaaaaataaccaacaacacttcacttcagtcatctgtgtaattttcctttagtttggggcattttctaggtaaagtttyagctaaacaatacagaaaaattaaaaagttcagagatcttttaatgatatgaaaaactgtttctaataataataaatgttaaaatcatttcactattcaaaagactgcgttcagagcggaggcaccctaacatactactctaggacatttctcactgccttcatcttcaaataaaagtgagaatagaaccctaacctttgagagatggaaataatgcatgtatatgtctgtttttatatctttcccatgtgtatagagcttagacactctatatgtgaagaccctccaaaaatcaagtctggctttcttctttcaggataaccattcccgaaacaccaaggacagggatacatcagaatggacccctacctgtgctatatttaaagatctccaaggatagagattttacgtatgtcagtattttttaacactatcagacaatgagaatattcctggccaggtccacttagtgatttcttcattgaaggatacaatttagaagattggaggarcaattataaaagaaagtaatacaatttagaagattgggggagcaattataaaggaaagtagctgtaggtctccaaaagttaaagtcccttaatcccagttgccttagtagttcttgcatgaaagcactaaggaaggatcaatgactgggagatgggatgaattctgaattgcaaaagagacatttaaatattacttgcaaactaaactcaaagcacaaataatttaacactgttttgttttagtttctaaaaaagtggactctaattcattctttccttgttcaggagataaaactatttgtaacctttaacatgttcttttcttcacagttgagagctcagtttgttaatactttctttcccaaactgttttctgaatgtattggaaaactgcacctgccagaatggattggtgtttgttcttcttcaatgaaaggtggctgtgatcaggagctgccccttttagagagcttaagctgccaaagcctaatacaacagaggtggaacggaaaatgagaatgaaggacatattcaaaaatttaacaaattgttggtgcctcaggcatgaagcccattggtttccaaagaatttggcagaaagatttctatcttctcatcttgtaggcaattaccttaatatggcacacttttgtgatggctttcattgaaaggctctgtttaaacatctttttctgaatcaccaagataagaatggagcaaatgaagggaaaaaaaatattcacttgtacacaaagctgctaccttcaattctctgaaattgtagttaatgcctaattatactgacattcctattgtacaaaagtgttgagaatgcaaatataatttcccagctaattatttcattacatggaagtgacatgagtgaagtaataaattagcatcgtctttataagaaccagcaattctggactttataatattgaaattttcaagtggagtgaagtgcttttttcttatgactactctgattaggtgaaaaatgccttttaaatttatgtgtataatacacctccttccttcagcagatattttaccattaatataggacagtgatatttatgtgagtacattattactgagaaggagacccaaaggatgtcaaagggcagagctgccagctgcgacagtctggcttgtactgcttttcttaaatgtggttcaaagcaatcagattatgaattgcagtgaaataaacttacttttatttttaaaatacaaccaccattaacagctccccagttagaacaactgaatgtcaaataattgyattctcaaatttaaactagaaaatagtagagcttgaggaaggggagtggaaactcaatagtgacacattgagatgggttagaaggtattcagttctccatttctttgatttaaggatcgtcaattgttagtggtgcgattaaaattaatacaaattttcaggaaaaataaaactacattaaatgcacaggggtttttaaactgacaatatcatacagtgcccaacacttttgtttttagaatcaatccatgtctaaaataccttcaatccagagtctgcagatgtctctgaaccctttggtcattagcagtgaagcattggcattaaggtgccaggccactttgtgtcacccatgctccttgttttgacaaggtgctaaaggtgtacccttgtggttggcagcctattacaaggcatattgaacacgtttttcctctgtactttcaatttggccaagttttttacacttaatttttaattttaatatttctgtaagccatatagcttctcctgaaactctaagggagcttttggcaaattgcttagtacctgagtgggaggcctccatgattcatggctggctacaccagtctttgctcaccttgaacactctagagtctattctgaagatttggcgatttctattgtttttcattgttttgcctcacacatgaaaatcaatcttctgtgtacatcaaaatataatgaagaattttaatcaataattatggactgtaatttaaaatttaatgatctgtgttgataccagtgtaaataagtgaagtgtaaaatacattatccagggccctttctgtgtgatgaagtttgcatgtggacaaacaatgacaatgaatatatgaatacaatacaatgaatatgtttgtttatttgcctagaatttggtaactttcttatggaatgcatcaataacaagatacattccaatttccaaaatgctaaaaaaggagaatactgtgattcttacatttagggaaatatggtattttatcttttgaattttatactggcagaaacaggagatgcaaaaaatcagaaaaacaagccagacgtggtggtgcacatctgtaatcccagctacttgggaggctgaggcagaaggattgcgtgagcccagggtttgtgatcagcctgagcaaygtagcaagaccccatttcaaaaaaattagaaaaattgtgcttaagtagccttttggtcctgatttgcttgagagtccagcttgtacccattgtcctgacataatcattaatagaatcccttttcactctcaaaagtttcctggcctacatagcaacttaagtaatggttactctacttattagtcacttttgttggtaataacaatgcctcgagagaacagaatagcttggtatattatagcccttcaaataaatatattaaatttatataatcctcagaacaaccctattaaatagccctttctttttgatgaggatatgaagctcagtgagattaatggttgccagggtcatttagctattatgtgacagaaccagtactccaacccacaggtccagggcaaattaattccattgagtttaataataataacactatgaatgatcatcataatcaccattactaccttactaataaagctaccatttgcccaacagaggttcttgaccattgctgtgccacaggccactttggtaatctggtgaaacctatggacctcttttcaaataatatttttgaatgcataaaataaaatgcatagtattacaaggatatgaattttattaaaatatagttaccaaaaattttaagctaaatttgcartatagttatatatgtggttttccaaatgaattaaacaagatcttgaaggattatttaattatgactatgatatcaaagtaatgatgaacataaagaatacttagagatttctgcaacaagtctaatgtgatatgaaaagatctatgatttctaccagcaacaaagtgacaggttttgctaatactactgaagtttgttgcttacattcataagtaaagaaaattctaaattttacatagaggttagtaaaaataaagatgtaattttttcccattcaagttcacagagctcatccaagtgtatcaacccccaagggaccccgattaggacttgctgccttggaataaacctgcaaaacaactattattcccattttacaaatgagtaaactgaggctcagagtaattaagtaacttgcctaatattatttaccttatggctgagaagtgcatcaaatggcattggcacttgtacatcacctccttttgctccccagtggcaagcactatagaggtgggtattgtagtgtccacccctctctgagactgacaaccttttcagcatggttgccctagtcacttgcacatcctttaaacaccaatgatgcccttgatggagaacacagatatccaaagagaaactggaggagaggtctgagtgtctgactaatgctttttattcaaccctccttgaggatttctagtgttcagtatcccgtcagtggtcctcacatggctccccagaatgatcattattcccgacatatttgctgctattttctaccatagctattttcctcttctacctttaggtgattattgctgctacttattactattctcagatgaaggaaattgtttttcttcacctcccttagttcaatacaggtacctatttggattttttcagtaattgctataattccttagcctctctttatctaaactatacccattaaattatgttaactcttctcaaagctaaattgcctcatctgtttattattttcctcatcttgcctgaatattttaaaacttacaaaatatgtgaagcgattgttaaaaatctaagtagtcccaggacacatttattagttactgtaattgagtcttactgattacacatgcattataagcctcatgatgtgctaactttagcacaacaaagatacagttttaaaatattatatatttaatattttttaaattctatgttgtcagttcagttactgttgctcatctccttctcctcctgagtaatggccaagttattttggtgagtctaacatatgggagtctcatctttgatagcaaaatgatgatgacatatagtctactgagaatatattcagccctgttttcacctgagaaggaggagattttgccacctagcctccaaaataagagcatcttattccattattgaagggacctttgaagtttcacttgtattttgataatttatggccacttcttaaaaaatcactatcactctatatatcctcctggaaagcatttgttttagcacttataatggatgttgtaaacatttgtatattattaagtgctttataacatacacagtaaagattcagctaataactttaattgtggaactgtaggttttcttgagaacatttttttaaaaaggaaaacagattctgaaaaactgatgttattttatcaccaacatgagtaaccacatcatcatcatcaacataatcattatcttcaccaccaccaccatcatccaaaatggcatctagttacatgctcgcatgggttcacatatacaaatatacacacatatgtgtttaaacacacacatacatgcatatatttattcattcagtcagcacatgtttactgagagcctactaagtgccaggcagtgttttgaggtctgccctcatcttgcttccattctagtgaatcaagactgataataaattggataaataagtaaaattgtatgttagatgaaaataactgctaaggagaaaaataaaacagggagcagagatagagtacatgaggagggggctgttttaatttttgatagaggggaacaaggcagactttatggaggtggtaatatttggttaagacctgaaaggatgaagaggagagccacgtggatacctggaggagagcattctagcgaagatggagagttgttccaaaggtgctgctggaggccatgcttgacattcaggggatagggaggaagccaatgtgcttgaaatggagcagtgaaaggaaagcagtaggacaagaagtcaatataaagaagcccaggcagagtcaagccccatgggccattttctctgagtgaggttggaactatgggaggcttttgagcataggagaaacatgatctgaatcaactttctaaaataatcattctggctgcttggttgagaacagactaaaggggaaccagaatggaagaaagataatagcctaggcaagacaagagtgtagtttggaacaagatgatagctgtggaaggcatagcaagttgtcaggctgcagataatattttaaggaaggagcgaacagaatctgatggtggattgcatatggagtatgagagaaatagaggagtyaagcataaactgacagtttggggcccaaacaactgaaatgaggggagttaggcagggggaaaagggggagataaggagtatgggtttgaacmtgttaagtttgagatatcagactttcatgtggagaggtcaagtaggcagtttggtaaaaagtatagagttcaatgaattgacatttctcaaaagaagatatacaaatggccaacaaacatatgaaaaaatgttcaacatcactaatcatcagggaaatgcaaataaaaaccacaatgagataccaccttacccctgggagaatggccattattaaaaaatcagaaaacaatagatgttgtcgtggatgtggtgaaaagggaactcatacactgctggtgggaacgtaaattagtatagcctctatggaaaacagtatggagattcctcaaagaactaaaagtatatctaccattctatccagcaatcccactactaggtatctgcccaaaggaaaagaagtcattayatcaaaaagacacctgcacatgtacatttatcacagcatggttcacaattgcaaagatatggaataaacctaactgtccatcaatagataagtggataaagaaaatgtgttacatacataccacggaataccactcagccataaaagagtgaaataatatcttctgcagcaacttggatggaactggaggccattattctaagtgaagtaattcaggaatggaaaaccaaataccacatgtcctcacttataagttggagctaagccatgggtatgcaaagacaaacagggtggtataatggacactggagacttagaaagggggagaatggcaggtgaatgaaggatgaaaaactacctattgkgtataatgtatactattcgggttacgggtgcactaaaatcccaggcttcactgctatacagtgcatccatgtgaccaaaaaaccactgtacccctaaagttattgaaataacaaaatgttttaagtatagagttcaggggggaagtctacagatagccataggcatggagttttcttcatataaatgctccatctgaatggaaaataatagttaccctctcacaacacccctgtccccctgtccaatggaagctcagcttctatgttttcaatgctgtgattgttggttttgctctccagggaatatagtgcccttagaggctctgtctcttcatcttgaagatcccctggtcctagggtctggattctccacaagcctcctttatcacatcatcatgaycctcactggaatcagtctctctgaactgttttcttcctcctcctgatgtctcactcccctctctcctttctccagggctattgttgccaccagttcctaaagccattggttgcaccacctttccttcaataagtcagctgatgtaattggatagagatggttttgtggctaactttttcagccttttgaggttcaagtccatattctgtagacaacttgaggcttctttagtcataaagccaaataaataataactcaactctcaccttcagattctccctgaccaagatcatttctcccattttctaaataggctgaaggaaggcaagggctgaaacggagacaggatgctactgcagtactccasgtgaaggctggtggtcgcttggactgagtcagaacagggaaactgatgggaagttgtcggagagtaagtctatgttgaaaatagagccaacaagatttgttgatagattgcattttgggtgtacaagcaagagaggagttccagaagaaaccaactctaccagcaccttgattttagccctgtaaggcttatttcagacttacaacctccagaactgttagagaataaatttttaggccgggcacagtggctcatgcctataatcctagcactttaggaggccaaagtgggtggatcacctgagcccaaaagttcaagaccagcctgggcaacctggygagacttttcctctataaaaacacaaaaaaattagctgggcgtggtggtgcacctgtagtcccagctactcaggagactgaggtgggaggattgcttgagcctgggaagccaaagctgcagtgagccaagatcatgccactgcactccaggcttggtgacagagtgagaccctatctcaaaacacacacayacacacacacacacacacacaaattgtgttgttcaagtcagtgactttgtggtaatttgtgacagcagcaataggaaactaatacacaattagacatctaagtggaggtactgagtagctgtgggatatgagtgtagaattcaggagatgcatgaaaatatgaatttggaactcatcaccatacagatttatttaaaaccatgagcctaaataagggttccaacacagtaagtgtgatagagaaaagaagaggcctttagtctgtttctgagcaccccaatttctattggtcaggaggatgagaaaaccagccaagaaaaatgagaaggatcatccagtaaagcataaaaagagccaagagtctgaggttccagaagccaaggcaagaatgcatttccaggagtaaacaaatgtcaagtgcagctccatcacaggtttgaaatttggtgctcactaatggtttccactttaaattttttgctaatgcctacaaaaattctaggagggacaaccaatgtttgagagtgagatactctacagaacatgcttatatttatccttttagagattgcctaagctctgatcctctcttggaaagctacattctggacattagttggatgcttagaataaagtcatctgttcatttgacaagtattttcaagtgcccgttagctaggttctgagaatatgctgatgaactaacaagatccctgctctcatgggaacactttcagtctagggtatttgctgaggccaaacatcacctcttttatcaagcttttgccaacatttttcagtagttgctttcccttctttgtacatattcatagaactcatcacatttaatgtattagccagttattgcctctgctggtaaactctcccctcctttaggaaagcaaccctatcttagtcatcttcatatatagataccctcatatgtaggttggaaatatgatttattattaaaaccaggaaatgtctgcaagagaaaggaggctctgttaattaacaccaagacaggggatgtaaactgggacttcctagggcaaacaaaaatgtatagtcaccctatcactcaagtttacgtcaaaataactgttgaataaatacattttgcttcctgaaaaaacacatttactgaaatgtgacttaatattttgcttttggctttaattgaggatcaatatgtaagaaatagtgttaggaaaagtgtttctgcatcttttgtaaaactgttattggagactgtgtccattattttgtccagcgttcctcatataaagagccatgtaattactccccttagaactgagcgctagaaaaaaatattgcttttttcaaggagatggtggtgcactttctcttcctagataatgagagctcagtaatacatcaatcacgctctcacattggcagccacaagctagagctaaattatatcctcaagttgcttttaaggctgtgtcaaaatgttccaaattgtgacttttcctttgccttaaacatttattgttcacctactatgtgcttagttctgttatttaatctagagatatggcagagatccacacacgtgattcctgtgttcatggcattttcttggttctagcacatttacctactcttttagtacagtatttggacattttcttgtagagagccttaaatttttgcaggagcaaggcaggcatttaaaaaaaattgaatgaagtgcaataggccaacaaattagggaggggtatggacggtagtcacagaaggcttgggcagaagtagggcatgaagtcacttgagcagaccaaggagccctgaagttcatattttggtacttttgtttttcataaggtttcaaacctgctaattttcttttgaaaaagaagaaggaaaggcccgcctaagaaaatataattatttctaaagttgtggttagcatctttactaatatttgtaaagagtacttgatcaaataaggcatatggggatactgtcacaatccagaaatgctgaaagtgcttgtctgtaggctagagaaagaaaaacccacaaattgggttttaatatgatacaccctatacaccctaggattgagtaaatatttgggttctagagtatagcgtagtctatttttgcaggacaagaaaatgatgagtactatttttttaaaaaataacctgtctacttatgggtagatgaacttagcggtccattataaccttagaaagggacttgaagaagctgctgcagtcttcccaaccaagagaaggacattagaggtcaaccagaaagcactatcttggctggaacaacaatgccatcaaaaacaagaaacacatctttatgtgttggtttatttagcatgtcacagtgttaagggaaaatggtcaaatgaaggaaaggttcttcaggcaggcaatttagttgttaccttttgaacctggagaagaatagtagtgtggtgggtataacaggaaagactgacagataacctgttagaagaggggactgagagggatagagaatgaaaaaggcagggaagtctgctcctacaaacccagctatgttggcactttctcttctacaactgcatactgaaatgaacgtgaaaccagtagcatgaaacacttgaccaatacatagcattaaaggaatcaaaatttaattgtgagctcttgagtcccactacttctattattattatattgcttccacatgaaagaataaaattagaagctgaaatagatatcaatttgctatgtaagcctttttttaagtcatatctaccgaatatcctggatattgcattttttaaaaaagcatatcaaatgcagtcagatttgctatataatacaaataaaattactctttttagctaatgtttatgccacatttttagccttctggctcactgttatgaccgtagtgtcatttatgcagggttcgtgtgtttttggtaagcttaagagttatccacggaccttaacaagcacaagaggagaattcactaagatctagagtgcttcaaatgacattgcaaacattggactgcctgaaaacataggtttgtctcagaacagaatacctctgtgcacacacacagaatgataggtctggaaagggatctccartggctactcattctgttcctgtctccaggtacgatggtggctaaaccatagtaggagtgcagtgacaagatggttagatccacagaggctcctgcatgtgttaggtttcccgctctgtctgcaattttggtactaatgtaacttacccaagactgcccatttccccaagctgcagccagttgagctatcaaataaaataatttatgttatcatccctttcctggctctcccttgggtgcccaaagctgttcaaaactgagtgctggagactgaaagtaaaggtcaaaaggaaaagtctgaacttcagggtagatctgaccagaaaataaaggctgtctttctaccttgcacagcagaggaaccttctttacctatcatccaatcatgttagttgtttgagctgaagctctgtaaagaaatcaccttcatccacagaaactgggaattccagggtcactggcagaactgcaaaacaggattgcagcaactcagcacacacattgtaagatgatttgcttttgagaacttgttttgagcctaccacctgaccaaacagcatcaccaccattatctgtaaaatatttacatttacagggcaagaaagagttactaaaattgattgccctgtgtcagtgtggagtttacttctttgaagaataaattgaggaggctacatgattaattcaaatagttaggagtctcttttctttccacttgatcttgagacttcaatgtcactttaagtcaaattcaaagacatgttgagaaacatgagaaaatacgtttatttcatttatttttccatggtggtctcataagttattttttctaggttatgagaagataaaaaacttttaaacaaagaagccaaatttggagagaaaggagctattattgaacttgggtctatgtttctgaaaagtagcctagaattttataaaagcaaaaaacaaaaacatcatccttgtgtttatattaggaagtattttaaaacatgcaatatgtattttaaacacttttcttttgaatcttgcgttgcacccaaagaatgctaatggtaaccaaattgttctttggcagagtagcctgacccttaaaaaaaggaacagaagtgttacagcatgtgattgtagcacaagacaattatgaatcctcaaccctgagcagatattaactaatcctatgatctgaccataagaggttaccttggagcattcctctacattgcattatgtatattacatggtaatgaatgwcagttttcatggctcctaataatgagcwgcttctctttatttagagaacaaaatagggggtttacagataatatctgagtttatcattgagctgctcagcctcctcttctatgtgcctcagcttgtctcaatcagtgctggttatctcagcaataaagcattcagcctctagaagttggtttcttcctacaccctataaacaagaggatgaatatcttgttacatgtgctaaaatgagttgggtgaaatgagcattactctgctccctgtcactagctataatcagcttttcaaatctatactgagtgtgtccccacacatagcacactaaggaataaggatgttcgtgacaatatattcctgagaagcagcagttctaacatcccagtgacagctattcattccagtttctttgtgcagagacattgtcccaactccttcaccatgtgctaacaattagataatgactccataaatgtagagaaaaagcagtgtcatggacggtgggtrgtttgttttcttagttctttattgaaaacatatggagatgtttatatataaatagaaaacaataaaacgctgccatcatgtaagcagcaacttaaaaagttctacacgaatagaaatcaaacatttctatacctatgccagaattctggtttactgatatctacacatcctgtcttatttggcttgaaaagatgttttattattttaggctttttatttatagttggaagcaaattgtggagcaagagatttttgtttttgttttcatttctttcttggcttaaacaaattacttttttagcaggaacaacaacttctgtccaagtataccttgtgttatgatcatgaaaaaaagtttttaatgtatacatttaactacggtctttgtatttctgaattaaaagtgaggacttgtggcctgacagaagtgactttcaggagacccagcagtggagaggttgagagcactgcttaggaggtagaagcaattcctctgggttggaattctggctgcaccacttaactagctaggtaaccgtgggaaagttagtcaacctgactaaacctcagttacttcatctgtcagatgagaaatataagagcacttaaagaatgatcatgcacactcatgggatgagctgtaagacgttacacatagtgtctggctcgtaggaaacatcacagaaatgctgcctagcatcgttgtaatcagctaacagaagggcttatattgagaccatccttgaaaatctgagaagtgttgatgctcagtgccaagaacagtaacaacagtaatgctactgtttaccaagtgctagttatgccctagcctttacaatgtactgtttttgacaattccatgagctgggtaccattatcatccccattacagctaaagattggttgatgtgagggtcaaacccagtctggatcattcagaagcccacactcttgatctctctgctaaaatggctgccacatatatagcctagggcacctttgaaaccttctttatttacactattctctatgttcctgtcaacatcctgtgacattgcacaatggcattcacaaactgtgaagtcccctgtccctaggacatctgttcatttgtagttaaagaggaccaggaaacacttaatgaacacattattagaagccctggttttcaattcatgcaaccatttttgctttggtttaaaggccttttctttaaaggtgcttgaagcttcatatggacaggctcattattcaagcttttgtcccaacctacagatgcagaagccaaggaccaaagtaacatgacttggggacagagggagaggccattcacctgccttggtagcccagtgtatcagttgctgaatcaggaatacaacagactgagcccagggcagtgtccaactcatcaggctgctcattaatgttgggtctaacagccaaactgctaactagctccactttttaaaaacttctattttaagttcaggggtacatgtgcaggtttgttacatagggaaacttgcctcctgagagtttgttgtacagattattttctctcccaggtgttaagcctagtacccattagttatttttcctgatcttctccctccttccaccatccaccctctggtaggttccagtgtgtgttgttcctctctatctgtccatgtgttctcaccatttaactcccacttataagtgagaacatgtggtatttggttttccatttctgacttagtttgctaaggataatggcctccagctccatccatgtccctgcaaaggacatgatctcattatttttgtggttgcatagtatttcctggtatatatgtaccacatttcctttatccagtctatcactgatgagcatttaggttgattccatgtctctgttattgtgaatagtgctgcagtaaacatacacatgcatgtgtctttataatatagaatgatttctatttccccttaactggtatatacccagtaatgggcttgctgggttgaatggtaattctgtctctaggtctttgaggagtcgccacactgctttccacaatggttgaactaatttacactcccatcaacattgtataagtgttcccttttctcctcaacctcaccagcatgtactttttttagtttttaatagttgccattctgactggtgtgagatggtatctcattgtggttttgatttgcatttctctaatggtcagtaatattgagctttttttcatatgcttgttggccacacgtatgtcttcttttgagaagcctctgttcatgtcctttgcccactttttaatggggttgtttttctcttgtaaatttgtttaagttccttatagatgctgtatattagacctttgtcagatgcatagcttgcaaaacttttctcctgttctgcaggttgtctgtttactctgttgatagtttcttttgctgtacagaaactcttaattaggttccatctgtcaacttttgcttttgttgcgattgcttttggcatctttgtcatgaaaactttgctagttcctatgtccagaatggtatgcctaggttgtcttctgggtttttatagttttgggcttcacatttaagtctttaatcaatctttagttgatttttgtatggtgtaaagaaggggtcaagtttcaacttctgcatgtggctagtcagttatcccatcatcctttattaaatggggaaccgtttccccattgctttttttttgtcagctttgtcaaagatcagatatttgtaggtgttcagccttatttctgggctccctactctgttccattggtcttgtgtctatttttgtaccaataccatgctgttttgattaccrtaatcctgtagtataatttgaagttgggtaacgtgatgcctccagctttgttcttcttgcttaggattgccttggctatttgggctattttggggttccatatgaatttaaaatagtttttctagttctgtgaagaatgtcattggtagtttaataggaagagcattgaatctgtaaattgctttgggcagtatgaccattttaatgatattgattcttcctatcatgtagctccaattttaacctacacagtacatgactagaagcactttgcctgattttcttgttggaagaatgggatctgcctgcaatatggaaaccctcacaaacaagatgactcrattctgttttcatttgcaagatatattgtgaatgttcttttctcctttttgcaggagagggaaagggtttagggttgtgggtgtggcagggcatagaagggaagaggcttaggactgccaaattacatgtcaacctgctgacttagcatcagtgtactagttaaatgagccctgaatgtaagacattaatgcaaatattttgcatattattaactctaatgatgctaccataatgcagtatcctcagctgaaagctgaggtggcattttttattataaatgccctgggtctttcactgaaaatcaccatgaagacaagtcccttagaagtgagagcagaaatatgaacagagttctgcatcgttaaccttctcatcattaacaataacaaaaaatattggtgtcccagggccctgcattcagtaaatgccggcaacatctttctttagaaactatcactgctcttgcccttataactacaatatacttccaaagcaaaaggttaggcaatcattgtaaaatggaatctgttttagaaaaaaatactatgcaatccccaaattgttatgtaggtggaaaatcattctaaatgcagaacaagtattgcttaccctccagtgccatgctagtgatggtagtgtggagtcttggaaagcagagggtttcagagccagcgctaccatttgccagctgtatgacattgagcaaatcgcttgacctccctgattgtcagatcctttcctataaaacagcaacattaataatactgctttgtctattttatgagttgccaaagaacaccaaaggagattgcaaatgtgaaagctctctggacgcaatgtacaaatgttattattgattttttactaggtgagtaatgaggaatgagtagcagtgtttgtccaaggatagcttgggaataagtcaaccaaggtggcagttggtaggtcttgaagatgtggttggctcctgggaaacagatgagctggccagtttgaaggatcttaaagttgcaagttttcgggctgggtagcaatttaactgtgcaacctgtcaagagcctrttatattctaaatttgtgccgtgacaatattggctacatgaaataactgtgtgctttcttaccagactttatttggaaagagtttatgaactagtggcctggcagcgttgcctggaattaacagtgctgtggttttacaccagggagagaagtgtttcatgccttgttctattacctccctccctggagattcaacagatggaacaacaacaaaatcagaaccccaagacaaacctgtcagcttgatgcctttaagcttcggcagaactcacaattaagataagatagaatatccatttagaggaaagaggtgcaaagaaataagttcacagagcataccttcttttgtctgagcatggctaatactatctggagatccctgccacataggaggaattgtatactggaacacagtgaacacttaagaaaattagttgaaagaatattattgctagtagaaataactgaacatctttaatatggggctttatatttcccttcattatatttttttaatcctttcaagccaactcttgagtttggcaaatcctaggctgagtaattgtgcatctcagaatggttagataatatgcagagcagaccttaagtcaggcacagcaacatgtgttttggcacagccgtaaggaggtaaagtatttggtaattgttgtttgatagttcccaaggagaaagcactgaagcaacagataagaaccaaacaattttctcttgtgtttaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggtaagaccaaaagatgaagttgtgttccytatatattgccaacaatttaaaataaaatttctgttttaatagagcacaatgaatactagyaggccaggttgtccacggaaaccttaagcttttgttcaaggtataatctgatgatttcyaaaactgggataatagtcctcaccttgtatttgtttacccatctgtatccctccactctttctaaattataagctcctcactcccagagattctgatttagtcattctggaattgggcctaaaaatccattgttttgttttgttttttaaggaggtatctttggtgattatagcacaaatgatctcataaccaaaatttgagaaatagagtagaaggcaaatattactactaatatccttctagttctagtcctgtgctagaaaaacttccttgatccaaataattccctattaaaacactgtggtatctgaaattttaccattagagatagattccttgagggtggggtactttcttttaatcatgttttaccttaatgcaaagactcctgtgcaagaggttgagcataaactaatttaccctgggcagtgatttatcatgtgaatatcctgaagagaagtcctaagtccctggggttcagggatgaaattatgaaatgggagcggacatgaggaggttacttacagaaatacaagctggaacagctggaacagtcttttttttttttttttttttttttttttagacagggtctcactctgtcacctgggctggagtgcagtgacatgatcacagctcactgtaacctccacctcctggccttaagcaatcttcctgtctcagcctcccgagtagctgggattatgagtgtgcaccaccatgcctggctaacttttgtattttttayagagacagagtttcgccatgttgcccaggctggtctccaactcctgggctcaagtgatctgcctgccttggcttcccaaaatgctgggattataggcatgagcgaccatgcctggcctctagaacagtcttaaagaagacaaatgtatactacttcacaaagttacctaagcctggccattgaaaaagtttactgatattgtttgtgacccgaggttgcttcctcaacaccattatatccataatccaaaaaagttaaaggatccatctgcaaattgttctgtatttgtactatacacataggatgcctaacatttgaacagttttaacattgctgtattcagaaatatttctgtggctacaaacatttcagaggtactaaaacagtgtctctggacctactccactccagatttttttttccaggctgcaaagtagattttaccaatagtaacatactacatagatttaagatttttaaaaagcttattcttgcaatactgcagatttttaaggcatattttaagttttaaggtttataataatctttcataactaaaaataaaaggagcttttctgtactctaatagaaagaccaaaattattttcctttgttctttgttctgtgtatgttaacatattttgaaatctcttaaagcaacatttccatttacaatgctgtacttctctggacagatccaatactatctacatatgtgtcattgataaacatgatctaagtgtaggggagagagtctgccctttaaattatatagaatcatttgtatgaaattctagattttttctgagcctgaaatatttcaacaagaacttcttaaaaattgagaaaccctgaataagctgctgtgtggtagctgtgaggaaaagmctggtagactgtgggtgaatgagagtgcagacggggggtggttcaaggtgaggtaaggagctgaaacctaagacagaattgggaacaaaaacttgtccctccccatcccaggtatttcttttttgttgtgtttgatcattgagacttggctctagcttttttccttcacatgtacgtgttgtataagaatggttctgtttggagtgatcaggttaatttgattcttttcacctaaaataagaaagcattttctgtctttgccatggtttaagatgaggtcagatttgatttctacctaatagaatggagtggggagactgagcccattatggttgtataagaattaataagaggccgggtgcagtggctcatgcctgtaatcccagcattttgggaggccgaggtgggtaaatcacttgaagtcaggggttcgagaccagcctgaccaacatggtgaaaccccagctctactaaaaaaatacaaagttagccggatgtggtggtgcaagcctgtaatcccagctaactgggaggctgaggcaggagaattgcttgaacccaggaggcggcagttgcagtgagctgagatcatgccactgcactccagcctgagctacaagagtgaaactccatctgaaaacaaacaaacaaacaaaaaagaattaataagagttaaaatgtgttgaactcctaatgtgtaggaagtacctaggctttttgcagacactgttttatccatacarccatcctatgaaggaggtacaattatcatratccctattttgcagatgaagaaacagactcataagggttaaatgacttgcccaagactatactgcccttagggcaggagtcaccctgagaasaggccattttggcttcaaggctggtggcccttttctcacaatatgcaacaacactgaggggtctggaatgctgagaagcctccaaatctccggcagtgtctaaaatgtttatcttactcagctcttgcttatgcaaaggatttcagtccattcctgctccacagtgatttacccctgggagaaaggagtttgttattgtaaataactacttatatcttctcacattctttgttctactcccttctttaactctgaaagatcagaaaggtttacataaagtcagtagctcatttagatgactctaaatgtttccttgaatgctrttttatttcctttagagcattagaagacagaaccaaattactgctgtcttccttttattacttttgagttatcctttgatatttcaaatttgggctattcctggaagaaacaatggtactggttataactcttgtcacctattgaaaatttcaggtacctcactgtgtgcagtggcttacccctgtaatcccagcactttgggaggctgcaaggtgggagaattgcttgaggccaggagtttaagaycagcctgggcaacacagcaagacccccatctgtctctmaaaaaaaaaaaaaaagaaaaggatgaagaaccatatttgggttcttcatcttttttctaaaagatgaaaatgaatttgtctgaaaaagaaaaaagtaaaaatatatcagttgtgtaccctatatttgtgaaggcctgacaaattatagcttaaagctaagggtaggattctaaatactaattaagttatcatttaaataactgctcacctaacttctaaaaaattaatgctaaataatatttctaaactccatccttttttctttctttttttctttcacggattcaataaacatttattgagtccctaccatgttctaggcctattaaatttctataatttgaggtgactgtatgatgactagaccccaatattccatgtatactatttaccaaaatactgatagaactgtatatctatcacacagatagaattaaaattcaacattgctttcattaattatagaagacaaaaggatcaatttataatacggccatctttgggagagaaaagatgatatcctttacccatctagatgatatctataatggacagaataactgtcaacattaatataaggctttggggaaaaaagattttctttaaaagtatcttggatgtactttccgcataaactctttgttctagatcttcagattccagccttctcccatgtccacctccttccatattcctattctttctctctaaatcctcagtgctctttaaggctcattctgtattcactggtgttcatgaatccttcctgagtccgtagtgctctattgcttttccaaatttctaacgcgcttcaagtctttgtcccacaacctggcatgtgaattacaaactatgatattgttcttggaacactaggggcttatgtgcatcctgctgcctatatgcagtgatcagttctttgaggttaaggtcaataatttctcattctttgcctgttccagagctgtcggtttaattttaggagacatttaaattcttataaatctgacttagcagaaacaaaaacattgaaataattattgtctagacaagcttttagatacttcagtttaagaatatgaagaaaataaaggatactaagagccaaaaatgtataaaaaatattgggagaatgatataaattgggaagcctagagcaataaggattatttctcttaaaggagcaaagactgagagaagatgtatctttcaatactttagtgattctcacacataaaatggtgaattgctcttccctgacaatttgaaagacaatacatgacttaaagtgacctaagagggatttaagctagtctctagtcactccagataatagagaggctttaaatctcaagtttttgcctgattctcctatatgagctccaggttaggatgaaaggagtctatttcattctgagtatgtcaccaatgaggtataatccatggttcttagatgtccctaagtgcatccttcttgaatatatttcttctttagaaactctttcacaaaatatacattaatgaaagaaaattaaataccctcttactgtgacctgagagaatgagcccactcttactctatatctgccaagaagagtttactcctctgcttcagaatctgaaattcaactttttgttgttgttgtttttagtgtggtggcttgtggtagacggtgtattgcaaggagttagaggacttgagtgtatattctgacttcaaaacttctaactatgtaggcaaacagtgtaatttttctaagcctcatttatttgttattaagcatccttattaatcaactattgtatggtactggagaatcagtagtaagaaaagacagataagatccatgctctcacagacaacacagactagtaatgagacctggttatttcatctgcaaaataagtctggtaacctatgagtcrttatttctaccaggcctccacttgtgttctcctcctcctctgtcccctatctcattagcaggcactataattcagaaacctcaaaagcacccaggacataaagccaaatgtttacaagtcctgtttactccaaatccctgctatttcttaaacccattccctcctctccaccccacagaccttgtctcaccaaaactcactgattcctacagcagcctcctagtaatatcccaacctgtgtttttaatcttctttcacctaattggctcactgcttctagaatgaactttctaaagtgaaaatcagtatatcaacctggatgcttttggctgcaaaatgaaacagaagacccagtcagaatggcagtaaggggatgatgtttttaaattcgcttaaaaagaactttgcagcaggtgttacagagtgcataatttggccatttgaccacttcagggaygttggttctttacatctttccatgttgccattctcagcatgtagacttttgtcaggcctgtctctttgtggtcccaggatggctgcagttgctctaagcagcacattctcatacattgtgcagtagtggaagagagaatgtctgtaacagatatcccttttgaagagtgaggaaatgttttctagaagccctaaaacaagtttcttaaactccatattattggccaaaattgtgacatatgtctgtggctaaatcatgcagaggcgatagagtggaattacctagattggcttatactgatcaaattttacttcctaggcatagggtggggcccagtattcactgaaaaacaacttcttgagaagctgtttgagaaaaattgggattctttagggaaaagatgatgatatctattgggtaaataattaaaagtagctgcaatatctgatcatccctgctccttgcttccaatcctccagcatctccctgctgtctccagagtatgtatgaataaagtgttcaccaagtatggcattcaaggccccaaatctcagaaatcaccgctaaataacttactcatgtaaccaaacaccacctgttcctcaataacgtatggaaacaaacaaatgaaaacggtaatttaaaaaaaagaaatcggggcatccaaatcggtaaagaggaagtcaaactgtcgctgtttgctgatgatatgaccgtatacctagaaaaccctaaagactcctccactcctttctatccatctctcagtcatacaagtctaattgaagttccaggcacaccctgctgctctcatacttccttgccactggacctgccctattctgtctttttcaccagttaatttctactcactcatgatgcagctccttgttctcctccttctcaaaccttctgcaatctgctacagtctgagtaaatgtcccctgggtacactcgtacaatgccctgtgttcacctctcctcttagtacttatcttgttctcctaattgtgatcaattgtgaattcctcagaattctcagtgcctacaagtgcctggccctcgacaaaatgtccatgactcaaatgctgaataagcaggatccatgtctgtaggaagagtaagataatgccaatgaggtttattaactataatgcaagacacaactgtaagttatgattamtttagtaacgacatcactcattgagctgtcctctttcattgcatattgtgttgttttaaaaatcatattttagtttatgtcatcttttctataatagttcagactccacgttgaagtaccaaatacacagattactcagaatttcacgtattttccatcttgcttatttctgcccaatacctcatatggcattaagmagaactaaattaaaactttccatttctacatttgcaaaggcctttcctctaaaatgttctaagaaaggagacctcaggacacaagtagaaatggtactgtaaagtaaattgaaggttcagcctctggacccaggactcctgcgttttccaatcaccagatggaatagcgcagcccagcggctctatatcccctgttgtccctaatttaatggtgcctcccttatggtgaaaacactgtrcagtgatgtttgaagggattgatgctccatggtaagcagacttcgccctactgggaacatgaaaaggaacctctctgatttgtggctgtaaycctcaagccctcgtttaaatagccagggcagtttcatttaatcaacaagcatgtgttgagtgcctgctgtaaaccaaacgctgagacactgaggagagaggatgaaaaagactcaacaggtctctgatcttgtggagyttacattgtgatggaggggtgggacactgggaagatacagactataactaagaaatagattaagaatagagaaaaacagtagacattgataaaggctatacagagaattatagtaggtggttacctcttacctctttaattcagatgagtcaaagctcttgctattcactgactgctatttgcttgacagcagtgtatgacatcctcatcaatattgcattcctggaaattgttcatcagaacatcttataagcttcttctgctcttccctcttgcagtagatctgcttcagctcaaacagaaaccactgggtatcttgcccaaagcagacctggctcatgccttctaggataattaccaagtaggagaagagcaaattgttataccattgggcagttagtcatgcactgctttatgaagtctcttctattgttgccttgaactgttttttaaagcacacactttaactttaaagttaatatactttgtactttatctccttaactggattgaggatgaagagactattttcttcttgttcatatacccacgacacccattattacttggcatataaaatgtatccagtaaatgtttactgattagatgtattgatttaaagatgaaaataagctaaggaacaataaaaggaagtttttggtatagtaccaagataaataacacatgcagaataactgcaggggcacataggtcagaagacaagaaagacgtggaagagaggagcttgagctggacattgaaagatatgtagtataagaatggacaggccaggcacggtggcccacgcctgtaatcccaggactttgggaggctaaggcaggcagatcacctgaggtcaggagttcaagaccagcctgaccaacatggtgaaaccccctctctactaaaaatacaaaattagccagatgtagtagcgggtgcctgtaatcctagctacccgggaggctgaggcaggagaatcgcttgaatccgggaggcagaggttgcagtgagccaagattgtgccactgcactacagcctgggtgacaagagtgagactctgtctcaaaaaaaagaatggacagaagagggtagagaaggacattcctgatgagataataatatgaaaaaggcaggtgtccctgtggggccggaaaggaaagtgacaccactttcctaattcatcttgcagggcagtgggcaatgagaataggtgagtacctctaggccagatgaaaaagagtcataaatgtcaggtgaaaactctcatagctgatgcgaagataccggaacgctttacaaggagagggattaatcaaagcagtgttttagaatgtaaatccctaaagcttgtgcatgcctagagcatccaggtcacactcaagtagaaggctcaaagtaagaasacttaaagggaacgaggagcttgaggaagtagcaaagggttgaaaacaattgctttagaaaatcagataatgacattatgatgttgctccattgtatgtactataatgacccataaaacactattacttaagtctctgtaccattttccgtgccttctaatgacatagcctagaaaagttttccttttctatcttccccttttagggtctcaagattagctcttctgagttccccttcttatccataggactttccatccatttcactttacaagttctctaatttatttcttatgttacactttaatcaatgggtagctacagtgtatataaattatggaggatacaaaaatgagatatggacccttctctcctggagctcacaattgaaaactgattttggttagcttaataatcgtgaagataagaataaagacttcatcacagaaaactaaataaagctacattaaaatttctaagaaaaatatctaaaattacttgaaaagccagtggagtataaagaagaaggatttcaaaatatgttttctccttgtcagccatgtgagatttttctctctctgctttaaataattaggaaatgtagaatttattttgacttgttttaatatatgaagtgattttaaagtgtgattttttaaaaatgctattaccaaaactttcaaatgtatacaaaactaaaataatatcatgaacccccatgcacccaccactcagcttaaggagtttttcactcatggtcagtcctatttcagccacacagcagctactctcctacacccagtttattttgaagcagatctccaaaatcacatcatttcatttataaatattttaatttgtatttctaaaaggtaaggacttggttttatttgtttttgtttttgttgtttgtttgtttgttttttgttttttgagatggaatcttgctctgttgctcaggctggagtgcagtagcacgatctcagctcactgcaacctccgcctcccgggttcaagtgatcctcctgcctcagcctcctgagtacgtgggattacaggcacacaccaccatgccaggctaatttttgtatttttagtagagatggggttttaccatgttggtcaggctggtctcgaacacctgacgtcgtgatcctcctgcctcagcctcccaaagtgctgggattacagtcatgagccactgagccctgccaaggactcatttttatttatataactacaatactattattctacctaaaatattttacagtgatttcttaatatcatatccaatatatggccagttttcaaatattcccaattgtcttcatacttctttaaaaatagttttctaatgtaaaccaggattccaataaggttcaaacaatgcagttggctgatatatcccaagtttcttgtaatctgtaggttctacttccatcttttttcttcttaccacttatgtgttacagatgccaagtatttgtcctaactccatttccacggcatcatttgtcatgttcccctatcccttgtatttcctgtggattgagttaaatctagaggcttgccctaagtttgattttttttagcgggggagagggagtgggctaaaatgctttctagatgttgctgcttgttttcataggcataatgtctaattatctccctttttatgacattagcagcctagatacatttgaagttgacccttgaacaacagggagtttaggggtgctgagccctgcacacaaaaatctgcatataacttttgactccccaaaaacttaactactaatgagctactgttgatcagaagtctttatgataacatagtcaattaacacatattttgtaaatgtattatatactgtattcttataataaagtaagctagagaagagaaaactgttaagaaaagcataaggaagagatacatttatagtaccgtactctatttatcaataccatctgtttacaagatgaattttctgaaatggcaaccacggtggcacacctcaatctgtggtacatatcaagcaattcaactttttcttgtaaagtcacgacttttccctgcttcttgggagcacttccaacatcactagttgcacattgtatgagtcctatggtgttagtcaaggtctacagtattacactaaatgtgatgaaaagtatgtgagagccatcacttcttcctgtgatatgcaatttactggagagatgaactgctcacatagaggtgattagcatccgcagcattttaccagatactggcaacacttgagctcaccacaatagcaacaggaggtagctatgaaattactacagtagtacagtatgtactacagataatgttctgcagttatgatttaatactacatctttacatttgtttacatttctctcatctgcaaagggagccatgtacaatctgtgtttatgtgcatatgttttgacaaattttaactttttataatagatctgtgtatactttgtggtagtaaatgctaaaataaactagcatccacatatatttatgcattcataacatacctttttcttaattattttgatatttccagactatgtggttcattgtagaatttttttaaattgtcacaaatctccaaaaaatttgtggaaaaaaatatttgaaaaagtggatccacacacttcaaactcatgttgttcaaaggccaactagatttaatttcagtatattctgaatggtacagtctaatcatgtaattccttctttattaatttaaataaatctatgcaaacagaactttccccttatcagctattcagttactctgagatacttttgtataagaaggtaggataaatgcctcattctttctctttatttacctatttttaaaccatcagtttgtttactagtatcacccaaagatgatttatttattttttgtgtcattattaactgatggatttaaaaatatttgatgtgtttcattccattgtagtagctattttattgatgctcaaattgtcccatctttggccaattgaaacatctttaaactggttctgagtccttttgacatgaccctcatagttgttgatatcatcctggctttctgataggacaaattgtttcaggctatcttgtacatgtcctgccctagatctgaaatcagctatctcttcaaagaatccaatttattttcctaggtcatagtatttagaggccacagtctgaacagtaagtgtrtgtrttgctactggattgttcattgtttctaggtcttttcagcagacaggactaggaaacactttttttctccaacatgaaattatattactaattatatgatatttccaatttaagttgaggactataaaattgcactttacctcactgatgttacatctgcattttctttttcccctgcctacaatcctggctctcagtggaacaacataatcactcatttgctttatcccacaatacacacccagtagtctcagaaaaacagtatcaacacgatcaccaacagtataactattgaaaagagttttctgtagttctttttgtttttagtatgtatattctactagagatgtacaaatttctgttaacctatgatgcatattactctaaatatgatatcatttccatttctctcyctctctctctctctctctctctctctctctctctctccctctctccttttttagagatgggatctcacccaggctggagtgcaaaagtacattcatagctcactgcaacctcaaactcctgtgctcaagcaatcttcccacctcagcctcccgagtagctaggactacaggctggcgccatkgtgcccagctaatttttttaaaatttttatttttagagatgaggtctcactatgttgcttaggctggtcttgaattcctgggctcaagcagtcctcccacctcggctgcccaaagtgctgagattataggcaggagccactgcacctggccatttttattatttttgttttaaaacctccactattgatttctaaaatgtttaaatgcttattttctaatttttctttataatgtggggaagagaatatgagtaggaatcattatatgatttatgaattaccttggagtgtcatagttagatcctcaggatactattgcctgttctttcttcttagacctgactcaatttcacaatttcattcactcattcatttaagaaacccaagtaaatgctatgaagcaattggaaaagaggcttaaggagagaatttaacatatatttgttgtttactatgtgtcaaaattatgatagatgctttacttatctcataatttcataagaacattttgaagtataaattattattatgtgaccaattttcaaatgaggcagttgggaatcagggagtttcctttgcccaaagtcataaagatattaagtagagaagctagaattaacatatacagtctgttttactcccgtgtcacatataagatgcagtccctgtccttaaggagttaatggagggttgagacccaagaagaacagagtacaataggagttcaggccaaaagaaaggtattaaactgccggggcctcacaaagaggtggcatttcacctgattatcaggaaataataaaatgtgctggatgtagagggaatgcatcccatgtcaaaaattggagatgagcaacattctgtaggtaagaaaatgtgaggggtatttaaaatgataaccagtcgggttggaccaaagtttagttaatatagggaaatagaaaactaaaagcgttgcctggaatctcagttgggatctgaaggtcattctgaggattcaggacagctagaaacttttgaaggtttgagcaggagtgaaatatgctagggcacaatcctagccactgggcaggctccggctaacccagatccttctccttggaaggactccagacaaaacccaccctcatagatccacaagtcttgctgattgactgcatgtcttctagcaatttcctagaaaagttgcattttcttcgatgttttgctactggaagttttgccaaattaagtcttccagttgaagagagatggagtagccccacatagcattgcattgcgattggcagtggttttctgaagtctcagatgtgagcaaataaagtctgactctaattagacatacttaatctgctcgttgaaacttggagtcaaataagtcttagagtgacatttcagtcttagagtracatttcactgatttcttataagagctttgctaaaaaatatgcttatcaatttaatcaattataggattctagaaatcacaggaaaaacatcacaattaaagagattttggtaaaactgagttaaaattgggtaggacttkttactataaaaataagttatatctaatgttatacaataaactgcctagtttggataatttcattagcttaaactcttccctttgctcagtattaaagttcagaagtkgccacctaacctaacattcttacatatccccctcatggggacttttaacacagtgaattaagtgtcccctttattccatttttttataagaatgtatgagattgcataattcatgataactaaacttacttttaaaatatgacatttgctgtcttaattctttccagttcataatctataaatcaaatatggtcgagctctgtgaaatctattagttatgcatcttttgagacctgagtgatccgttgcctatcataggacgagatatgaagtgtgtcctcagtattcttagtacccacccttctttccttccttccttccttctttccttccttccttccttctatacatgtattttttgtaatagcttgaatagtttactgtcatgtaagagaatagtatcttatgtagaaacatagcgtggacttcaccaatactcatttttggaagtttaaacctaagagaaaaatgtttgctggatacatctttataaaatctacatttttacagaaatagttcattgattattataaatatcatgtttgaaaaacttttaaaaatgaagttacacacagatattgtttaatacctttagcactatactgygaagtgcactgcagaaataaagccattgtttatttagatgggtcagtgattccagactcactactcctcacacaagattttatctgagataccctgatcattgtagtcatttggcttgtgagcttcagttgcccccccatacgcttaaatttttcattttgtgctagtgtagaccaagtcaaagcccacataaacccaatatatgtgttaaggttagagttgtgcttcacactcttgactgtactttaaaatcacctggggagcttttaaaattatctcagtgctggggccccactcccagagagtcagagctaattggtcaggctgcaaggccacaacagttgcacaaatgcaggtggcacctcttaccaagaacctcttcatctccctggccttccaacttcctggagcacaactccactgttttccatgtgaatagcacccctgtacttgtgcaaacttggaagccctagcgatagtggctgagcacccatgttttcagaaggcccccaggtgttctaatatgcagccagaattgagaaccactgacatataactttgacattaggtgtatggattaaggagctgtgtagaaatagattcaagatctagctctactactttttagctgtgtgaccttaggaaagtcatttcactccttggaacctcaatttcttcctaaataaaatagtaatactaatacctacctcatgagattatataaaagaaaaataagatggtcaaagtgaaatgcttggcacaaagttaacacttaataagccacttttattattttagctattaaagcaagatttctatattagtctagattcctacagtactaagttacagaggtctatctcagatgatctgaarcaaaaatggggaaattaagcaagccacggaaggatagagtttgatttggcctcagattttggcatttgaatgctgttaggacacatattctctctctctttctctctctggggcttattccagcttctcttttcatggtgcttgcattctctcagcccaacttccccccttggggtaaaccatgaccatgggcagctcaagacatatcttttcagcctctttagcacagaacaggcaaaaaattcatcctatctgacccggttggaaaagttacagtgacccagcctggctccatccctgtggtcaagagctgtagtcattaaaacggggagaaggagtgctgtgcaggtaaatacaataaccagctttgtttcattgttgagacctgattcaaaataaataaaatacataaaactcctgccattctaggatctattggcagacaaggaaagtcagcagtaagatcccaagagcaagaacttccctgaaattaaaacacctagtctctccactctccatgatctatgcacaataatcaccccttaaggtgaatttaagatcacagaagtgtgccttatcccctctggtccagtttayttgagacgctcaaactcacaggcaaatgaggagttgaatcacttcataccaagctcccagcaatctgcattattgaatacctgaagtgttctgtcctcccactcccaccccatggtatttccttacccatacaagtgagaagactaggcagagttatttatttatgtaagtgttatttataggaacactctctacagctactctaacgtgtatgttatccaagaataaggcaatgaggtaaaacaaccacaaaaggcccagaaacatcctttaacatttggattgttctaaccacttacctgacacttgtggtggagaggcaacaagtgtcatgaaagagcaacaagattcatcacttatagcagtgtgcttttgacaagttacttaacttcctggagcttcagtttcctgatctgtaaaatgagggcaataatatttcaaaggactattgtgagaattgaatgtatttgataagtgataatgtatttgaatgtcaattacactctgtacagttgacattaaataagtggttttccaaggggggtgaataattttatatttaaagcattattgaaaaagctttgctatgaacatgttctcatgtatttggacccagtagagaggatgactgggcatgtactcgactatcctaagaaacattgcaaaagaggcacaagtactattggtactcaccagccattgggttcttagcatacttactttgtggttacaaaaaagagtgatggagctactagcatacactataaccaccctgctactatactggttcagtgtccttgtttaggaaagcagcctgactcatttcactgtaacatggtacaacactgcagagaataatgccaagaagaaaaatgtcaaatattaataacattactagctcttctatttcaaagaatgcctctagggattttgaggtctctttatagttcctattcagccaaagtaaattgattgattataggtgataagagtcggtggaggattatatgagtgaatgtataaaagcacctggccaaaggcacagaatagcacttggactgactctcacaggcgayatcaagttctagtttgtctgctatggactgactgggtattcttcactgtaaaggagcctcatccctaatggtgatgtgaagatagtatgtatcccaaaatatacatagggtatgcattttctgtgacctggaaatgggacaagtacctctgtaagcctcacttattttattttttttcacactgccatgagaaagtaaatgtaagcctcttttagcattaaaactctataacccaaaccccacatttttccagaagtgaaaattgcttacaatgtaaaagatgaacattttgaatgaaggagcagtctactcataaacttttaggagcaagagatgaaatagcacaaaactgcctatatcaaagaaacacgaataaagttcagacgtggattttaagttgttcaaaagattggtacttcaacctactaaaatactggggacaaactgatgagaatatcttggaagtgaaggaacatatttccttaattttcaacatgtagtcttggaaccagttttatttcaaattttttctaatataaatatataaatatctgatttatacagtttatgtatcccgtggcaatgtgatcttttgcttcttttattttcttcctacccctcccccatctttttcttgagggaatcaggaaaaggtgtcctatttctcaactgttgaatctatttatgaaaattagaactaaacagtttagcacaattaagcagaatgccacattcatcaaatcttcatttttctaagacttcaattctgtcagtcactagaaagcatgtgctaagtggaagctgtgtttccggtcttttggcatcccacatctgttgacaattacagaggcacatacagtgccattcatagaatggcatgtgtctccctatgccttggttcacaggccctcrgggacatttacaaagtgtgtactttttaactgtcctagaactaaggagtttaattttgcctgagaatgtgtttatgtgccttgtaaaggagctagtcattcccttttgctttcctttattatgatgtgtgtatactctgtgtgtgtgtgtgtgtgtgtgtgtstctctgtgtgtatgtacaccaaagaagaaccacaccaggaattgagcataaaggctttctcttacccatctacacacctttcttgtaagttgctgcttttattttttatttattcttttgttaatagtgtatttcttggcttctgctggattttttttctgtttctaaacactatttagttctgatttcatatccttatgttcttcagtcaagactggggtcagacttctttatattatatatgtaattattacaataaaagtcaccatgtgtggtggcccacacctgtaataccagcaatttgagaggctgatgagggaagattgcctgagcctaggagttcaagaccagcctgggcaacatagcaagaccctgtctctacataaaatttaaaaattagccaggcgcagtggtgcattcctgtagttctaactacttgggaggctgagggaggaggatcacttgatcccagaaggtggaggctacagtgagccatgatcatgccactgcactccagcctggatgacaaagtgaaaccctggctctaaaaaaaaaaaaccaaaaacaagtccctggaccctctctggagctatgccctctttcttttggatctcttcctgacccataagcaaaccatattcttcaggaagtatctagtacctagaaaactgaagctgaatctacatgtcatctatccaggaacttcatctcgctagtcttaacacctcagatatttggcaatacccagaatattgaccatttttcctattttcatccaaatatttaatattgggtatgcatgaccatagtaacattaatttttttcatttaaaagataggtactgcctttggacattgtaagcatctcttgttaataccatgaatagttaaataaattctagtataggagccacctagaggagttgtttaacggctgaaagaagaattaggtgaaaaagaagttgagactgaggctaaagccaattgtggtttcatccacagtggttaatggtgtttcttaatctttaaatatcaaatgtgttgtaatgcttaattatccttaatacataaaggaagtgacctacaaattctttactgtttattgaaaagtagcatatttggaggctttgacaattctacagaagagaggaagctgttaaattctaggctaccatgtccttcaaatgggaaaaaacaaaatgcctgagcatgtctcttctccagcattaaatttttcatcagtttcctattaaactcaaggatatgggaagggagcaattttaattgcttggcacttaaaaagcctcctccactgttcaatgagttagaaatattttgaaaatttgattgcatttagaaccacacaaatttacctgtaataaaatttttgctgcacgcttaaataatgtcttctagaaatgaacatttaaatgaactatagaatgctcagggggtaaagggaagctaatatttattgaagaccataaggtgccaaatacagtatattcattattttatttgctcttcttaacatccatgtgaatgggtattgctgtttctgttttacgaataagaattggggctaaaaccagctgagggggttacctaaatggtacaaggtgcagggcagatctgaaatctgctctgtttgattgcagagtctgttttccttctctgttgtctttacattctcaggattatgttgaaaacagcaaagagtgccatcttattagctcatataggctttacagtcagtgcagcctgattcaccaaagctacacacccaccctcacacacagaaaaccacttgggggctgacttacctggatttgtgtctaaattatcccatatatcaaataatactagatctcctcttcagtttctgctttgtagttagcttaaaatatctcaaaactcacattgtcccagaggaataccaagaatgtcatcttacgttaagtaagtatgtactgtactgtctcatattaattaaatttatggtacctaaatcaagaatccttcagattggcttttgaagtgcactctatctctgccatgggaagagcccattttgaggttttcctacacaaaagaaaagaaagccacctccaggtatccttagggtcctttcaactgatccccaaacagaggaatctagtttcaatggaagtttttaataaacctcattatttgacaattagtcaagtgtctggcattccttctttctttatttttccacttctgcttatgctttcaggctcctttgatgttgtttgcccctccggtggtggtaaatgaccacaatggctaataggctggcttccacaggtgcctgttaacaaccacttcataaatattcaacaggagcattctgtgcgaaagactggggaattaggtgacctgccaaatctttccacatccaatatctatgataatggatacacaaattacgcgggacagaaggaatggccttgcactgtgaaaaaccgaaggggaatcaatacagcctgtggctcccagctcaggcaggcagcctcgcccagtatacttctcccaggtgccgacttggggggtcaagggctttcccctctgcctaatgagcagttcttccatagcaagtcatcaccaccccagagtggtgggctcttatctgtattttaattttttgttataatggtaattagcattacatcttgaatagtaaattaagaaacccaaaacagaattttaaatttaaaaagcttttccattaggaatccagttgcattaattttgtggatggaaggtgagctaaattagccaagtttgtgcattcattacctcgttctaatcctcaacatcacaaatgcaaaagactgtcattagatttgagaactgacaagaactgggatttcacagtatgaatgttgaaagattaatttgaaaagatctcactaaaaaacacaaaaggttattgctaacatggaatattttatattcatagtctgtacctagttttaaaatgcctatttacagttatctggcttaaaaataaatggtacatttacagtacttgatcaaattggaatatttctaggtatcttgttttgatgatagagaagtgtaggtatccaatattatatgataatattggaaatgctttttttatcaagagatatttgactttcaattattatatccaaagagaggttaaaaataaagagaaacaagaaagagaatgggctttttcacccttttacttcatagtatgttgtcaaaaaagaaagttattcttttgcaatatttcaccctttgtgtttgccctgaaaatattaatggtgaagtagaaatcacagtgatgaaagcagtgtcatacatttcatgaaagtacagttaattttcaccaaatgagttgccaagctggtagtgggtaaaaatgtaaatgttcatctttgatcaattgaattttaatgttgtgaatagctgtatgccttgatttatacatctgtagcacattttaaacatctgtgttcaagatgaccatttgggaaaagattcattggcttcacttagttcatgttgtttggttctatatactatattcaagtcccaaatgagacttttctaaaaagaaattttacacaaattgcttactttattatagactgcgcaacctagaatggcattttaaaaaccagcatgggtgatttcaccatgagttttcaaaggttatacaattgttgaagaatgaaaatgtatccgtttcaacagtgaaaatgagaataattgatatttaaatgctacagtagctgaggctaatgtttctcttaggagctctgttaccacaggaccctcactctctgtgttgtctttattagtttctaggagatttttgcatttagaacctatagcctagcttttaaaaaatgctactttaaggtcatagactggagtgtagcattatttttcatcaaacttgattaattttaaccataggtagctcaaaagaacagctcaattaaaactaccacatatacaggaagaaaagaaatagattgcctgtagcttagctctaaaataggaagtccaagctatactcgaaataacttttacaggtgacccttctatttttaagacaattataagctgggcatggtggctcatacctgtaatcccagcactttggaaggccaaggcgggtggatcacctgaggttgggagtttgagacgaacctgaccaacatggagaaaccccatctctaccaaaaatacaaaattagccaggtgtggtggcacacgcctgtagtcccagctactcaggaggctgagacaagagaatcacctgaacccgggaggcggaggttgtggtgagccgagatcgtgccattacactccagcctgggcaacaagagcaaagctcagtctcaaaaaaaaaaaaaaaagagaaaagaaaagaaaagaaaattatagtattaccatttctaaaatgtctaggcagccattgctattaagaaagttgcattgcttctatttaccttacaatgtgtttgcatctttcctaaaagcacaggcctagaagtaattccaatgatccagggggtagtccatagtctccccttcgagaccagagctacagctgcagattttgctaacatcagaatagtccgctagttcttcttcattttctattagtacaggaatccccccatgggcttaaaagcagcagctttgttataagaggatcttttaaaaaaaattactcttgagatccctttctgctggagatatatttattttgtagtcaataaaaacttacaggaccccttctgaaagttttgcttggtaactcataatttaaacatctgtcattttttcctttttaacactaccctttatgtgtattgaactcaacctaggatggggtagggagtactgatcctttctttaattttgagtggccttttggaaacacttacccctggaccagtagtattcaatgtggttaacaatctcctgtacagcttattacaagcgcaaagactcctgagcccaataccccaaaatactaatgtagtaagtgtggggtgagactcagaattttcatttttcttaagttcccctgcgggctaagaagggcatctgggaaccatcctttgaggagtaagatggtctctgagtccttgtttatctgtttacacagaaactacctattgtaaccacctaagaattatgtgatctaggcagtgttttcccaggtatactaatgttaacagttgcagaagcaaaaggataacactgaggttacttcacacgaatggatgtttgatggattctgagagttccctggagtagggagacctgggtgagttccagggccctgatgctgatgctctggcattgtgcaacttaaatgactcagttttctagtgtgtgagtggagataatcatctttccctcctacccacataattccaatgctctgacaaatgtcgaggcactacctgtaaaaataatctaatttctacatgatggtgtagttatataagtaaaagttttccagaacaaaataccaattgaaaacctagcattttttaatgttttataatttccccccattttagatgatagcttgtaaaactacttcctcacagactttccccataactttctactttacctttaacctgtgctaattcatttctataaagacattgagataccagattacatgtcatgtttctaaaccactctctaactggtgtccttggaaatttcacatttcccacactcagaacctaggagatcaaccatatttgactcaccgaaaataataaccagtctgggatatggtatgggaaaaaaattaggttaaaccacaaaactcttcccaataatgagtcagtgtgtgagtgcctctgtgtaagacctcatttaagagcagcaggagctgagtgggggacagttctcaagcggttctttggaattagcatttttgcaaggaagctttcttacccaccccaactagagaaacctctcattgttttacccacctcatcctctccaaacattatgatgcaacttcacatcataacaggatgctgcaagagtccatgcccctttaacttctgctttgtctaagaccaagaacacatctatggctggacaaattgggtttatcattcattgcagtgagggagaactcatgtcatggggacccacgatgcatctcaataaaagggtgttagaagggcttggaggaggattgagattttgtgtagaggagagtttggtaagagtccaagaaagtggcgttcgctctagactgggcgctgttgggaagtggggaccatsctatgactgtgtatcttaataaactgtgtctacagggacagaagcccagaaggagactaaagctttaattagtaaagatgcagccatcacttatatttctcagaagaggggatgtctgatattttgtggtttgccagtgactttgttttttctgggcttaaatgaaattatgaactggctagttttgactgacttcagtacrgtcacagagtgaccttgtctgttgctggcgttccatgagattagttatttgttcatgaggagaacagatggcatggtttctttaacagcactgatacctacttgtaattgtcaggccagttcccagatgtcagaggctacttcttttttagatcagatacctttgtagcataaaatcagttttagggcagtatgatttttcatggtgaacattttaggttctctttgtaggtgctggtttttaaattaatctttagttttgccattgtccatttatgatcagttgatctgatttcaaaatgcaaatccctagcatttaggaacttatacattgggaacatttagggatttaggaaaagtgggaagagtgaagaaaggtttctcccatgaagcagtgggtcagtagggaaattataaggaagaccaaagagaatgaaatggttaccaaagtgtactaatgtgagagatacaaagatggatggatadatggatggatggatggatggatggatggcagagagagagagagagaggatgaaaatgtcatgctcatctgaacctcattcttatcaccccagggaaactgcagttatcctaaatgcctctggtaccaataactgacaaaacacatgattcctaccatttagttattcgtctgtttgtatgtatgtacatacgtacatatgcattgcatctgtttgacacataatactgaaaccgtatactgctaaaattatgataaagagcagctaatgttccaataggcttttcttgcttcatagctaaggggaaaatgtatgggatgaaaactccagtagaaaactgtgtgcggcatttagttttaacacccactacctttgaaatctgtcaaaaatccattgtccgctgtggttagcctcagaatcataaggtttaaaggctataaaatgttcagtttcatataaacatagaatggattcaggatttgaggtgatgcattccttttccaataggtacttctgcataactacccagtagagaaggatcctttcacaaraggtgtgggaaaactatactacaagcctgcagtaaccaaaatggcatgttacgggtacaaaaacagacacataggccaatggaacaggttagagaagccagaaataaagccacacacctacaaccatctgatctttggcaaagccaacagtaaaaaacaatggggaaaggactcccaattcaataaatgctgctgggataactgactagccatatgcagaagattgaaactggactccttcctctcaccatacataaaaatcaacccaagattgattaaagacttaagtgtaaaacctaaaattataaaaatcctacaagaaaaccttggaaataacattctggacattggccctggcaaagacttcatgatgaagactccaaaagcaattgtaacaaaaacaaaaatcgacaagtgggacctaattaaagagtttctgcacagtaaaagaaactgtcaacagagtaaatagacaacctacagaatggaagaaaatatttgcaaactacgtatctgacaaaggtctaatatctagaatctataaggaacttaagcaattcaacaaactaaaaacaaacaatcccattaaaaagtgggcaaaagacatgaacagacacttctcaaacgaagacagacaagcagccaacaaacatatgaaaaaatgctcaacatcattaatcatcagagaaatgcaaatcaaaaccacaatgagataccgtctcacaccagtcagagtggctattactacaatgtcaaaaaataacagatgctggcaaagttgcagagaaaaaagaatacttacacactgctggtgggaatgtaaattagttcagccactgtggaaagtacttttggagatttttcaaagaacttaaaacaggacctaccacttgacccagcaaatgctgtgtgtatactcagaggaacataaattgttctaccataaagacacatgctcacatattttcatcgcagcactattcacaatagcaaaacatggaattaacccaaatgcctttcaatggtagagtggataaagaaaatacattcattacctgggtgacaaaataatttataaaccaaaccccaatgacacacaatttacccatgtaacaaacctgcayatataccccctaaaccaaaaataaaagttggatagaaaaaagaaagaggtgtgagaaaagaccccactgtgacacataagtggcatagataacagtggagattcactcacatttgwtgagtattacctagacagtggagattcactcacatttgatgcgtattacctagacaaggaggacaatggcccctcttcctttctgtattctttgtaaagggtaggccttctgagaggttaaaccaccaatcagaatttgaaatctttaaagtaatcaatttatccgctattcatttgccttctactttaaatctaaagttttgtcacagccaatatttakagtstctgacatcactgggatcagaatggaaatactaraatctgttttgtggtatcytaaattcactgaattagtatttattgtaggactcccatagggtgtgagtctttacaaataaaggtagggaatgccctttatttgtaagggcaaataagttcctccttctcttgtcaaggggatgtgaaaacctccttgcacattttttcttttctttttttctctttgcagaatgagtgttctgagaagaacaaaactcttttctgacaactcttataaaacacttttgtgtttgattctccaacgactaagatttggacacacaattctccattcatttctcaagtgtcaagaragaattgagtttaaaggctccaattcccttgcaggttacactgtctatctagatgaattagtattcagcacagctttgggaaaatctcaaatgatttgcaggtttgcaaattgttcaaactcataatgaaatttcaggctgaggaaatcactaaacagttcatggcatgagtttttccctctgagatctggacatcttagatcaattcactcctctaccttcgctgccccatccatgccagacagcccagggctgcttgagaaagtcacacacacctgtcaccactgaggttattctcctatccccatgtcctcccctgctcagcaaaccagcccactctccatccattttcattctttattttctgttcctatagcatgtgttcctcttcttatccmgggctatgttctgagtccggtccccctctatgccctcaagcaactcaaactggcaattatttatatcctattgcttcaattctctctcttctctaaacttttcccatcagaatataaatatttcaagtattcgccattaaaawatatatatatatacagctttacccaactttatgaacctccagctctttcttttctttgcagccaagctttttgtcctctcactcattcctccttccagtgcatcctgaattccacttggaactgtccaccaggattaccttcccaaggacacaaaggtcctccttttggccaaattgaactggtgcattctagtccttttcttgtttgatttttctgaagcattgacatagttgaccaccacttacatcttgaaactctgtatgtccttagcttctcttaactcctcttttcattcctttttygcttcccttccttgtgccagtcccttacgtgttagtatatgctaggatctcatccttggactctatttattcaggtcactgttcctggaagataactctatagattctcaaatctatatctacagattttggaagccatgtggccaatgttaccacttgggtatcctgtaggtatttaaattcaacatgtctgaagccaaacttctatctcacccttaccacaacccatctctaggaatagaaattatcgtccaagtcgctcaaacctgaaaacttggcattgacttagacttattttcctcattcactctccctyattcagtcaatccttaagataatgccatttctaccctttaaatgtagcctctcctttattcattgtactgctgccttagttaaggcactcaaaattcctcattactgcattgctcccagttgtcttcccaaaatgtggcttcccattctttcaaggccaactcttgagcatgacatattggtatataaaggcctacatgacttgacacttgccaaactctccagcctggtctctcatgggtttttcatgtggacttaactctggccatagcatcctgctggaaattatttaaaaacaccaaattatttcacaattccttatttcatatgctattattccctttgctacttatcttttaaggcttagcacagagagcgtcttaacacatattactcaagagatgttagcaatcactattgttgtttttgttgtcatgtctccctttagtatctaaggctgtttggtactcctcctctgttttcatagtaaacttaaaacatagccttaatcatactatatcatagttggctacttgtttttcttgtcaccaaattctgaattttacttttctcacttacattgccttcctggaacctaaaagcatttgggcttgttatttctgtttaaaataacaaagaccatcaacaaatttccagtgaaattatagttgtggtggggatgatgatgatgatgatgatgatgatagctacatttattgaactctatgtcctaggcacttgctaaatgtttttaaatgttttccattataatcttattaatgatttcatttaatgggtaaggaaactaacactgagagaggtaagtaccttggccaattcatataagttatgagtggtagagccaggatttaagcacatagagtagtattccagagaccaaaaaataaagaaatcattatctatgtcctgatactaaccttatccttattactttatgagaaagagagcctggaaagtcaattcaaaatatttgttacatgtctactttatgttggattgaattaggtctttgaataaaacagctcttctttgaactttatctcctagaaagggaaataagatatgaacctccctaaataactaggcaaaatattataaatgctaaaacgtacaactrctataaaaatggaaagagagaaagtttaaactggttgaggaaaactcaggaaagtcatcttggagaaggcggcatttgatatgtgcctgaacagttgagtcctaatgcgtgaagatggcagaggattgaagagtgcatgagatttgaagggtacttgtaaggaatggaacaaccacctcttattactctgctttatggcaaaggagtaagatgaaggcaagaggccttcatagagctttctccctgcagagaggggaagagtatagtccctcatgactcagaatctcttggttgctgccatgcaggcatctatggaatcacaaaagcraggcccaggaaactttaaactaacctatgcttcccgcccagaattcagtctatttccatattagtgggtgccttctgtccrtacctatttctgtgtgcaatgtgttgagtcttttgagtggtggcttaacagcccaggagagaattgagctatactgaggcttcatatatgaacacagtatggttctattcttgaaaaggtttccagcgtccttttccaaaactatagagttgtgctgctcctgtctagaaagcagctcagtgaacttgaccttgacccttctgctgtatgaacttctcagaagattgcagatacttttattcaataagtctattccccctttttttgtttagtcaagtaggtaactattttgtgggtatattttctaaggtcaaattcctaatgataatagacaacctgaagttgatagtggccaactccgtgacattgctacttgataaatataccaatcttaggatctcttcttttttttgagtacacaaaaatcattttgaaatgcctgacttgctagttttttgatgccttacatatggaatatgcttaataaattacatttgttatttactatatgtgactcaatatatacatatgcaagtacgtatgtgattgtaacccccattctttagtcctactctctgtcaagaataagaagcttaaaggtccctataaccaacacagaattcaatggcctctgtcgtgtaagtaatgctggcagctacaacaagcaatcccatctcagtggcttaacaaaacaaacatttagttcttgctcatgttataggccagtggggaacagtttgtgggaggggtttggggaggaatattgtgcgccatgcaggtattcaggtatccagacttctatctactgacctggctgtgccctaaggtctcagagccttgaagttctccactggaacctctgcaactggttgcccagacaaggagagagagagagagagaaagaaagaacatgtaaatttacaagagaggtttctggaagtaccacacatgacttctgcccaaattccattggctagaacaagttacatgttacatggccctaactaagtgcaaggggagccaggaaatgttgccttcctatgtatccagaagaaaaataaaatgatttgttgaacatacagcattgtctctatcacagcctttatccccttcattattccactcatttctagtattttgaaagtttcaaggtctcccccaaccctcagatgtcaagagggcctcctagtagattgatggagagagttggggatacataaagaatgcagtcttcccaactttacactactctctttttcctggatcatggctttctgcagctgcttctcatttagttcagtccaaaaacatkaattgaaatcccaccatgaaccaagcactgttgtaggatctggggagtcaatgatgcacaagacagtctctgccctcaagatgctgagtctagtggggtcctctactactgtggcatgttctttcatcaactccaaagggctttctccagtgcttttccccctcccaaacttctgggttcttcagagagaggtcatactccccttccaactctagacagcaactctcagcagaagccctgctggtccttacaggaatagtctgtgtttccaaaaaccttctttgaacaccctagaattaattttgagggataagtctagaaaacataacccagagccatattcctgcttattattaaggtcctctttagattatgtcctcaagcatggcacacattcactgatgttctctggcacaaggaaaactctcatcctctctgagtggattggttgtcttaatggtcacagtacaggtcatcatacacctctggaggaagtctgttctccagtattgagaaaaattagcagtagaatcaaattccccttcacaggggaatttattcaattgggtcctggaaacagccattgatatcccatgattcccaaacagagacatgcaaatagaattctacaatagcctgaggttgtatgtgtgtgtgttcactcacacccccacacacacatacataaacacacagatatgtgtataaaattaaatttagaaagccattttgtagaagagactgacttaggcctgttaaataaaagtttaatttaacaaagcaacccggtatttttttcaccaagtttttaaagcattcaagatgctaaattttccaagatgagttttctggaagaagtcccaaaactcccttctctctcttttttttttttttttttttttttttttgtgatgaagtctcactccgttgcccactaccaggctggagtgcagtggcacgatctcagctcactgcaacatccacctcccagattcaagggatcctcctgcctctgcctcctgagtaactgggactacaggctcacaccaccaaacctggctaatttttgtatttttagtagaaacagggtttcaccatgttggccaggctggtctcgaactcctgacctcaggcgatccatccaccttggcctcccaaaatgctgggattacaggcgtgagccaccatgcctggccccaaaactccctttctgatcacatcctatcaggcttagaaggggcaggtattttcttttggtgggttcaactccacctttgttcattttgattataggaaaaattcttaagatatgtgtgttttttttttttctgactacgtggtttctcctagtgctaaattctcaccatgcttgaaatattgtagagcaaagcagctctagttatcctcaagaaaaggatcaaagaagggaaaatatattaatgagcacaataattcaaaacctcttaaaatgctgttcccaagtgtgctgggactttctggtcatgtctctgcgaaatggatattttggatcttgctttagcatacacagraaaccaatctccaggcagttcttccttataatttctttacaagtttccccttaaagaattcctaatgtactttcctcaatagtaacatagatttttctagagttagaaaattatgagaaaatagagtgagcggctatctcaagtgtgtttacttgtctagtcccctgatattaactagctatgtacctctaacaccaaggcaaccacattattgatttaatgataagctgtacagcagtgaaatcacattgtttcttcatagacacagagaaagcagaagcatagctactgttgtcaaggaggttaaaatttagatgtgaacactaaaagtgggaaccccaactggaacataagttccacgagaggcagccttattcactgctgaatctctagtgtcttgagtagtatctggaatatgatacagttctccagaattatttgttgaacgaatggagatccaacagcatagagcaatatatcaccaagtattaaaactgtaagaatggcaggagttcactgagaaaagtgaagactttatgaagacagtggagttgagcagagccatagagctatagacttccaataggtggaggagagaggagcgggcaaaccaggcaargagagatgagagaagtaacacaggaggtaatgagcatgttgcagtgggaaagtgggcttggctctggtcagaggaatcatgcaatggattaatagaatccaggcaggtcagggatagggataaggacttagacatctatctggttttgtgtcctagcttcgtcatttattcaatagctgaataaatcaccccttttagtctcatttaatatctaaatttgagaataatacatagaacatatatttttaaaattcaagaagaatttataggttaaaaatggtaaacttgaagagcttttttaaaacatggtattatcattgttattatttatgacaacagtgttctggttgaccttttgattgtggttttcttagtgggaaaatagctcatataatggcccccgaatgtatgcctgggaagaaatatgttaaaaaatgaaatctagtgattgaytgtttattggataatttcaaaatagtacaagggaaaaaattattttagtactcctaagtattagaaataattttacagttcaatttgtgtgattaaattattgtatattatatacagtcatttcacaaaattgttatgcgggaagtaaagatccgttcagtcactgagttagcaaaggaacttgattagaataatactcaaccacgtttgtattgtcaggaaatgttagagaaagctttagtgttgttaatgactcttggcatatataatactcctcgtccttaaagaacttgacaaacattgatttaagcctcttttcaaatatattccaaaactaaagtcattgtttctgagtatgccataaaagataaagtacgatttggtggttctcacattaaaaaaactgttgaagaagcagaagtgaaaactgcatattcatagagtaatgatagtttgggagatgatagtgttggcttaaaacaaattgggtggtatgttctgcccacaattgatcaaattgtggtcaattatatagacagattcagcaaatatatagtatttctgccgtactatatatatatatatgatatactatatatgtagaagatatactatctctctctctctctgtttctctccttagagactctgagtctaaagcagacatcactaatcaatcacagattctttccaactgagtctttttttcttttttctttttttttttttttttttgccttttgaccaggaaaaggaatccaactgagttttgatttggccattatgtctctttgagatatagggctctaagtagccaataccagagatcagagttggcacaggcaaaatggaacctacttactatcctagaatcaaggatagttctacgaaagtttcaaagagcctcccttatcattaatggctgcaaatatataagggcatataattaataatacataaatgcaggacttaaatgacagtaatatctcaatctcccttcccacgtgttgctttcttcattcatttggcccttcatttttattcattagattggtggctctctctctctctctctctctctctctccctccctccctctctctctctctctctctctctctcctgatagctcaccttatgttaagtgctaaagagaaaagatataagacctgcttgctgctctgaaagagcatgcaatatggtacagttagggagataagatctagctgtgagaagcagtcacacatcctgcttctttttaaaatgaatgtgattacttgagttgtttgtttgttttgaaaataaaaatgcactcaaactgaaaaaaaggaaaacggatgtatttcttcctgggtttgcaaagccacttctgatttcaaagaaagctgctcgataatttcttacgggctcaactctgaaagaagctcttagaaaccaaagtacctaattactaagtcacccccatccaaccatcactactgtttgagttaaactgcctttttccagaagtagagagaggaataggggagaggttctgtgatgggaaaagaatgaggaccagagtgattgtatatgttgctgtttctcgctattcaacaggcaattgaaggcggctgctttacaacattggcaatagtgccttttcacttaccttcttttactcgcagtttcaaggattcagatttggtgttttgattaggaacatggtccaaaaggcctgagttcaggtatcagctgtgcgatttcagccaagttcttaacctatctacatgtcagtaaaatgacattactgacatttttcatctgtaaaatgagattaaaaacagtgtcactgagggaattatggtgcactaaaccacccagcactacacccagactttgcatgggctgaaaaaatcttgtctagtattatcactggtgatgcttagttgactatattagtttccttttgccactgtaagaaatcaccacaaagttaagatgacttaaaacaacaacaacaaaaaagtgtctttttttacgttctagaggtcaaaagtcagaaatctgcttcactgggctaaagttagggtgttagtagagatggttctttacagagtgtctgaggggagaatctatttccttgccttctagtgccttggggccccttcttccatcttcaaagtatatcactccaatcatctctgcttccaccattgcgttgtcctcttctccaactacctcctggtttcctcttgtagggatcattatggttacattggacccacccagataactcaggataatcaaccatcttaaaatccttaatttaagcacacctgcaaagttcctttttgccatataaggaaaaggtgacactcacgggccctaggaattaggatgtggccagccatctttggggatcattattcaacttaaccacattgactaatcagattattcaacatcattgagacagtctgcttcatagtgctataacgcagagtggtgactgtgaaccttgaggccatgagggtttgagatgctaatcaaacaaatcactttagaaaactagtattttttaaactctagtgttatttctgtaacacccatctatccttccactcctgtcttatctctacttgctcagaaagaaagatgaaatctgataaagcagaacagaagagcataatcctaaaactcagatagacctgagttcatgttccaactgcaacctgatggctagctgggttaccttgggaaaattacatgattgcattgggtgcattcctcaaaagcattccctgagacaaagatttgaggtaggactttatctgaaagatgatcccaggaaagatggatggaaagtgaggaaatgagtcagagaatggaaagaagctaataaacagtatattatcaagcaggttactcctgtgggccactgggtgacctgtgggaagtcacaggcagacagtgtagaacatcagaggtatcctagctgtggaaaagaagctttcatcattggctgaggactgatccctggcacattatcttcygcacttccaggctgctcctgaagcaggctgagaaagccctggggagactgcataggatggcctacctctagtgagaaacactgagtgccacactggttgtaaatggggtactagaaaggcctctctgaacttcaaggatgatagtactcagcttgcagggattttctgagaattagggattttctgagaatcacatgctaaagcacctactagtatgcatggcacataataatcgctcaacaagtggtagcttctaaataatgatcatatcaaaggtttgcctttggtttctgcttatgaaattagtttgcacatgagaagatcactcgacatttttgtgcccagtcgttttttaatctctaaaatcagggaggagagtaaactaaaccatcccaaagtgtattcttaggactaataatctaagtcgtcatggcttagtttctcatgtcctttggcactataatttcgctctggcttctatgctgatgattgtaaactgacctcagctgatttggtcatgtatgactcttaggatctttttggtaaatcatagtagcctctgatgaagttttgaggtaagagttgcctgctcaactggcaacttcactactaggttataatgaacagaaattccagacaaatactgtcacaataaaacatccatcaagtaaacatttattagcaagtaaacacacagttacacacacacaatttatatgacctgttttgtaaacttgagcatgtgtcagctgttatttttagctcctctgacccccatcttgcacaaaatattccctgaaggccatcacaaagattccacagtcaggaatttgtcactctttggctagcatcagggatctagaatccctcagtgttcctggctgggcataggactatttagagatttagtctaggtcatcatccctgagggtgaagtctacaggactaattggattcttgtgcccttgtgaagcaggtgtgggaagtgtttctaaaatatttctgccgatccacatgtaakgaatacttttaatttcactgagagtcttttcctaacattcactggcctacataacaaactaccaatttcatcaacagaaaatctgtttctgactttcagtatgttaattagcaaagcattgcttgtgggttgagatacaggtaacaaaaacttgtggtagctaattgaaaagaccaccccggcattgtgccttcttgattagcatgcagacagctctcgggttatagcttaacctaagtaatggtcacgtggtatcacacagcacatgctgaagtttggggatttttttagattatagtaaaatagacataaaattccactcagcccttgacaaccaacattctaccttctgcctctgaatttgacaactctggatacctcatctaagtggaataatacaatatttgtccttttgtgactggcttatttcacttagcataatgtcttcaaggtttatccaggttgtagcatgtgtcagaatttcatctctttttaaggctaaataatattccattgtatgtgtataccatgttttgtctggttttttattcagcagtggacatttgagtcgtttctaccttttggttattgtgaataatgttgctataaacattggtatacaaataaatgccaaaagcattttgacataaattacagatataacaatctgctccttttactaggaacctaaggaacatgcaaactattgcttaatccttagtattgttgcagtttagtaaaacacttgtagcttcttagtaccttagtatatctaaaagcattggtcacgtggatcttcaaaataagattttagaaggaaacagttttaaactctttatttgttatcataagcctgatttcatatttcattccccaaacagcttttaaaaatatcatttaccctatagtcatttaatttcctatacagtactttcattctgcaaaaatcagttacatttctacagctatttggtaattctgctttgtttctaggatgcagttgcataaaacattatattctgtgacctcaacctcttcatctgtgaatgctgaaatgtgccttcatcttcctttccattgggaggtcccgatactttacagaattttaataacttccctctgtaagaccatgaatgtggatagtatctgctctgaattctgatgatggccacgaatgaatcaagtggattacataccagcagagattggagggcttggattctgtgcaggatggattgtttgtttccttaatttatatgtgagaatgaatgtgtttgtaaaatcaggaaaacccaggaccaggcactgttcttacctacaggtatgctgtcagaaagcccctgcccagacttctggatatttccttaacatgcttggaaagaagtgtgtttcctgagtgatgagttcccgggttctgaccctatctttgcaagtgatagactgcaagttcttagaaaagttgaccttggactttgatcacacatctgttaacacatttttattgagcacctactatgtgtcaggcactctgccaggtgcttaggatacctcagtgaggaaacagtgctccctgctcttgcggcackgcgtctagagctgctccttgggagccactggccacatgtggctaataaaatatgtttaagtttaggaaaattaggtaaaatttaaaattaaattcttcagttgcactagccacatttcaagtactagacatccaaatggagatgtcaggtagagagtatgatgctaagaaagaggtgaaggctacagaaatcatttgagaatcaatagcaggagagccttgggccagatggatcgcaagtgagtgagcatagagaagagaagagccctggcagttccatcattaagagcttggggataaagagagagaatcagcaaagagccgagaaagagaggscagtataggaagaaaacgaaagagagtggaatactagaagccagtgaaaaagcgtattgggatagagggagtgattctcgtgtcacatgctgcaggaatataaagtaaaatgaggatagaaaacaaatcattggatttaatatattggtgaccttgacaagaacaattctattagaaggtgaagagcaaaagccaaacaggaaagaacagaagggaaggaatgggagctactgactctaatagcagaaatttgctacaaaggatctttttttcaaaaaggcttaataggtagtgcactaacatttatgggatccaggccaaaatggaggcctatatacaatatttgtaaataggtaaaagttatttatcaagctaacaaactattaaacaaatatgtgctttgcattatattgacaaatataacttcataagaatctggaaaagcagattccaatttagaattattggactttggagttctgttctataacttggtggcacagggaaagggcctgaggcccacatgccttggcttccaaaccccagcaccatcccatactctgaagggtgtgcttgtgaggggcctgcatgccctggcctgcatatcccagccctgtccacacttcttcaaacaacgatcccctgaatatctcttgagtccaggagtgtgtaaatcagcaagtccaccctaaggaagatggacccagagaagaggactatgaacaccctgtaaggggctaaggaccatgtgggcagagaattctgaggtgcagagtacccatgatctagatggcaggaagcatcagctctgactaagcacttctccttggcctagcaaatgctcacccagagagagatgtatggctggagaagggccagaatacagaccttaaggcacagagccaagggcagctctctgaggtggtggggaaatggggcaaagaaaaagatttttaagataagagaaataacatgtttgctcatgagaacaatccagtagagtgggaaatagatgatgtggaaaagaaaaggatagccaaagccattatctgagtaggcaaaagggaagaggctgtggtgtgcaagtgtagaaatgggctttggatataagcttgaacagttcctctacagcagcaaataagaaggcagagcatgtggatgctgatgcaggtgaggaagtggatgtggtggtgggacgatgtggaagttcccttctgattaatcagcacatgtttctggaagatttctgattaagaatgccttgccagtgctgtttcaggtcaaagttgattatttttgttaatttaatttctatgtaagtctcactaataatgcactgtttttaagtatataaagtactaatattccatgttgtatagctctttcactggcatagtttctccatgaggaaactgaggcacagagagacaawcatttgtcaagggacacataacaactctgctgccattttctcctgacttatgatataacaggcagctcctactggccttttgaatgtttttcttgatttaggagtctgggggttcccaaataagagattttatttttaaagacttgatgggattatgtcaattttaaaaatcaataaaagaactagaaagatgaataagaagaatataactcctttcttctcataaattttatttttaagtgtcaaaacacgcaatttcttttcagatactgaaacctgtgatattatgtgccctttgcctactgcaatygctttctgaatagtcaagtgattcagcgattacctctgtgcacccaaatcctacctgattggaaggaagtcaccggggaggggatggtgagatgacgcactaaagtaaaactccttgtttgtaaaaggtgaataaaaaccacttttgtgttactcatagagactgaattgagatcaactttaaaacatattttgaagaatttccagcttcatagaattaaagtggttaattatagacaataacataagagaaagagaagcttgttgagtgaggattctccaccacattttctcaaggacttcaacctttggctcactcttcctccatacccatattctgccatgatccttagtgactccaacgtccaacacaaaatgtcaccaccgttcagctcatccctcagcatagcttgtaactcatcagcattcagagatgctctccttcaaatatcttgagcattaaatttaccttagttgatccacattgcctcatacttaccaactttcttgtacatcctgaacctacttctcttcttcctgacttccagacccttgacccttccccacccttcactggccctgctccatcccattcctgcttctagccataatcmatttcaagggtgttcttaatagctacggtgcactttcattctccatgctctgctagtttcccacattggcaatgatctccactgttggtctatgccrtacaactcagaattgcttcattcatctcaggcaaaccccctttcagattctctatagtgctgtgttctgaacccttaacatgctcttgagaccacagttctacctttcactgaaggtcttttctccacwatgttgagacattggaggatgtctgtcaggggttctcattcttttcttcccctcacccttcacagctttacccagccctccatcttccttcctgacccagaaggttcccctcctttctaagggtgagccatcaaggtctaccagaaccttgctctgtgaacgatctcctctcttcaatgtctcttcctcagtgattccccctttggcctgcaaacatgctacacacaaatgatttttttttcagttatctagacttttcagactccttgaatgattattccccttctctttcttggtgaatcctatggaatatgtactcagcgcttttggctcctactgccttacccgctgttttatgacctccgcctccctttctggctttacctccattccccacatgactcgtcctcaggccaatgcacatccccagctccctaccttctatctccatttcttcctccttctttgccttccccccaaaaaattctttaagggttattctccatggagccttcttgaggcagcacttctacaaatccatgctatctttctacccaactcttatttttttctatttttactgagatacaattgacatatggtaaaatgcacccagcttgatgagtttggataattatgtaacctgggtgaccaccacccaaataaagacagaacatttccagcaccccagacattttcccagttctacttttcagtcaactgccaacttcaccaagagacaacactattctgatttctattaccagatattagtttttcctgtgcttgaacttcatataaatggactcacacacgggtatgtatcatatttagcactgcatactgtttctgagattcayccacgctgttgcatttatcaataattcattctttttgattgctgagtactattccattatataaatacaccacagtttgtttatccattttcctgttaaatgcatatttaactttttttcagtttttggcatttatgagtagagctactatgtacgtacttatacaagtgtgcaagttttattttctttcttggraaaatatctaggagtgggattgccrggtcacaggttaaatatatgtttaactttctaagaagctgtcaaactattttccaaagtggtttttaccccttttcattcttcacatcccaccagcagtgtgcatggagtctggttgctccacatccatcccctacttctgtgtcctccttcttggctttttttggcatcactgcctatattcttagagcatcttatctcatctcccctccacttgagcttctgagggactgcagttgtgccttcatcatctctgcacccccacactctagccttccttaaagctctaaatttgtacagaataggataatatggaatccagcgaaggagccagggattcgggagttctgtacaaacaaccaagtggcccaaccaaatcaatatgatccgactcacccagcagtgtattacagtattgcagcttgaatgtggggctcctgcggccatttgtcacagtcttcaggaaaggctttttatcagattcatagtggcaagtgatacarattattggatttcttttccaacataaaaaatagctatttgcagccttttgaagctgggtaaatgagccattgatcttacctgtggaacaccgcagggtatttttgtccatcctaactttcaatattctatgatgggagcccacccctccagccaagctggtctaatcattattccttgggtgtgcctgatctgtatcctcctccataccttttcccacaatgtagagaaaatttttagtggaaatgtcctcccttttcctcctcctagaagctgtcttcaaggcctggcacaaatgccagtacgtctatgaaggcttcccagctgcatcatcctgtagtaactcttctctcccatgaattattacaaccttcccaggatgagatgacggcctccctcatagcttcctggacttctaaatagaaagaggaatctgagaacagaagagagctccctaaatgacaagtgtaccccagatgtctgtggccatgtcccagarggccagctgcaatgcagggcctctcttttgatgtcccttgttcacaacgagccatttcacttctagtcaggactatctgcctcctaccatcatcttgaagcaataaattgcttcagactgtgtttcatcacttaccagtcagtcaagagcttgggttgcattcaagagcacatgttagagcattctgtctgctgagtgtgtgggaaggcacagagtaacatggccctgcctcatgtcgtcagtgcaggatgctcatttccaagggggacaagaaacattcagcttaaatttggtaaatatcttgaacaaaacaagaggagtctaaaaaccctccaggtttcttttctcttattctgtctcactctctgtcaaagcaaaccagcacctggtctgtttcttcatatgctctgggatatcttccygaagaacagcctgaaaagcagagtcttctcttgccattgtccacactgatctccaggaaatccttcatctttaaccctggaaaatggcagctggagaaccaaggaataccaccctcccatgcttccttattttccctttccagctttggtactccactctgtcctcacctcccatttcctataaaatatgtttattcattaaaaagtatttaatgccttattttttattatttttattttttttttatttttttttttgctaagacactgtggtaagaattagaagtccaacaacagacaagatgaaaacagtgtctacttctggggcttatattttactaggagatatagacactcaacgagtcatctacaaaagagtatcctgactgccatcttagtaaaagtacaaggactgtgggcatatgagaggggcaaagaggccaagctcaggacatctgggaaggcctcagagaagaactgacccataagctgatgagagttacccagaagtcagctggaagccatgagggtggcatggcacagaggacatgggtgggggcacccagcaactgagagcatggcacaataaggaagcagtggcaggtatgagagggagtggtgaagacaaagctgaaaagggcagcaaggatattcccatcacaggcctttcttgtacgttctaagaaagagtagggacttatagcaaaggggagccatttataagctcacacaggggaatgagggcatcccttttgtgtttgcaaaggccgtgctgcagcagcactgacagcatggatcagagggcaacactggacaggcgggaagacagaggagacatgacaatggcttccatgaggggaggggcagtgctgatggcgtacatggaggcactagtgatgtcacggagaggaaggagtaaaggatggggctctggtttcaggcttgcgcctctgggataatcgtagcacacccacagaagttgggaagactagaagctgcagatctagggacagagggaagccatttcggggatagtttgctgtgtatctgggcctcaggagaggcctggaccattggggtcacaaatcatcaaaactttgctagtcatgctgccctgggagtgggttagacagcccaggagaagaggagggatgctaaggagcaggcaggtaaagagaagcccatggagaagactgcggggccatcagcgagtgggggcaaccaggagagaggctaccatgacagggcttggggaagagttttgcaaggaaggcagatgatcaagcaggtccagtgtcccagaaagacctttttttgtttttgagacaagtcctgtgctgtcgcccaggctggaacctcaagaggcttggctctgaagggaggagacagagagagcagcagcaggagaagggtgtggggtaaaagaatgggttggtttaagacaggaggaacrtaaacaggactttaatgtgttttagaatgaagaggatgagtgaatgaatgtttggtgagaagcaattacaggatataaagcaaataattagaatataggcacagtgtttactgacttaaacacttaacaacaaaattatatgatagtggactgaatcctcagtttgcaaaacagagaattcagttccatgtggtggaggcagcatagtgagcaggttctggagcaaacctctgtggtgcattcccagttgagggtggctaagggcaagtgacctaatctctctaccagaaatggagataatcacacccatctctcaggcaacaacaactgagctcagttagagcgcaacaaatgtcagctctaatcagctactgaaacctaacattaagggaataaaacgtatctggtggatactcacccagtctgctaaaggtacagaaaaatgtgttcatgtgctgttgatttctaaactgctgaaactcagaccagtcctcaagagctgggcctgttccaactgtggaaacacttagggtttgtattgtttggctacaacgtgggcagcagagtgtccatcacgaaggccatgtgtgcacagccaagaaaactcttttaggttcctacctgtctctttccagagccatccctctggatttcagatgagatttccctattaaggagggatgccaaatgctggggatttcataatactcccaaccccaggcaccagatttgtgtaattgcagtggtggagatttaattgtcctttgaagaggccccatactgtttgtctgtcaaattgtctgcatgttggtgcagttgaaattataggagaagaggaaaccaggggtatgtttcaaagtagttggcacgtggttggtgatccatagtgcaggtttcctttctggaaggtaacaggactgtgttctcataaggcagcatggcagggtggaagccatatgggatttgccctcgaatttcagcgctgccgttgagcagctgtatgaacttgagctatttgcatatcttcttgaacttttttgctcctctgtgaatgaagccattgcaccagcatgttttcaggattaagtgagacaatatgtggaagtgcctggcacacagtaggtgttcagtatttttttattttccattctctgtgtccttgttttgactaccaggtaactatgtttaccctcagagatctgatgtatttcttcatatcaagtatatatcaagaatttcatccctcatcctaatgcattaaactcactgcatggaagttataccattacctagactcaccacggtcttgtcagacaccagcagagttttgtgtggctgcaatagagatgttattgccagttgtcagtattgaaatgaggcactccttcatccttcagtgaaatctgtgcaggcattttcctttctctggttaaacattttatagtctcctttaaaaacaatgccctcatttcatttcctctctctggctggactcttctcctccctcctgctttcctaaaatccatcttgtttccctgtaytgtttgctgaatgggcagtttaatgaatacagcatttccattttgaaatgtacagagcacaaggcagaaactgaatttcctcctggacagtttccatccacagtcctcatttccagttttctcccttcttttcttttctacaacacaactgaaatttgctgaaccagaaaggggaggaaggaggtgtgacaggagaggcaatatgccttctcattgtttcagcaaaagcttattagcatcctgctccctagaagagaccaagtgccctaaagatgccctgggtgcctcttctattgcacaaagctcaaggtccagagtatacagtgcatgacagaatctaattaccaagataattactgttacctgcactacctaactgttgtgttttgtaatcaaaagctatattggcaggggtgagtgtgagcctgctgaaaactcagggaaactgttgaaggtttatcaaccygaagcaattttactctagttagtgggcctgtgttgctcagttagcagaatgtttggggatcagaagaataccccagagcacttcagccattgcatagacattagttaccgggtaggaatatcctcagctgactcaggtattcatgttgttgaaaccagacttcatggcaatttgaaaacgtctgtgccatttttaaatttgttctcgaaatagttgatcagtacctgacttagccttcatttggcattcggtgaaggagaaattgatttcctttgggcatggctgtatgtacctgatgggtacagcgtgtgctaagctggatgtaggtatgtattcatactatcaccacctgcttcatattcattatggcacaaggttacaaattggctttctgtttcccatctcagccagctctagttaatttatgtctttacctctgtgcttcacacactaaagaaatggagtttctactttaaaaatcaggtgtattgaaaaaatggttataattgtttttttaaatttttaaagaaattccaagtggaaaacaaggaataagttgcaaaagagtatgaaaagtttggtaataaaggcaaggacacttaaaaggagggagtaaaataacaaagcaaaatgggtgaggctgacaggctataaattgaaaagggagaaggggtcaaggaaaatgcagacaggaagaaaagagacagaaaaagaaatgatagggccttgagtaatggactcagaaaaggaaataggaaaagttaagaccaaagtaagaattatggagacaaaagtcaaagacatccaggtctcaagaattacaggttattggtggcctgggaggtagtgaagaggggctaggcatatccctcatgaagttagatgtctgaattcctcaggacagtgtgacagtcagggagaatgtcccctgaatatgctaattcagactctaaaataagagccagccagattcattaccatggttggccagcctgtaatggcaacagaattcactgatgcatattaaactgaatttttctaaccaaggtcttaaataaacagacaccagctataactgaaaattagaataaggccttcagtggtgactatttctgtagggaaagtctgaaaacccttaacatggtttttttccaaatttttagaaatttgtggttcttaaggctgcttagtatgttagcaattgctccagtgcaggactgtgtggatccctctggtattttcttttaactttctgcaaggcagagagtgtggctgacctgtgatataaatgaaaccccgtggcaggaacattaactccatctacaacaaaggaacatgtagagatttggattctaatgaaaataatagaagctccttctcccaaagttgggaaatacagaggaggtcttctcagccagtccaaatttgcaaaaccagaatcatcacagaaaggtagataataggaggcctaagagaaagctcagttgtcctttggcctatggcctttgggcttgctgtagatcctctgttggcaactggatgctctgttgrgtccaggaattgatgataaccagtagtttgtgggtagatttccatgttgagcactgccttcagctaagtgctttcagttgcctcttgttatggttggagctgaatgacctttgtttacgtgtgtttcaggctaactgatgaattacaagattttcaccaatgagtgggaaatgtagcgataattattcagactgatttatatttgtctttgggctggtttttcatrtatatttttagacattttaatatatttggatctgattttttataaaatcatgaggttctctttatgctcaagtgctgccaagaagttggacagccctcctgttcttctcccagttccccagtccctattccagatgaggggatgcagagttagttgtcmattcattcaacaaacatttattcagcagttagagtgactatctcatctcagtttccctgagacttttctggtttgagcactgaaaagttctatattctaggaaactcctcaacctcaggccagccaagacagttggttaccttatcatctaccatgttccaatagagctaggagagaccctagaaatcatgacaatttctttattattattaattactttttaatattcttcttttttttgagacaggatcttgccctgtacccaggcttgagtacagtggtgcaaccacatctcattacagtctccacctcccaggctcaagcaatccccctgcctcagcctcccaagtagcttggactacaggcatgtgccatcacacctggctaattttttatttttatttttttgtagagacgaggtctcatcatgttgcccaggctggtctcaaacttccagtctcaagcaattatcctgtcttgatgatttaaattcaaagaaacctagcttcccaaagtgccaggattacaggcacgagccacagtgcccagcccattctgatttctacacacccattttaaagtgccagttaaagccaaggagacctctttatcaatttgttttccttctgattcacacattccctggattggaagagataattaagttctatggttgaagatgttatcttcaggctgcattaaagaataaaattaaataaaaggtcatgcagtgtgccaataagagttttacaagccagttggaatttgaaaattagagagtcaaaaagataaagtgaatcaaaaatcatttatttagtattgaggtaccttttggtacatcaaagagatcatttataaaatagtataatgtaaggaagttgaaagaatgaactacagtggaatactattattatatctacttatgcctttttttctggaaaatgttcacaatgatgtgaaaggatctaagaccagcctggcagccaccagatggtgattctagtcctggctcagtcagtaataggtcactgaccccagagaaatcaattcagcctccccaggtccttggatttctttctgtgaaaatgaaagcataggtaggaatttcccatggaacagctagcagaggagaaatattaaaagtcaggagactcatgctatagttttcatacttcattacaacaatgttgtttaggacaagtgagttaacctgttagcttcctctatataaaatggaaagtcattaaaaacctacatagcagggttcttgtgaagatcaagtgataatgtaggaagcatgtacaaatgtcacattctgccgtcacgtaatggtcctcacagcttgaggtagcatttagcatgtgtcatgatttagtacaagggttggcaaactgttgctcttggattaagtctggctcattgcctgtttttsaaagaaaaaaattgtatatgtgtgtatatatgttatatataggtacacacacatatgtgctatatatagcatatatacacacataatatataaacatgtacatatatagcattatatatatacgtgtataatatctccagtcctcatgaccagccatgcttgttcatttacatttgcatactctatgattgctttcatgcaacaatggcagagttgagtgattgttttgcaacagagactgtatggcccactaaacctaaaatatttagtctctgaccctgaaatgtaagattgatagcccaggaccaggcrtggtggctcacacttgtaatcctagcactttggcaggccaaggagggtggatcacctgaggtcaggagttaaagaccagcctggccaacatggtgaaaccctgactctactaaaaatacagaaattagctgggcgtggtaatgggtgcctgcaatccaagctactctggaggctgaggcaggagaatcacttgaacccaggaggcagargttacagtgagctgagatggtgccactgcactccagcctggacgacagagtgagactccatctcaaaaaaaaaaaaaaaaaaaaaaagatagtccaagatccaggattcttttaggttctgtgtcactatgtgatctcaggttaatgatttattgtttctgattctgtttcttacactgtaaaaaaaaaaaaaaatggtgggggggaatacaaatccagccccttctttcctcacagaaatgttgttaagatagataagaaaacaaaakcattgatctcttctggaggaaagatgatttaaattcaaagtattactcataaggtggatgctgttagatgactcagaaatgatgactgatgtgttattattattctctgaaattagttccctcatgtacctcagtgggggattacttagaacagcgatagcatacagacccctgcatcgtgacactacatcaaaagctaagatactgcaccagaatctaatttaatcacagtacccagtcaggagtgagttttaattgtttctttatccctttatcctctgaagactgtcattaacatttacaagacatgaacttcagatcatgccaacatctctgctgaggtcacctggcagctagccattttagtccatgatcaagacagaggggccttctgggcacatgaggagggacaagacagaacagtagtggtggtagcacataagctggtttacagagcaaataccaaagataggcttgtttctgttaaaacttgaatttatattttattcttggacacatgactgatatccaggctgactaagaacatacacaagtaaataacaaaactttgtctaacacgtataaatattaggacctcctttttccccaagaatcccctcaaacctctagggaggatctccctaaaggagcagctcttcatgtggctgaaagcagccacataaggaggctaaggctggcctctgaaagttacctcggcccaggtgcagcccatttatagaccctctatacccaactccagatttatggcatagataaattagtgggcaatcatttgctctataaaatgattcttcattttacaagcttattcactgccgcattcctttactgatctattcctttactgatctattcctttactgatccctctatacmcaactccagatttatggcacagataaattagtgggcaatcatttgctctataaaatgattcttcattttacaagtttattcactgccacattcctttactgatctattgccactagtgcagttccaataaaatctcattgttagaaatccagtacacaaatgctttttcactgctaacctggatggaaagatgaagaatacaatgcacttataatccccttagatcttatgatgtggctttggtcaaagtcttctgttctcagtttaggagcttaatgttccttggtacttacaattgacagggagagacaggacaaaagattctttaaaataacaatgaaacaatatgtgatttcattaactaacttgctctaattatctgcatgagatttttaataaaaggatcagtcatacagaaataagctaactggccttttgatgatgagtaataatgatactgacaatagctaccatattgagcattaccatgtgccccatagcattctaactcattaactcattgaagctaaaacctaaaaggtaagtataattattttcatttctgtattacagatgaagaaattaaggcacagagaagtaaaatatcctacctcatgtcacaagctgctatatttggagtcaatattcaaactcagtggcactgactttataattttgctactaaatagttacagtgctgtattgacaagtaaagcaactgtcaggtgctgaaatgtaggagcaagagcaatacataacatgtgttctaccttcaagaaactaataagaatttctgcctcaggccattagagaaaaactggtttgggacttgtcctttgccataaaatgaaagaaaaaaggaaaactggacaaaatatatcaaacaactaatttcataccttggacaacaggaaggttgttgttggacaacaggaagccaaagtggaaagaacttgttgggtatatagtaaattgaacagagaccctagaagggccttggtgtaatagtaaggctaaactagccctagaatcaagattattttagactcactctggtaaaacttaaaaacaagacttgaaaggatcaagtacatctagagctgccaaaacaatagccaacactttttaaaggaaaaaaagacaatctagacagacactcaacatgtaaaatttattatatctatcattcaatcaaaaattactagacatgtaaagaagcaagaaaatatgacccacaactagaacacccactgaagagaagcagacctagaaatgatagtgatgatgaaatttgtagacaggcactataagcaactattatacatatattcaaggatttaagagaaatcagaaacataatgmaaagagaaatggaaactatagaaaaggaatcaaatgtaattctataactgaaaaatacaatatatgaaataaaaaaattcaccttatgggctcaacagtagattagatactgccaaataaaagatacatgaactcgaaaagatagtgatagaagcaattcaaactgaagataaaatgaggctgaagataaaaaggctcttgtaaaaataagaacagagtctcatttttaaataaaaataaacagagtctccatgacctgtgggacaacatcaagcagactaacatatatgtaaatggagtcccagaaaatgtcagggtaatggcaaaaaaacctgaggaattaatgactacaatttttccaaatgtaataacaactataaactgacatatccaagaaactcaataaaacccaagcatgataagcgacaagaaaatcattacaatcaactagtcagaaagcagcaatacaaaaaaaacttaaaagcctccagagagttgaaacacattatataaaaaagaaaaagatgagaataatcactgatgttttttgagaaaatgcaatgtcttgtagaagacaatgggtgacatctttaaagtgcgtgaacaaaaatctgcccacctagaattctataatcagcaaaaatattcctcaaaaataagaatgaaattaagaattttttagacaaacaaaatttgatgagcaattttttcaccactctaagaaatgtcgaagggaatttatcaagtcaaaataaaataatgggaactcagatttgcacaaaagagaaaagtttctaaattaataaatatgtaagctgggtgtggtggcttatgcctgtaatcccagcactttgggaggccaaggcacgcggatcattgaggtccggagtttgagaacaggctgaccaacaagctgaaatcgcatctctactaaagatacataaattagccggacatggtggcgtgcacctgtaatcccagcttctcagcagcctgaggcaggagaatcgcttgaacccaggaggcagaggtttcagtgagccaatatcacaccactgtactccagcctgggcaacagagtgaaactctgtctcaataaaataaaataaaataaaataaaataaaataaaataaaataaaataaataaaataaaataaaataaaataaaataaaataaaattaaaataaaataaaataaaatacaaaataaaataaaataaaataaataaaataaaataaaataaaataaataaaataaaataaaataaaaaaaataaaataaaataaataaaataaaataaaataaataaaataaaataaaataaaataaataaaataaaataaaataaaataaataaaataaaataaaataaaataaaatataaaataaaataaaataaaataaaataaaaaataaaataaaataaaataaaataaaataaataaaataaaataaaaataaaataaaataaaatagtgagtaaatataaaaggcattttggtttttaaaatagcttgaaaagtaaatggactgttcaaataaaaaataataaagatataataatgatataataggaaaaaatatatgataatagcataaaagaaaagagaataagtggaagtatactattgtagaattcttaaatatatgaagtacatatctaatgaagactgtgatagttaaaatgcatattgtaaatgctagagcaaccatttttaaaaaatggtatagccaataagccatagaaaagatgagatggaatttgaaaagaaaaacctcatatgaaatgaaaggaagaaaggaacagtgaaagaataaagaataaggtacaaaaaaatcaagatgatataatacaaactcaatatatcagtaattacattaggcataaatagactaaccatgccccattaaaagacagaaatcgtcaaactgaataaaaaaagcaagattcagttatatgctatttacaaaaaaaatattttaaatataaaaatagctaggttagatataaatggatagaaaaagatatacagcaaattctgtatacgtgaaggctgtcataattgtactatctgaaaaagttggcttcaaaatagagaacattattagagaggaggagggacattttataatggtaaaataatctattcatcaataagacacagtgatcttaaaagtaaattcactcgccgaggtgggcagatcacaacaaggtcaggagtttgagaccagcctggccaacatggtgaaaccccatctctactaaagaaaaacaaaaattagatggacttggtggtggacacctgtaatcccagctgctctggaggctgaggcaggagaatcgtttgagctggggaggtggaggttgcagtgagccgagattgcaccattgcactccagcctgggcgacagagcaagactccgtctcaaaaaaaaaaaaaaaaaaaaaaaaaagtaaattcattcaattacaagctttgaaaactacatgaagaaaaaactgacagaattgaaagaatacacacatctatagttgtggctggaaatttcaacacttctcagcagttgttagaacaagtagctggaaagtctggatatggaagattcaaacaatactatcaatcaacttgatcaaattgatattacagaacactgcattcaacaacagcagggtgtacattctttttaagtgcacatggggtattcaccatgatagactatatgctgggttataaaagcttctcaacaaatttaaaaggattaaaattatatgaggtctgtttgttgaccaccatggaattgggtaagaagtcaaaagcattaagatatcaagaaaattcccaaatacttggaaattaaatatcacacttctaaataagccatagatcaaagaagaaatcaccaggaaattagaatttatttgaaccttattgataataaaaacacaatatatcccagtgtatgggatgaagctaaagcagtgcttagatggaaatgtgtaggttaaatgcttatgttagaaaagaagaaagttctaaaatcagtgatctagcttccacattaagaagctaacaacaacaacaaaaatactaaccttaagtacgtagaaaaaagtagaaatcaatgaaatagaaaataataaataatagagaaaatcaatgaattttaaaacggactttttgaaacaaagctataaaactgataaactatcaagctggtcaagaaaaaagagaagatgcaaactggcaatctcaggtgtgaaacaggacacatgactacacatacgtcattaaaagggcactaaaggactctaatgaacaaacatatacaaaaaattcaacaacgcagatgacatgcataaattccttaaaagacaaattgctaatactgattcaagaagaaataaaaaacctaaatactcctataaattaaatgaattgaattcataagtaaaagcctttactcaaagaaaaccccaggcccaggtagttccctaattaattctgtgaaccatttaaaggataaataataacatgactatgcaaactttaagaaaacagagaaagaggtaaatacttcccaactcattttataaggcgtgtatgacactgatatcaaaaccaaagatatggtaagaaaactatagaccaatatccttcataaatatagacacaaaaattcttaacaaaatataagcaaattaaattcagccatatgtaaactggataatatactatgttcaagtggcatttatcttagaaatttaaggttggtttaatatttttaaatcgatcaatataatttaccacattaacataataaaggaaagagtatgatcatttcaggaggtgcataaaaagcattgcacaaaattcaacacccattcataataatgacttttggaaaattagkaatagtgacagcttcctcgacctgttaaaaggcagtgatgtcaaatcttcagtttaattatgaaagagtgaatgctttcctactacgatggggaataagacaaagattcccgttctcaccacttctatttaaacatcatattgcaagtaccaactagtataattagacaagataaagaaatcaaagattacagattgcaaaggaagtagtaaaattattattatgaataaacaacagaattgtgtactgtcaacctaaataactaaaagagaggggctctgtgaaagaaagatgtttatctgggaatagagctttgcaatggaaatacctaggctgtagttaactatgtgtgtattcagggaggtaaaggaagacaaagctttttcaaggaaaaaatgaggaagattacataattgttttaaaataattatccttgactacaaagatcaataagaagggtgcgatgggtacgctaaaagcccasacctcacaactgcacaatatatacacgtcttctgcacttgtacccactaaccctataatttaaaaaaataataataaaaaatagcaagagtgacaccttctgaggttggacaggtagctgctgggcagatgtacttacagaagtaagttttatgcaaagtcttgatggtctctgtgcaaagttgtggttttagcggtcttttttgttatcaggcatgcaagcatgagaaccctctcttcgtgaccttccctagctgtatttgtttgggttttcataacatttatgccttcatttttattctgataactttcacagtacatagaaaatcctaagaaaactacaaacatatgctgctagaagcaagaagtaaacttagcaaggtcacaatatacaaaattaaagtttatgtctgtatactaaaaactagcaaataatattttaaaaaataacatcaaagaacatgaaatactcaagaataattttaataaaatacatgtaaaatttaggagatttttaagcagacttaaataaatgaaagaaaaattttgaaaaggagaaaaaaaatttgaggacttactctgatttcaaaaactttcatctacaataatcaaagtcatgtggtattggcatattggcataagaatagacagatcagtggaatagaataggtctatgcgtatatggtcacttaattttttacaaaagtacaaggttattcaacgggaaaaggatagtctttacaacaaatagtgttaaaacagatatccttaaggggaaaaaaatgaaccttagcccttatctcataccctgcacaaaaattaactcaaaatggatcataaacctaaatgtaaaatcttaaactatgataattatagaagaaaatataggagaaaaatcttttgacctcaggttaggtaaagatttcttagattactaaaggaactaaccatttaaagaaattgataagttggacatcatcgtaagtaaaatttccactctttggaagatatcattaagaaaatgaaaggcaagccacagaggagaaaatacaatacatacgtctgacaaaggacttgtaactctcacaactcaattaaaaggagactaacaagaaaaaatgagcaaaatattttaacaaacatttcacaaacaagatacaccaatccccagtaagtacatgaaaaggtgcttgagatcattagtcatcattgaaatacaaattaaggctaggtgtggtggctcccaacactttgggaggccaaggccagcagatcacttgaggtcaggagtttgagaccagcctggccaacatggtgaaacccccatctctacaaaaaatacaaaaattagccaggcgtggtggcacgcacctgtagtcccagctactcaggaggctgaggcacgggaattacttgaacctgggaagtgaaggctgcagtaagccgagatttcgccactgcactccagcgtgggtgacagagcaagactccatcccaaaaaaaatgaaaaaaagaaaaagaaatacaaattaaaaccaagacaagacattgctaacattcactaaaatgtccaaaacaaacaaactatgcaataatgtggatgaattcccaaatcattatgctgagcaaaagaagccagacacaagagatcacactgtatgattcctttcaggcaaaagtataggaaaggcaagcctaatcaatagtgacaggaatcaaaccaatggttgcccgagacgggggtgggaaggaatggactgaaaaggaccatgagtgaatttttaggagtgatggaaatgttctgtgtcttattgctgtagtagtcacacaggtgtgttcattcgccaaaacttgtcaaatatacacttagaatgagtattttctattctattcaaattttgcataaaaagaagcagctattttgttgttcatgatagaagcaatattagcacttactgttctctagctctttcccaaggttttgcagcactatgaattcctttagtcactcagagaattaggaaattagcatgggttgttttgatctgattgggcatcacaataggaactgacctttctgtcttctgagctctaactttggatctcatgttttgctcctggtgtgtaagtcctagctctcctatttgggcctccttaagggtgggtgcttggtgcaactgtcatagtcctttgcttaaaactttctccttggccaggcacagtggctcaagcctgtaatcccagcactttgggaggccaaggcaggtggatcacctgaggttaggagttcaagaccagcctggccaactcggtgaaacctcgtttctactaaaaatacaaaaattagccaggtgtggtagcaggcacctgtaatcccagctactcaggaggctgaggcaggagaatcgcttgaacctgggaggtggaggttgcagtgagccgagatggtgccgttgcactccagcctgggcaacagagcgaaactctgtctcaaaaaaacaaacaaacaaacagaaaaaactttctcctcagcttattttacgaacatagttgtaagttgaatgaatgcacgcctggagagcaattgggatgcactactgtggaaagtagaggtattcagaaaaggctcaacagccatatattagggatattatgaagtgatttaaacattagatgatggttggactagagaagttctttcccagtcctgattatgtgaaaagaaagcttccaagggcaggagacatttctccacagggggaagtgagtctaaatattaggagggtcagtagccattctgacaacctacccaccatagacagagtgggattcacccctaaaccagcagagtggttagatgtctgtcaccaggcatgtgggtctgaatcagaagaaagagaaggatatcattttggaaatttacaagtgagacatgaaatctaatagaagggatttcaaaaagcacagattcatatgagaagttccctggaaagaaaagatgggtgctgatgtgggcaggggccatctgaggatggcagcttcacagaattgccctctcactccactctggggccaggactccccactcctgtagtcttctccctaagatgagtaaatatgaattcagcaccaagtaaaacggcctacacatcctctcaccagactcttttgcttataatcatcattattaccttaaagccaaagtttactcatctgtaaaatsaggataataataattatagaatcattgtgaggctttgataagataatgcctgtaagtgtttagtacaggctcatagaaagtacttagtaaatcctggctatgattgtggttatgattttgttacttgtttcatcattaaaccatgtatcatttactccggaaacaaaaagtaggaatgctatttcccaatctctgtaccacgctcacagcgaaacagcctgtgccatccactaacatacccataaacaatctccactgcattacaatcaggaacttagggaaaatgaggcttttttcttgttaagctttatctgcagaatctcaagtagtttttagctgtgctcttttatattccagtcaacctcatttccacagatgtactcccctagattgaaagttccgtgagagcaggcatctggtaaattatgcccaccactctttccccagggcctagcaaggtacttggcacttagtgggagctcagtagatataagatgaatgaatatggtgccctttccaaaatccttctacgcaagtcctgctgcactagtcgctgccctgctatggatgcaaaaatgagtgaaaggttgatacattgtaaacgtaactgtgatcattctgagtagtcatttaacctctttacagcagctggatgattatttctcagctatacgaaattattaaataagaaataattcatgcttcatgttccatgtcctccatcatgaggcctttttaccagtttaattagttagtaaaggacagcacgctttcctctccaccttttatcaagaattctaaaggctttagagaaaaaatgactcaggaggtgaaacagcaggactcctggtgttatttataaactcgtccctggcatctgcagcagcaaatctcaagcatcgtttaccttgccccgtaattctggagtttgagtataaatgatgaaacagctaatggcatgttacccgacaaagtagcattagcttcctctatcatcgtcagctgttttttttttttttttttttttccacaaaaatgtgtaaattgcagtttatctcaccagagaagcatttgatcaaatgtactttaattatattttgtgtggctactgagaataatcactgtttcttcatcataaggattgtcctaaaaaattatattaacgtgggtcaaccataaacagcagtgggaatttagctacctttaaatgctaaatttacctctcagcttgtagatttcctacaaatgaatttctttgggtcaagattttttcatgagcattggcawttagtggatattccttgaaccaaccttttactttaagtgaaatgtatttgcattaagagcatattcatttcccaggctgcttcttaacacatttgtttccctttgttttggaattcacaaagcttttcatggtttgcctattcattccctcactgcataatgatttatagtaggttatattttagaaggttttgtgtcaaaaaaaaaaatttgcatctcttcatcaggtagtcagttaaagaggctgcgttgagctgccaaatgggacgctgccaggtgaccaagaaagaaaagcctacttgcataaataaaacgaaagcatattagaacatttagctaacattcacccaatttttcatagttggcaacttctaactttgtttcatcttcaaggattatggtttgaagcaagggtaattcgccttgtgtcttccttttagttcttccctcagaacctggtttgggaaaaacctcactaatattttgtagcatcagccaagtagttgtcatcttttttgtaaccaactgccttatacaaaagcatagacacacttattttggataaatccatactgtctgacacataagcaaatatggaaaatataaaggaatccaaaggctctcacacagatcaattttcttcattggccagagctgcctctaaagaaattcacatgacaccgtcttcatttttctgaacatgatacatattattcattagcatttaagcttatatctaatgcacatttttagataggattttttagtagtaagacttttttatatgtctacctattattatccatggtagagtttcttgtgaccttgaccctgtgatatctggaaatgaaaaaagcccattttgtttcagactcttggtccctctagctataattctacttctgacagtggcccccagaggcattttgtggagggctgctgccactttgacatcacccctaaaattgttgggcacaccctctctaaaataattttatttctcattatagcttaatcactatgaatttmtactagagtcatttaaaagaacaattttagcctgccctacttgttgggaagaataggggaaattaacagcatcttgtaactggaaggacccttataggttcctaagactgattccaattccaaacaataataccagtccgtaagtggatctgcttatagagaaacacctgttgcttctgttttttgtctcatatccagttagtttcccattcacagcaaaacattcccttcaatsccaaggaaactcaacctttttgattattagtatagtttcatcaaagtttctttgaaaggtaaaatatcccctttttcttgcctataatttttaaacctttttaaaggttgtaaagaattagttagtcaaggcttcttctcataaagccagggtttcttttttcctagactctatgtgcttaagtgctctatgataaaatgtggatgttataaactcatcagcttggccatgtggaagtgaaaaccactggtcagaggtgtgtggattctcccttgtgacctatctcatattactgtgaaccagctggcccccaataccataagcattaacaatggctgacaaaattgggactccagctccattgtgtcacctgggcatctgtgcagcactcctgccaaacagtcctgctaaactattccgatttcagatgggaatttggtcagaaacagcattttcttgtaatacttcccacttttctaattcccttgtttctggttgccaaaagaatgggaggtagacaggaagaggtggggaaaaatgtttaagttcaaatgtcatctctgctaaaacctgacttccactgcactgtggctttgtaacctccttgtgtttgtagccagctatcaaaaatctgtccatttgaacatgattatactaaagcatgattattttaaagctttcattataaactctacactggaaataatctttagggtgttttcaggtttgaaaacccatatgcactgaatgttctcatggtgtgctctgtcagaaacaatttttaatgatgtttcctcagtgagcatcattccctagatgtggacagagctgcagaaaggcatttacaaggagtcatgctggctcagatgggtgaagagggaactttattgacgtcagaccatgaaaagagagtgggcaataaattctgtatagacaaaggtgaacacaataaactgagactgacatataaacacgagtacaattcaaaatacagtggtaaggaggtgtggatgtttctttatagctgtatatgtttttgacacacccgcacacacagaaaattataaagtcaaagataatgaacctagagtcatgtggaaggtgtgaggtgggtcaagggagaaatagaggttattaaggagtataggtaggtattgaagaagagcctcattttatacacatacagacacatgcacacatatayacctatatatactctctctccatatatacatatatttatatttatgcacatgtaaatacatatatgtaatttatatttattttcccccaatactcctcatacctagagaccatgaactacatacagagggaaggcacactttctacctgaaggccagcccttatattggtgatcagtttgttcagtgctcttaatcattagagtaattgtgtataaaatcatgaatggggactttgtgagtcacttaacatttgcaagaagcatatgaacgtgattgttcttttagagtttgttaggtgggtggtggtaaagyaatacaattttctaaatggtaaaatcatgaatctcatgcatgtcaaaaaatttattcaattcattaattaatgagaatatcagtaagatgttacaccattttaaagagcatttgagaaaccaagtctgtgcaacttaataaatatatattaggataaaattgctgggttagataaaaactggttaatgtcttagaagccaataaactgtaacatttgagatatctgttctatgggacaaaattcattttcatctcttttagacatctttaagttgacatgtaacttcactaaatctgggacctttaatcaacagtaagcagtgagtcaaaataagtacattctaataaataatctttgggtggacttggcccctgaatgacattgaaagaatgtactgcctacctttttgctttatttttaagtcatgaataatttttataagagtggtgaaaggtataagaacatactgagttctacataatagtgtttggatctcaacttgtatactgctatatgttcacatggttttggtaaggagaactgacttgtcattctccaaggcagaagctgagagtagaactcccagaaagtgggatttacttaccataagttgctgtagaaaaggaggatggagtcaatctttatttctgcttttgtcccactacatgttaagaattttttcatttacccattcagtgattcaacaaatatctgttaagcatccactaagtgccaggcattgaggattggggtgaaaaagcccctgctcttaaggagcttacattctagcagaaaagacagacaacaataataaaaccatgataatattgtttcaactggtagatagtgctatgaaaaagaaaaagaagcagcagcatgaaggtaagggagataatgagtgaccacatggaggggtggactttagactgaacgatcagggagtcccaggaggactggcaggcctgcagagtgtggcccggccacagcgatgggcttggtgtcaggtagggctgccattcatcttctgcccactgtatgaatgtaattcaagtctttactctatttcatggtccaggatacctccgacccaagtttccatctctttgtcataaagtagaataggggtgggagatcagagctgcaaatgaagcaagtcatgcaaatggtttcccactggagaaaaggcacattttttcccgagatagggcagtgaagaaggtacagagcatggatttcagatcagagacacctgggtttgaattctatttctaccacttactactgtatgacatcagacaagttactaaaatctattttccatctgttaaagacacatgaagatctctccctcatagggccaattcaatgaaatcatctccagaaagccctcagtacacagaaagcactcaacaagcagtgactattattcttgtaattcccctatttggggagtctgtagcatcatcttcatgtagtactgattaactagtcttagttattgctgccacacagttttaccaccttacagagatgactcattatcacacagttcagatactgtgggacctgcaagtccaccagaggtgwtggtgttgacctaaactatttggtcaaaattatgcccatagccaagccaaggtttccaaagagatagaaggtacatgggcttagtggcgcacctaaaactttttagcccaagtttggagattcttgggtagcttgagagttagaaactaaaagtagaatacttttaatggatttgtgattgaggattttttttgtttttactttctggtcctgtcctgtcctttgttttcctttcatttyttccccctcttatgagttgagttgctttctcttctagggagctatgtgttaggaagctgctaatgaactgcttttgagtctaattttcaataagatttaatacagtagggattaaactgcccccttgaaaagagagattaagtgtctgcaaatcccatgaattgattttctaattgttttggtaataatgtgtatgtgtttttcatttgctaatgttgctgaaaataataataattttaattaaattttaaatgtatttttagtattttaaggattctagagggactaagttttcttgcaaggaatatgttaagaccataacattcttccctcaccccataattattatgatcagggaatatctataatatattccatggcaattaaattgcataccccagactgttcaagatgtgtttataaaaggagaaatggatttcccacagctgctygcctgtgaatgcatccttcacacagaaccacagtagccagtatatgcactaaaataacagacttgaatttaaactttcagtgctttcaaacgtctttcaaaaacttctcataacacaaattgcttaatttgtgtacatgaaaactcactgattacatatgaatgagagtcaacctataataatggtgactttgagaatctttgtgtatgtgcccacccatctcttcaggaattagcaggtattcagtcttgttccaacattctgcacaagccacagtcattagtgagagcaccctgtgaaggctgaaatctgctgtgaacagtatggggcagctcaggtattttttataatattcatcagatggtcttcacccagtcacgtagctggaaaatgttttctgtgagatgagtgtttacaaaaaaaaaagattcatagagaaggagcaagggaaggaggaagagggaaaataatccaaaccagggtcaaggcagtcatatagactagaatcacagaccaggtgttccgtctttaaaaagcgatcgtcacaactttgatttattaaattggaatttaaatcttccaagctgtaatgaattgatcatgatactgttgatatagattggctcatctttgtggctgtataacaactataataaagaattaattgagtacctattaatcctcacaagcatcttggaagttggatatcattagccctgtttgctgattgaggaaactaaagttgaatggctttacatcattctttcaaagtcacccaggttttaagcagaagaatttgaatttgaacccagccctacctgcctctaaaccccatattctctcagctgtatctccctcctaggtgcaatggctccttggctgacatgctgaaggatatgtcttcacattcttaaactccaaacctcccttggaaataatttcctaacagtgaaactgccctaataatgcygtagtttgtttccaggggagaatatttgccttcagagcaggctccttctgccagctttccatttcataaatgcattttatgactccctcttcagagctcatatacctgtcagaagatcctatgcaatttatccctggggatagttaacattccccctgacccacccaccctgcaatgtcaggtgctctcagaaatggaagtgcaggatctccctcagtgcccatcttttagatcagtagctgtcactgataaaatgtctccttggaactacagagacaaagttgcaagccagccagcgggcccaccctggtatctcctgcagttatcagcattctcactagtgattgatagaacacgttttggagttgttttagttttgtagaatgttcatgggaacttagatgatatctgaggaaatgccttcttcaagtcactagttctaaaggaaggcagccaaattccttcagtctgagaattttggagctctgaagagggcatggacaaatatttcttgcctctcttttttaaatatggaatttggaggctttgtctgtcgaccaccatgccgtgtctttaagaagctctgactgggaaggaaacagccccaagtgttccaagctctgtctgctggaattaaatgtcccttcctgtttcctgacatccacaattctaattcatcctccattcaccctcagtgacttctgttctttgaaggttttgactctgtccttgtacatgaatttgacattcacctgatactctgtggggtccagagagcatgtactccccaccagcttcaactaactctaaaatgtcacagtttctgttaaagtgctttctagctactaccagagtaaacatacagatttgtctcccctgggtgtgctgtgagttcatggcataaagtattttctggttttaaaatggacttctggcctgtaatcccagcactttgggaggccgaggcgggcggatcatgaggtcaggaaatcgagaccatcgtggttaacacggtgaaactccttctctactaaaaatacaaaaaattagctgggcgtggtggcaggcgcctgtagtcccgggaggcggagcttgcagtgagccaagttcacgccactgcactccagcctgggcgaagagcaagactccgtctcaaaaaaaaaaaaggacttctggcttttctactgggaaatgtggttatctgtgccttctggaggtcaagatgtcatcatctggccctggtccctctcacttctcctcagactggacctcttctccagctgtttactcaccttcgtagttgttcacacaatttctccttcatgttttttggagcatctccctaaggtgcatctctagtcaccccaccttctcattcatcctcccaaccaccatggctccacatttatgaactacattcagtctattttcagcctgacatttaggaccttccacaggtagttgccaactttatctgccaataattagcccaagttaccccccagtgtcaaccaaactggaacgctcacatgttctgttcatctggaatacctgtgcctatatctgtctgttgacatcctaagtactccaccccagagcaaggggtttatgggagtagataggggaaaactctggtacaaagttgtaagaacgtgggttgggcttggagaaaatctagatggcatcctggggcaatggagggctcaagaacaatggcaatgtccagtccacaagacaggaggtaggggatttgaagagggaaatcctagcaatgtggttaccagaaacacatagaaacatacctccccttccctaaaatagttattggatataataataattgccttttaataatacatgacttagcaagaggcaaaataagggaattcctcagaggtgagaaataatagaaataatgaaaatctatagaagtaagaaaaccctggggcctggcatttgtctgctaatccctgtttgcctagagcatgggttttaatgagcagtgrgtgcatctaggacaagtacaaaacttggggccactagtgtactttataagatattgattaactttagacttattaagatgaatatgtaacctataatttccaaggtctccactgacagaattgaaataaagcatgtagcttccaaactatagagttggagggaaaaggaatgagagaagggaaaaaaatcaacccaaaagaaggcaagaaagaaagaaaaaaaagaaacctagaaaacataataaacagatagaagcaaaaaaattcaacyctaaactattcataagagaaactcctaaaagtatgagatagagaaaggctgccagtraaacgatgggaaaggacataccagggtaatactctgcaaaaagaactaggtgtgcctatcttaattattaggaaaaactggacttccagaacaaaaagcaacattacagatgagttttcaatttaccagggatacataattttaaatttgtatacccctaacagcataactttgaaatatattttaaaaaattactggaactacggaatattcaaaatcacaaagggacattttcacacatctcacagagggacattttcacacatctctctcaaaattgatgggtcaaatagacaataaatcagtaaggagttaaaaggtttgaagaacacaattaagaagcttgatctaatggacttacacagagcactgaaagcacattctcttcaaatacacatggaatatttacaaaaatgcatcacatactaggccatagagcaaacatcaacaaaattcaaagaatctatatcatacagccaacattctctaacagttaaattagaaatcaataatgaaaaaaataactcagaaaacttcatacttttgaaaattaaaaaaatgcattctaactcatgagtcaaggaaaaagtaaaactagaaattaataaatatttagaactgaattgtcatgaaactactaatgggaactggtgagatacagctaaagcagtattgagggaagattatagccttactgcttatgctagagacaaagtacgtctgcagagtaataaactgagtgtttaactccaaaaattagaaaaagaaaagcaaataaatccaaagaaaggaggagtaaaataatataagcataatataaacttaggagcagaaatcaatggaagaacaactactaaataatagaaagtatccaaaaaatgaaagtcatcattttttctttttcttcaaattattaataaaactgacaaactgcaagcaagatttaaaaaaaaaacagagaagacactgataatcaacatcaagaatgaaaaagagggcatcactatagatgctgcagacatcaactaaaattaaaaacaggatattactgacaacttcatgccaattattttgagcatttagacaaaactcacaaattcctagacaaatgtaatttccatagttaattcaagaataagtacaaaacctgaataagccaataaccatgaaagaaattgaatcattagttaaaattgttatcataaagaaaacatcagactttgatggctytgttaaaagttctacaaaataaccaggaaataaataattctaatcttacacaaactatcccagaatgtataaaaaaaagaaggaaaaccatgttatgcatcagatacatccttgatactaaaactggagagccacaaacagaaaatgtaggtttttcaaaatgaaaatttacaatagcaacaaaatatataagccatcaaagaaagaaaatgaacaaaagggatgtaaaactgttataaaactttaaagacattaagaagacaaatagaaacatatataaacacaccattttcatggataagaacacaatattctaataaaaagatgttcggttccccccaatttaaaatagatattaccacaattctgatcaaaatccaaaaatacttttggagtatatttaaatgattctaaaatttatctgaaagagcaaatggttctgaataatcaaaacactcctgaagaagaaggaagagaaagtgagggaatttgccctaacagatatcaaggattctaaagtaatagcaattaagatagtgtggcattgttgcagagatagacaaatagatcactgaaacaattagaaagccccaaaataaacatataaggaaacttaatatggcacaatccgtaccgcagatcagtggagaaagaggatgtactactaatgaataaatgtttctaggcaatggaaaactgaaaatagaatcctacctcacacccaacacaaaaatcatttcctattctggatgggtrgagaacttaaaaatgaaaataaaatatttttaaaatttagaatagaatttcagagaatatctttgtaatattagggtaaggaaggacttcttaagacataaacagtatggatcttacaggaaaatattcataaatccaactacattgaaagtaaaaacacttattcatcaaaacacacactaaacagggtaaagagatgagccacaaactgggaaatgatatatacaaacttactaacagaagtgtctaaattatgccaagaactcttacaagtcaataagaaaaagacaaatccattgaaaaatgggcaaaatgcatgaacaagaacttcacaaaagagaaaacacacataaatgacaaaaaaatccacatgtaaaaacatacttaatctcacaattagtttcttttaaaactgaaaatgaaatgttagcatttcacactcaccaaatttacaaaaattagtttgacaatatcaagtgctgtagactatgtgaagcaagagaatgactcatatactaacagtgtaagtgtaaattgaaaaggaaaacattttggaattgcacggtaaaattgaacacacacatactctatagcccagcaaaccactcctacattcaaagccttgatagtgttggtagcagcacgtaatagaaaactggaaaccacctaaatgaccattgttggtaaaatggataaataaatacaaagaggtaatatactgcaataaaacatgaaaatactagagctatacacaacagcatagataaatcttatatatgtttgaatggaaaaagcaagctaaagaaatatatctggaggatatggttcaaaagtaggcaatattaaactgtatatctgtacacgtataattgttatatatagtcatatacayatatgtggtaaagtatgaagtggtaaaactgtagaaaagcaaggagtaattaagaggcaagacaggctagtgggtacctctggagggaggaaaagatctgcagtgggcaggggtgtcataaatgggtttccaagatactggtgatatcattcttgcattaaattatggacatatatgtacttattattttcaccctttataatatacatttatgttctgtacaatcttatgtgtgtatggtatatttcacaataaaacagtcaaccaaccaatcaatcaagctagctagaggctaaagaactgaaactagaatccataagatgggtctagtaggttttcaaggataaataagagacaatgaagtttccctgaggctatgatccatgactgaaactagcaaaaagcttcacacttgaatgagaagaaagctttgaagcagggcagagactcctgctggtgcccttggaggttgctggggatgttataactctaggaagtaaatggatgatttgagaaggaaaacttgaacaaaggggtattggctttcttttgtaaccaggaaggtacataatttgcaaacgtgcagatacaaagaagatactgtctttttataaatatgaggcatttgtctcagttacttatacaaataaaagtttattttcccttatatcacaggaaatccagaagaaggcagtgcagagcttgttgagagagttagcaatattttccaaatgtaggctacttccactctgccatttttagtttaggggctttttgccccatgcagctccaaagttctcatctgccttgaatgcagcattagggatattttcccaactctttgtcaacgaagttaaaggcttttctagaactcatccacagccggctactcacatcatagtcatctgaatggtgacacatggacatttcttgcagcaagagagcctggaaaagtaattattttgctattgcagactgtataataggagcaggcaaaagtgaagggggagaggtgtgtattcagcagtgtctgtcaaaatactccactaagaattcttcctcttttatccccaggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccmccacatagaatcaacatatggtagggattacagtgggggcatttctttatatcacctcttaaaaacattgtttccmctttaaaagtaaacacttaataaatttttggaagatctctgatttttatgtgttcatttatgaacattaaataygaaaatattatggtttatattatttattgaaggagtagaggaattactcaactttagtatgctcttaattgaatatatggaggcatttgactttctaatttgtatatttttatattatgtgaattttaaaaatgagctttggaattttttaatttatagaaaaaaaggatatcatttggggaaaaaatcaagaatgtataattcaattgccttattaaaggtaaatactagggtctgtcactagataaataataatgctattttgcatttatgttttgttattttacacaacatttccatgaagttggggcttattcacaatttgctgatgacatggttggagctcagagaggctcaataatatttacagagtcgtctagagcaaaaacattaatccccatcctctctggagccaatttctactattctgcctcacacaacatccaatattcaataaaaaattacaagacacaccgaaaaaagaagaagaaataaacttattgtcaagagataaagcaattaagagaacaagactaagagatgacccagaagtttgaacgatcagaggagtttaacctaactatgatgattatgttaaaggtctagtaagaaaaatggactacacacatgaacagaaggggaatttcagcagagctggaaaccataaaatggagtcaaatacaaatgttaaaaaatgcaatgtcagagatataaaatttttttgtcagactcatcagccaattggacaaggctgcagagagcattagtggacttgtatgtaggccaatggaaattatccaaaaagagaagaaagagtaaaaaaaaaaaaaatgccagagtgaatcatccaagaattgtgatacaatatcaagttgtctaatatgtgtgtaactggattttcagaaggagaggacaaagcatcaattgtattaatgataaaaaaatgattgaaagagtgggatctttcatttctgacgaagtagcacaccagtactctgacccttacactgaagatgactaaaaatgctagataatatttgagaaacatcttattaaatatatgaatgaactgattaacaagaatattagacaaaagactaagtatcgaaagactatataccaagagatacatagaatattttttgcttttaaaaggtttttaaacttttaaatatatatatatacatatgtgtgtgtgtgcgtgtgtgtgtgtgtactctgttgcccaggctggagtgcagtggtgcgatcttggttcactgcaacctccacctcccaggctcaggtgatcctcccacttcagcctcctgagtagctgggaccaaagggtgctaaatttttttgtgttttttgtttgtttgtttgtttgtagagatggggtttcgccacattgcccaggctggtcttgaactcctggactcaagcgatcagcctgcctcagcctcccaaagtgctgggattacatgcatgagccactgcgctcagccttaaaaacatacatattttttaattccaatagctttttaggtacaaatggtttttgttacacggatgaattgtatagtggtaaagcctgagattttagtgcacccctcacccaactagcgtgcattgtatccaatatatagtttttttatccctcacctccctctcatcctccctgcttctgagtctccaatgtccattatagcactctgtatgcctttgtatacccatagcttagctcccacttataagtgagaacatacagtattcagttttccattcctgagttacttcacttagaataatggcctctagctccatccaagttgctgcaaaaaacatttcattcttgtttatagcttactcagcagtgttccatggtgtatatataccacattttcttcatccactcatcacttgatgggcagttagattggttctatacctattcaactgtgaattgtgttgcgataaacatatgtatgccagtgtcttttgatataatgacttattttcctttgggtagatacccagtaatggggttgttggatagcatggtagatatacttttggttctttgggaaatctctatactgttttccgtagaggttgtactaatttacattcccaccaatagtgtataagcagtcccttcttaccacatccagtcaacatctattgttttttgactttataataatgggcattctggggccaggcatggtggctcgtgcctgtaatcccagaacttttggaatgcaggaggattgcttcagttcaggagttcaagactagcctggacaatattgtgagacctttactgtacaaaaaataaacataaaaataaattagccaggcatggtggcatgcatctgtggtcccagctacttgggaagctgaggtgggaggatctcttgagcccaggaggtcaaggttgcagtgacctgtgatcatgccactgcactccagcctgggtgacagcaagaccctgtctcaaaaataataataatggccattctgactgcagtaaggtggtatctcattgtggtttcgatttgcattttcttgataattagtgatgttgagcatgtttttataagtttgttggtcatttggagatacataaaacattgaacaagctttctctttgagaaagtttaaggaatgtggtaaacttaaattccattcagagatcaggagattgtagacaaattccagattctgccacattaaggatactatagaactccaacaaaaatgagaccccaaaatattatacctcaatacagtggtgaacaaaaataactctcaggtctgcaaggaaagttaccatgattgagtaaaagctaagtagagggtctgaagaaattcccacttataaagttagataaaatattaactcacaacaaaaaggggaaaaaaagaatcacagcattctgagcaagagcaaacaaaaaaagatcaagaattaacccacagtgtcctctgatattggaattttttggttaaaattatttaagctatgtccattatttcaaggaagtcaaagaagagtttgaaagtagaatagagagcatgggaccataaaaaaaaatgaccaagcatattgtagaaagaaccaaatagaactttagggaatataaattatactcagtgaaattttaaaattcggggacaaatttaaccaatttaatgagagttagtaaactgcaagacaatagtgatgaaatttatgagaatttagcacagaaagacaaagaatggaaaatataaatgaaaggttaagaaatatgaaggatagagttatattgtctaatgtgtttaatcagggtttcagaaaaaagaaaatgggacaaagaattatctgaagacataataaatcaaaattttccagaatttagatacacaaaatcaagaaacccagtgaatcccagacagaataaataaaaagacatattttagagaaactacagaccagaagagacaaaagaagctctttgaagtaagagagaagagatggactatcttgaaaaaagcaacaattggacttttagctaacttcttaacagcaacaatgcaagccagaagatcttccacatgctgagagacaacaattatcaacctaacaactctgtgctcagggaaaatatcttttgaaaacaaggacaaagtaaggatatttttcagattaaaaagtgaaagagttggccagccatggtggctcatgcctgtaattccagcactttggagggtgaggcgggtggatcacctgaggtcaggagttcaagaccagccaagccaacatggcaaaaccccatctctactaaaaaaaaatacaaaaattagctgggtatagtggcacgtgcctgtaatcccagctactagggggctgaggcaggagaatcgcttgaacctgggaggcagaggttgcagcgagccaagatcatgtcactgcactccagtctgggcaacagagtgagactctgtctcagaaaaaaaaaaaaaaaaaagtgaaagagtttactaccagcaggtcttcactacaggaaattagaaaaagtgtcctttaggcaaaattaaatgattatagagtggacactaatatacaagaagtgaggagattggctccaggccaaaatcaaaatctgtatgtgactttccaggcctgactttaggcattacaaaggctttgcctggcaggcgctactgggagaaagctgcccccttgatgtggtttgattgtgtccccacccaaatgtcatcctcaattcccatgtgttgtgggagggacctggtgggaggtaatttaatcatgggggcaggtctttcctgtgctgttctcatgatagtgaataagtctcatgagatctgatggttttataaaggggagcttccctgcacaagctctcatttgtctgccaccatgtgagacgtgcctttcaccttctgctgtgattatgaggcctccccagccatgtggaactgtgagtctattaaacctccttttccttatacattacccagtttcaggtatgtctttatcagcagcctgaaaacagactaatacacctccccacagctgacttagtgctctgccagtgggttacagttttccagaaggagctgcagtcaaggactcaggccgcctagggcagccacccattcctcacccaaacacctccattcaaggcctccttatcttatgaccaagatactttcatccactctgacccagtacttttctagtcctagacttcccctactcccttctgtcagtcccctggaccataaaatgtcaggagtcatttgttcagggctctttggtagtgagatgattttccctgtctgagctgattcatctgacccttgcctactgccattccctggggaaaaaatggaatgttaggaagctggtgcttatttttgcctcttgtttacactatttctgtaagtgattaaggcttgattgttaactttcagtttggcttattgttctgactgaccacctaatcctggccactggacagaaattaagagcaaagaaagtgataaccgttttaaacaaacatagaataaataaaaaccacaataataaggtggtatttgaaaagaaaacaagatggaaagaatatatttcactggaatagcatgtgaataagacgtgaagttactggaattagtgttctaaggtccttttgaaactgcctttgcaaaattataacagtaagaaaaatctgacctagttgactccatctcacttctaaccccaagctgtccttggtcattcctggacataggccaagataactttgagaggaatttagtttacagtttaacttagaagcaagaatgataatagtccctccctgaaactaaccctctccctgttcaatggctgaaactgcctttgtaagactaatgaaaggccacaagattaggattatgggagaggcccaagttctgctaaaatgtaggcatagtttctataatttcttactgctcaggagtcatgtggccagaggtcccaagatttataacttccccaattgcttctataggtatcactgttgtagaacctaagactggggagttttttttttttagatgtttttcagactgatcccatctggactcatgactcagctggtcctgtggctctgcccacaggtggcctcactgcacaaggacagtcttccagtgatgtgatggcattcccaaccaatcagctgcacccattccctagtcccctgcccacaaaactgtccataaaaaccctaacctctgacccttcagggagactgatttgagtgataactccagttcttctgcatagctggcctcatgtcagttaaactctttctttactgcaatgccatggtctcaggcaattgattttgtctgtgcagtgggcagaaagaataaatttaggagctcatatgggatccacccttgtgggtgcctgcttgcagttcattggttccccacaggtccgactgaccw

SEQ ID NO: 17607 - DNA, 317876 bp, Homo sapiens
  misc_feature (1)...(317876): n = A,T,C or G, or insertion/deletion polymorphism (see Tables 1-2)
agtgtcaggattacagacatgagccactgcacccggccaacttccccctctaatagttctaatgaaatattaactacccaagtatttctgtagcctgttttctgaatatctttctcactgtctcctcatctgactgtccattgccttaaggctccccaggtcacatctctttaagtgtactctaggcgggccgatcatgaggtcaggagttcgaaaccaccctggccaacatggtgaaaccccgtctctaataataatacaaaaattagccgggtgtggtggtgtgtgcctgcaatcccagctactcaggaggtggaggcaggagaattgcctgaacccaggaggcagaggttgcagtaagccgagatcacgccactgcactccagcctgggtgacagagtgagactccatctgcggggggaaacatgtactctaacctccttaccaactctgggtctcagacatggctccacagggttgcttgtaaaatgcaaacatgaccatgttaatctcttccctaagagactctcataattctgcagtattaaaagtaaataaaatctaagctcattaaaatgatatttcaaagtccttcttgatttggcttcctgttcatttttaaaacttcatctcccacatatagacactgctgtagccctgctgagctactttctactgaaaagctttgtatacaccattactctgcctgaaactcctcactctactattctacctgggaactactcagatggactcctgggaagcctgcattccccttccaggcagagttaattctctcctccattgttctccaataaaggtctctctctctctctctctctctctctctccctccccctcccccaacctctgtttttgtccttagccatattctgattaccatgaccccttcttaaccttaaattcccctcatatgaaattctagtatactgggattaactttcatgtatgtttttgatgaccacaggaatttttatttgtgaagtctgtgggaattatttaaaggaggagcaaagaactgagcattcagaatataaagggaggagaagtgaatgtcacagaaggagaaaaggttgcacagagatatcttgaaaaacataaaaaacaggagaaaggagtagttcattctgattcttacaaccaccttcaggtggttttggaaggagggagggagggagagaagggagctaagacttcagtgagaaaggctgtggagccaggatgaggaagaaagagaaaggtgagaccatgcgacaggaccggagcagaagtcagcaggtcatgaattatggatgagcagtacactgaacatttggataccaccctcattccatgtaccatgtatggtatcagcaacaatgcaaaatacatttgcatgtgtcttgctgaagaagtcaaagagagtaaaggctgatgagtggaaatcaacagtacagcagacaccattataaacttaaagtctacaacatgccattaatgttatcagtgttctgacctaagggttttatttattttttattattttattttatttttattttttgagacagagtctcactctgtcacccaggctggagggcagtggcatgatctcagctcactgcaagctccgcttcccgggttcaagccattctcctgcctcagcctcctgagtagctggtactacaggcgcccaccaccacgcccagctgattttttgtatttttagtacagacggggtttcaccgtgttagccaggatggtctccatctcctgacctcgtgatccacccgcctcggcctcccaaagtgctgggattacaggtttgagccaccgcgccgggccctaagggttttattttaatgaatgcgtacaaatgtgcataagggttccttaggtaaactctccaactaggtgccctcctccaaacactgagcagcccccagagcagatcctccctgtccgagggctccattgctagcaccccatataaaagcttcctcaccctggttactcagttccactcaaggatgataccgtttcttttggattgcctgctcttcaaaactcttggatttaaatggaatcttgctctccacccaccaatgtggagttgttctgtgcttcctggagtcaccttgccttgttcttagacatcagttacctttgcctcacacctttaactccaggtcagcaatcgtcttcctcactcaaagtccccaattcatctctctgctctgaaatcctcttttataggagaaatgatcagacacccttgcttctccttgtacccaagattataaagacagctgtgaattctttttgtcattttttcttttaaggaatctaaacccaagagaggatacaggagggtgaggattattatatttctttacatgatattgataacagcttatatttaatgaacacttattttgtgccagtaacctaatgtgctaaacattttacataacttcagtgctgttattatctgtctgctgatgaaaaaacaaggttccatggtcagtaagtgatggagtcagactttgaacgcacataaatgagcttcaggcccgtgttcttaaccttcaaccatgtggtcttccctagactggaggcttcagagggaagaatctgcaatttactacatttcgtgttcctatcatcttatagatggctaatatgtaaagggcacatgcagaatattaggggaatgcattctagattagggaagagacaggagttttactagtcaatgaaagatagaatttcaggtctatagaatgtttaccttgggagaggagaagaagagaggttatctaccatatagatctgaaggtcatagattctaaaactactttaattcatctttcctgaagtatttctgaatagagtaagtaaacagaatgagtgccaatcccttggaaacagcaattgatttttatattgcttttcacagagtcaacatatgcagacagtctgacttgcctattgatctgagctagagttgagtgaatgagctggatgtaaaattccctaactcatcactaaaagtcagtcagaccttgaacgacggttactttcttttttttttctaacatgggtgacaatgagcaattgaatgcttagattgggagctgagagattatctttactttgttgagtaataaacacattaattaacaaaacaggaaaatcctgtcaaagaggaagtccttattaagatcatgctggaggccttttctattgcactggaaagattagctgagttcagtggtctttaagaaagtataatcatgaaaatagttacgtccagagctcagagagtttgaattatccttttgattggaagattctagcccagactattttatcctattctaaacttgccaaaaatttcatattgtcaaactttccctccaccccatgccaagttgttaagctttcaaataaacaaatttattatgataaatttcatctctattgatgtaaaggctattggatatcttttcttagcatttagtttaataccaaattaatattttgtatcatcctgatatatgaagacatttacaaatatagaagagaaataattttaatcagttttattgtgctgtaatttacatctgccaaagattatctattttaactatacagctttatgagttttgacaaatttatacagtcatgcaaccacaatcacaatcatgatacagaacattttcatcacccttaaatattccctcatgcctccttgcgatcaatctcctccccaacccctggcctctgatttgttgtctatcagtgtagttttggcttttttagattttcatatggaatcatgtgatatagaatcacttaggaagtagtcttttgtgtcttattgttgtccttgaaaaatatttttaagcaagcaaaatgacttgccacaggttggcagaaaaatatttgcaaaatacatatttgaaaattcttgtatctagaatatatgagctcttacaatcaataaaagacaaacaacaaaattttaaaaaataggcaaaatatctaaacagacagttcaccgaagaagataaacaaatggcaaatatacataaaaagatgcccaacatctttggtcattagggaaatataaattaaaattgtaatgagatacctatgttgacacaaagacctgttcacaaatgttcataacagctttatttataatagtcccaaactggaaataactcaagtgtttatcaactgatgagtagagaagcaaactgtgggatagccatatgatgaaatactactcaataataaaagggaaccaattaatgatatacactacagcacagatgaattacaaaagcattatgttgagtgaaagaagcagatacaagagacatatagaagaaattgggaaggtttaaaaaaaatttttaaaagcagtgactatttgagtatcacaagtaaagtttttttttgttttgttttgtttttgagacggcatctcgctctgtcccccaggctggagtgcagtggcatgatctcagctcactgcaagctccgcctcccgggttcacgccattctcctgcctcagcctcccgagtagctgggactacaggcgcccgccactaagcccggctaattttttgtatttgtagtagagacggggtttcaccacgttagccaggatgttctcgatctcctgacctcgtgatccacccgcctcggcctcccaaagtgctgggattacaggcgtgagccaccgcgcccggcataagtaaagaattataagctatggtacataatgatcctctcctcaaagagcctacataagtaagacacaaaataagtaaaacacaaacaggcttgtcctgaaagagcctgcatgggtattaaccaatgcaatggtaattacctagagatttttcttagaagtgaaatttttacagctctccctcaaattcagttttgtctgtgtgctcatggaaagtctgagtgcatcaatagttgattttacaatcgaaatgtagaatattttcatcactctcagtggtttctgtagtcccagcacagagtgagtggggacatcagtgctccatgtcctcaaaccatatatccagctggaagggtgtatagcgcagtgtggaaagtgggaatggattccacagccgtccataggtcccacagggatgataaaaagtaaaaagtacaaattctttgtacattctggatattaacccattttcatatatatatgatttgcaaatattttcttccattctgggagttgctttttcactctgttgatgtattttttgatgcacaaacgtttttaattttgatgtattccaatttatatcttttggttgtctgtgtgtttttctttttttgcccatgcttttggtatcatactcaagaaatcattgccaaatccaaaatccaaggtcatgaatttttgtcctattcttctgagttttatgttatagtttcagattttttgaaccattgtgagttaattttatagttttagctcttagatttagatctttgaacttttttgagttaatttttgcatatggtatgaggtaagcctcctacttcttttgcatgtggatatctagttttcctagcgctgggtaaaggtggaactcctctgcaagggaggtgaggaaggaggggaacagagaaaggtgtagataatgaccagtttacttttgttgaaacctagttacttcttaagcaaagattgtttaagtggatgttttcaaagctgcttgttactgtttcaaaggtcaaatagataatgattaagttgcgcatcacttaaggtagattttgacctctcacaagttgaagagtactgaagatctaagatcatttacatccctctggaagaaaaaataacatagccttctagggcaaagaagaaaaaactcaacagttacaggatattccatggttcaaagtacacctgcctggtttgctgttctccaaaatcccatgctcagttggttggagtggcctcactcttacctgccaacctgggaggttgatgatgaacatgtctttaccttttctttggagtttgcttaccttattaatatttgctgaagtaaatggcgaagctggagaacttgagctgcagagacaaaaaagaagcatcaatctccaacagtaagtaaacacatgggtcattcctgctcagggactaggctaattcctcaccagttttcccaaatagccagataaacaaaggtgcaatttttcttgaggaaaattatgttgagaagcaaacagggaaaaacatttagactgaggtatgaaattactttcctatgcacaaattattatctgtcattttgcaaataatctgtttgcaattgccaggaggtatctctgagaaatgtgcagagaaaaaagtggcagatgagcaggggcagttgggttgagatgatcaaaaagtgaagatgtatttggcctgtagttattcagtaagaaactttgttattttggtttaaaaattgtacttgctaattactgatgcattctctsgtttgaattatataggcctcgaatggctacagagagaggaaatttggtgtttcttacggggtctgctcaaaacattgagtttagaaccggatccctgggaaaaattaaattaaatgatgaagatctcagtgagtgtttacatcaggtaatacactggaaatatattgaagtcattttgtatatccatatacggtgacttaattgaacaagtctagattaatctgtaccttgaatcttttttaattattattttttattaatacataatttgatacattcctataatgtgtaaagttcaaatcagggtaattgggatatccatcaccttaaatatttaccttttcttcatgctaagaacatatgaattgttctcttctagttattttgaaatgtacaatagattaatgttaactatagtcaccctactggtctatcaaacactaggtcttatttcttctatctaactatatattgtattcattaatcaacctgtcttcagcctccctcccccttcctagtgtaccttgaatctttagcatagagaacataattgggcatcagacatgttcttgtaaaggacgatggcctggggttaatagtgggtagagggagtatgctaaaagatagaagctcattgtgccagacaatgcaccctagtccagagaaggcacggagggtggaactgaaactcctccacaggggatgcgaggaagtaggggaccaaggatatgtggacatgtgaccagtttgcttttgccacagaacagaattggccagttattctcctgccttactgggtgttttcatttcccaataatcactgcatatttcagtcataatgttagaagtcagcattattcagagcttactgtgggccatccactgtgcttagcaccgtatggatgttatctcatttgaccttcacagctgtcctatgaggtggcctttattgtcaccctagttttacaagaggtaaagaaaccctgaagcagttaggtaacttgcccaggacagcaataaatagctgagccaggacttaaaacctaaacagtctgcttccaagccaggtttcttaataagcaccctaaactggtattataggaaaacatacaaatggaaaataccttgatctattgttactgaaaaggataagtggaattatgctgtggctattttagcccagtgtttattacgcatggtgttgttttggtttttataataataggcaagatcttagtgcttaaagtagaatactactcaagtttttaattatgttactgtaaagataaatatgatattttcactagtgctcttcatttcttcttctttttctaaaattagatccagaaaaacaaagaagatattatagagttaaaagggagtgcaattggtctgcctcaaaatatatctagtcaaatctatcagcttaattccaaggtaagtctgacatctacgtcataagaaccgatgagttctccctagttctattgtataagtaaccgttttgtaggggatataccaactttgtgtgctctttagagatttagcatgtaactactcactgtttggttaaatgacacagctgtaatggaggctgtagaagtgatggacagaaggcaggaaatgctgtgcaagcacttgttgcagaagtaggccttgggctgggagcagtggctcactgcaagtgaatggatgattaatataaaaaactgcctgtaatcccagcagtttgggaggccacagagggagggtcgcttgagcctaggagtttgagaccagcctgggccacatagtgagactccgtctctaccaaaaaaaaaaaaaaaaaaaaaaatagctgggcatggtggcatgagcctgtactcacagctacttgggaggctgaagtgggaggatggcttgagccagggaggttgagrctgcagtgagctatgatcatgccactgtgctccagcccaggcaacagagtgggaccttgccagaaaaaaaaaaaaaaaaaaagaaagagagagagagagacagaaagagagagagagacagagagagagagagaaagaaagacagagtgaaagaaagagagagagagaaagaaagaaaggaagaaagaaagaaaagaagccttgctgaagttctgagagcaatcttcttattggggaagtggatgcatcactgacatttatgaacatttccatagtcactgcctacagagaagcaatcggtcaacttatcagtgggttgtactttaaaaaaaaacttaaaaaaaccccagaaatctatgtgataggagggaataggaaggaagaaaatcctgaggggagaggaatgaagaggaaaaagggaataaaaggaggaatgaacaaagtgtgtccctagcagagggcattaggacaatatgtcaaggatataacatcacatgtgcaatgcctttgaaccagctaactgaagctttttcttccctattgccagctggtggatcttgagagaaaattccaaggcttgcagcaggtaggtctcatgctactacatacccaaatctttcacagaaaacatactagaatcattaatagagctgctattcttattttgaaggtgaatggatgattaatattaaaaacttgctttttcccataatttaattctcatcccagcrtgtgcttcccaggatgcagatgcagagctgagtctaagacagatgaaatgacaaggctgaggtctccgagcctgttagggcttctgaccctgagtttgcagcccacagcccacatcctttaccatcaccctttagctgtgtgtgctgtgcttggtcagctagtgatctcccaacttgctgattctcccatcagggactggggctcggaaagcaagcatcctctctgacgctaagctcggaagtctaggtgtatcacaaaatagtccgaattttcttaaaaygacatttgctggtaattaaacttgaacagtttcttacagaaaacattgtataactgtactacatgcttgtagactgatctatgtaaacttaggcttcttaccccttttgtaggaagctgaccttttaaagactttcatggaagctgtaaccttctatgcagagaaatgtacagaatctcttcatgtttaaaattttgcataaaaatctggggattccagtgtaagaatttctgcaaaaatattcttcatctgttttgctcatgcttcaagcattttcctctacttttaagtttgatctgtcccactgtgaaggacagatacaaaaaaaaggactcatgcagattgaggcaggtcccaccattctggcaaggattgctgctgcaaacctttttgtcatttgatgatcaagttcgtgtattccttttctccacttagataatacattgacccctcagctgtcatttttaagagagtagttaagcgaaagaaaatgagtaaagaatagtgctgtggaccgtgacactgcactcaagttttgtctcctggagggcttcattatattcgctcagccagtcctcctaccctcatccctcaggaggaaygttgaatgattttcaaatgtgaatgctttgtgcctttggatagggcaaatgctctctggccaccacagtccccaccactccctattgtcttcctcctgactcctgatttcattttctactaggcccctgtaggcttttaagattttagtccccagacagtgttgcttttgtctgacagaaaacctttgaatgagtttgtggttaatgttttaaagagcattctatgatggacagagccaattgttgtgctagcacaaagagaaaaatagaataatggaataaaacagggttcataaagagacccccagacgtgtggtcatctaatttatgaccaaagtggagaaggaatgtgctttgcagaaaatggtattgagtcagttggctatcctctggctttctatttcatccataaaatgaaggaaacagacgtaatttttttttatgagtcactgtatatagtatgttgtatttgtatgtgtgtgtgtatgtatgtgcatatatatagacacatatataatatatatgtatgtgtgtgcatacatatatatgaaatgtaatcaacagtttgcccctattttaactttttaaaarcagagaattaggttgggtacggtggctcacgcctgtaatcccagcactttaggaggccgaggcaggtggatcatgtgaggtcgggagtttgagatcagcctggtcaacatggtggaaccctgtctctactaaaaataggaaaattagccaggcgtagtgggacattcctgtagtcccagctactgaggaggctgaggcatgagaatcgcttcaacccaagaggtggaggttgcagtgagcygagatcataccactgcactccagcctgggtgacagaccgaggctccatctcaaaaacaaacaaacaaacaaaacaaygataccaaccaaaacccagacaattggactatgagtgaaattcataaagtggccatcattgcataatcaagtgttccctctaaagaagttttctctggctgggcgcggtggctcacacctgtaatcccagcactttaggaggctgaggcgggcggatcacgaggtcaggagatcgagaccatcctggctaacacggtgaaaccccgtctctactaaaaatacaaaaaattagctgggcrtggtggcgggcrcctgtagtcccagctacttaggaggctgaggcaggagaatgkcatggacccgggaggcagagcctgcagtgagcrgagatygcgccactgcactccagcctgggcgacagagcaagactccgtctcaaaaaaaagaaaaaaaaatcaaaaagaaaagaaaaaagaaaaaagaaaaaaaagaagttttctctgcacccaaaggcagtaaaaatcttaacaagattcaaactggtagctgacatagggtcagattccccaggttatgtagatgtagatgtagacaaaggtaggtctgtttgtgatctgggctgaaagcagtcaggtgagcaccagggtgaaagatatgtcttagctggccacatttctaacaaagggacttggagcaggagttcagtcaccttaacccatgggaggaggggcagcagcagcagatgattatatttcaaaggctcacctcgagggaccaaagataagaatcaccggtaaaataaccggaatctccattttattttctttgtgcaatagcaacatccattattatttccacacctgaaacctttactcctgtccactgaggtctctttctcaggtgagaataatacttttccaagacaaagtgagaatcttctcccctcagacttcatcccacccgtggtcaaaagcatgctgagagttaaggaataggaacaagattgataatagaaaatgctttctgttttttcacaagagaggtgatttgaagaagaacataagtaatggctttaaagtgtagaaggagacccccactgattaagagttaaatgtaatcccacgtgcacggtaacatgcgttttgttgctgctgactgcaagtcatctcattgactgtcctgtttttgtttcagactgttgacaaaaaggtttgcagcagcaatccttgccagaatggtggaacctgcctcaatctgcatgattcctttttttgtatctgtcccccacagtggaaggtgagtcatctactctttggttaagaatgatggcmggtcagcatctgtggtttccttggaatcatcaggcatatttaattctccatctaaagtttctaggattctgtggcctcccaaatcaaattgaaatataccaggtatgctaaaacccaaacagtggtgagtatgattgtataacccaccaaatactaaagccattgaaaggagaggttcacttgattggataactgcctggaagaacacaatatttctgttaacattaatttaaattgttcagcattggaaagtaccaaacaaatcttgacatacctatgcaaattttctcattttctttgtttgtttattttttctgataacgatggaaactgtctccagcatgcacataaaaaaaaaagttaagtaagtattcccagatgtagcaccactgtgaactgaggattctattatgtttagataaggattcctctcctgtgactgctgtgatcttatgaagagctcttgtgttctattaggtgaaatctgagttccagaggaagaatagccaggggttaatatcagtattattgtatttgactttatgaggacttatatactgtccacgtataaatccttaaacgtatcatgtgaatgttcgctccagatacctctgtgacctttggcacctgactttgttccttatatgatcacagggtcctctctgctcagctgatgttaacgaatgtgagatttactcaggaacacccttgagctgccagaatggaggcacatgtgttaatacaatgggaagttacaggtaactttttttttttttttttggtaaatatcaggtatatttttgaaggcctaaaacatcccatagttaagagcatcctaaattaactatctgtattccaccaaaagttggtactccatgaggaaatatttagctcttgcttaacgtctacatagctatttttacttaactgaagaaaagctcatgagtcctttactctcaccccgtgaagaaatccttgctctaacatccccaaggaaccggaagaaggctcccgtgattggcacagagagtaagcatggcctggtgcaaaaggagctgaagacttaggaagagccggagcattgaaggggagccactgaatggccttaagtagaaaaggggacaccccaccacaccagtgtccccagctgtactctttccatgtattagcaagctcatagttttgggtaaagagagctttattcaatgctatgtcaaaatgtgacyataacgaggtcaaagattaaactgaggttcaatgaatgaagtaactctctctgaccacagtcatcattatcagtacagctctatcttctcttctgacttattctgtmaagtgacttgtccacagaattctcctgctcagctcaggcatcactttctgcaggaaactttcccttccctttttaagcagagtgaggcatctcagggcctctatgttcccatcatgctctagggatatccatcgtcaaagctttgctgatgacacacacattgtctttctaaaaacgaagtccaaaaaattaaggcagatcaatgccaaacttacttttgtacagttctttgaagtcaccttttaaactagacagtgtctttccttatagtttggctggtctcttttattttgtgatttttaaaagattaataaataaattctgctatagaatgaacaaatcctttcaatgctctggagtagaatctcactggattgaagagcaattatttgctctcttactggtgtctctgctatcttgttcttcaatttccacataacaatatccattctagtctttccagcaaaaatgagtgcagtaattttgttttttaaaccatcactattttttttaaattttattattattatactttaagttttagggtacatgtgcacaatgttcaggtttgttacttatgtatacatgtgccatgttggtgtgctgcacccattaactcgtcatttagcattaggtatatctcctaatgctatccctccaccctccccccaccccacaacagtccccggtgtgtgatgttccccttcctgtgtccatgtgttctcattgttcaattcccacctatgagtgagaacatgcggtgtttggttttttgtccttgtgatagtttgctgagaatgatggtttccagcttcatccatgtccctacaaaggacatgaactcatcatttttttatggctgcatagtattccatgttaaaccatcactattaatgcacacttctaaaaatgcagtcacaaaccttctctttttatttgatacttttgtttttttgatctgatctttaaaacttttactcattccaggttataaactcaaattattcaaacttctactagatatgtctatgagttcaatcattatgcaaaagtaaaattaaccacttctgacttaaatttagtgttatgttattaaagagctttttgattccaggactctgtttctcatttaaatgaagmcttttttccctgcctttgttaggcttgggctggaagcaaaatgcagtctagtctctcatttccgtgaacccattatctcctgatttctgtttatgggcatttatcaaggaggattgctacatagaggtattggtggcaaatgtccaggctcctagaacttctgctttctgaccttcctgatatctaggaatgttacagagattagatttcactcctagtcttcctttatcatcactgtcttttggagtcttgtgggccaatagagcgacaagtatgggcaaactgtgatgagatccatagaccaagataaaggctgttgctgttttcagcacgttatttyttccccctgcaaaatgaaaaacaaaacaaaaacccttttactatttaccactctgcagcatgtcagaggttagagttctttwtccacacacacatatgacagaatgagagctaggaggaaaggaaccatttatttgttgaaagctgcatttctaaatgacagattcaactttgtaagaacagtacgaaattctctcttgcactcttttataaaggagagcaagaatacagaagaactratgatgtgtggatggctttggaaatgatcttgattcctagactctgcccttcatagatttgctggaggacattagagaacagagcatttaaatcagggttctttctcttgatatgggaatagtttctgaaacctcatgaattccatttcattatctacactttaagtcccgtaattcaggcatatgttggagactttttgagggaataaaagaaaatgaaaaaaggtgcatgagcataagattaaattattgctttgtggaatccacgtgtaatgaaacaagtgaacatttagatactttcttgagttctgttaattatgtgaggttaaatccttgttaatcagggtattcactgaggctagaaaaccctttgggaaatttcagcacacattagctaaaagaaaacttgagcctcagaatcatctggacctgcaaaaatgtagtcatggcatcaaagttcgctttggagtttggacctcattcagtttctttaactmtttgagctcttttacttggacggaaaaaggagtctttaactggattaatmatttgccattgtaaagacctctgaaaaggtgcagatactcattcatggaaagtcctgtttcatacctgtttcataggtaaacttctggtggaaattcttttttagaacaatgattatagcacaagaaacatcattttctgtttccactgattcttttggcttgaggtctagacccagagcttcagacaactaacacaattacatttygccacttctccatgctgttactccctctttgttctgaagacgtgattcttgttgtttccctgctcactttgttttgttttgtttgtttttgtttgtttgtttttgagacagagtcttgctcttswcacccaggctggagtgcaattgctgcaacctctgcatcctgggtacaagcaattctcctacctcagcctcccgagtagctgggattacaggcacctgacaccatacccggctaatttttgtatttttagtagagatggggtttcaccatgttggccaggctggtctcaaactcctgacctcaggtgatctgcccgcttcagccacccaaagtgctgggattacaggcgtgagccaccgtgcccagcctcccctgcttactttggatttaagacagcccttgggatctgagcttgccatgcatggatggtgtgtgttgtacatttagggctcagatctagaaggctttccagaaaaacaaaaagttgagtttctctggttttccrgaaacatgatgattagtaaattttatttcacttatttccattcatatcactggtagattttacatcatgcagagtttaaacaatgaggataatctagttttagctcaggtggtagttaggtattaaacttattacctttttcactcagtcagtaaaattagtattgaaccatggactctaacacaagttaaactatgactatccaagtgtgtttaacctcttctcaattgccaaaatgcacttgcagtgttttcaaagaaaagcctagatttgttctgctggaaccaagttggcaataaaaggtcatagaaaagacacttctgctatatcagtaactaataactaaagcaggaatagtagtaagttggttttaaaaatacaatatatggcttttattttcacttagggaggtatataagtaattgttcatttttaaaggccatatcaagacaccttgaaaatatattttgcctgttaaccctgttatgtttaaaaggtacatgaggctgggcacggtggctcacacctgtaatcccarcattttgggaggccgaggtgggtggatcacctgatgtcaggagttcgagaccagccttgctaacatggtgaaaccctgtctctaccaaaaaatgcaatacttagcttacgtgctggcacgcatctgtagtcccagctacttgagaggcagaggtgggaagatcgcttgaacctgggaggcagatgttkcagtgagccgagatcgcaccactgcactccgcctgggcacaagaccctgtctcaaaacaaaacraaacaaaacaaaacaaaaaggtgcataaaaatgcagcatcttcatataactctacttatcagaatgtaagaatataacatgcaggaacaayggtgcaggagtcgggtagacctaagtgtctatttatcttctgccaattattcattttgtggttttgggaaatgttagtctgtaaaatgggattaataatacttgtctttgaggatcataggaaggaatcctatggtttacttgagtttcttcctccctttctctatcttctcacatcatctaaacttaagtgaaagaagtatactctgtagctatttagagaacagtataggattaatgcctactcatctcccagtgataatagcaaggatgaaggaagagagagataaagagaaaggatttaactgcaggtccatgaaccagaatctcctctcaaatcttatgtcattttgcaatagttaagcacttagtgataaaataaagacaatcttcttagcacttgctacagggraatgcctgtagactgcaatatgaccataattcacagagattaccactattatttcataagaaattgaggcagagggagttagtacattgtctgggtaaacagttaacaggaaggaccaaaatttaaacctaggcaatcttatcccaggggtttccaaacactcagatctcccagacatagaaaatagaaagctagtaacagttggtttaaagattcttcagcagggtgcggtggctcacgcctgtaatcccaggactttgggaggccgaggtgggcagatcacctgaggtcaagagttcgagaccagcctctacctctagaaaagagacttctgctaaatcagtaactaatcaattggtttcaccacatggtgaaaacccatctctactaaaaaaagaaataaaaaattagccgggtgtggtggcacgcacctgtagtcccagctactygggaggctgaagcaggagaattgcttgaacctgggaggcggaggttgcagtgagctgagatcatgccactgcagtccagcctgggtgacagagtgagactccatctcaaaaaaaacaaaaacaaaaataaaaaagattcttaaacattgttgggaggtgttgggacaggtggcaaagtaaacttttagtaatgaagyctcctggatcaaatgctcaaatatgtgtatgaactgttttaaagttccataatcctcaagagtctaattaaattctctatacaaatattctatgtaaagatgggaggacaaagaggaaagaaaacaatatgagaaggraagtagagagagatgcggggaatataaatgtctatgggggggatggataattcaatttctctttaattttaatcatttattgttattttcctatgactttatcttagtgagccgttccaaaggcaactttggaatgctcagaaatgtcatatattaatgaatcagcttttatgtaaatatatactgatgtygtaaattgcatggaacatatttataccaaaaaatattcatttattggaaactcacatttatttgggcatgctgtatttttatttgctaagtctggcctcccgacttgaatgcatggatggtgctccctgcattcttattctccatttctggccacactcattgctctcctcttccttagaaactgccaaaaagctgccaccccagcaattggttctggggcccaccacaggcaagccgaatcctrtgcctggagkttggttcttgatgcctttcaaacagtcaaatgctaatttcccacaatgtcgttcatacattgtcatccatgaacattackaagctccttgtacctcactgtgtcttgttaaaatagctcttttcctttgtagaatggcatgggagggaggcctggccacgcaggcacgccctgttccttgtctctgacccctggcaccaacagtcatttcccccatgagagcttttcttgccaattctgctcaagtccggcaatcggcaacctctgggcctggccctacctctccatcagatgtgccctggcatgtggggataggcttaggcttctgggactcctctaccctcctcctcccctagctcccatgctcagatcatagaagttcccattaagctgcagagataaggctaaagcagctttaacaatgacaagggcttaaaacaacattgcttatttgattatcattggacttaaatcttctagtaacaaagcacccactgctagcttacgcatagtgtaataattaccacattttgttggaaattcaagtgtggctatgaaagaaatgccactgtattatattatataactacgctttttatggatagaagacatattgccctttgtaagataataataatgatcatagactgtgaggtgtggacactggattgcgtgtggggttatataatcctagagagcattcagagttatcagtgtagcccacgttgcctgtgcttcatggcaggtccaattggacagatgatgaatggatttgctgatctctccctttaccttcttgaactaactccattacctttggcttatacacatctgacctttgaaaatgctgtttgatgacctgataacacaagaatttatagtgctaggcttaccagataataagttgtgattcaccaacattgtatttactcaatccaccacttggagcacagcagagtgattttctcccgagactccagtcagtaaatttgcattgctggctgacgattccaagttaacatcgttgatttgtaatttgaattatttttctcattgatattaagagacaggcactggccccaaagcgcrtgccctgacattgtgctcttgtgtaaccaacagttgtcactgcccacctgagacgtacggaccccagtgtgcatccaaatatgacgactgtgaagggggttctgtggcacgctgtgtccatggcatctgtgaggatttaatgcgagagcaagctggagaggtgggtcccttccccaaatgtgcctccttgcagagagccatggttagtagctcctcctcctcctatgcccactgcatacaagcactacctggagcttacagaggtgaagtcacttcctgtctgtaagtaggacataggcgaggaggggagatgaactatgcaggaagtaggacccagagattaagatgtcattatgtaaaataggatttttttttttttttttttttgagatggagcctcactctgtcacccaggctggagtgcagtggcacgatctcagctcactgcaaccttyacctcccaggttcaagcaattctcgtgactcagcctcctgagtagctgggattacaggagcatgccaacatgcctggctaattttggtatttttagtagagacggggttttgccatgttggccaggatggtctcgaactcctgacctcaggtgatccacccgcctcagccccgcaaagcgctgcgattacaggcatgagccaccgtgcccggccgaaatgggaccatttttattatcccgtcatgactctctctgagataagaccttctcttggccttgtaagttttattttaacagtgacaaaacacaggaatataaaaggaccagtcttgttggcaacatgtggtttcaaggagtctgacttttcccggcctgggtctctggaactgctgcagactctaagagcccactccccagaacgaccctccatgccctgcgtcctgatgactttgactcctgaccctcaaggttgtccagtcttggctggcttggctcttcatgagaacttcaattctttatttttagttgtattttttctacccatgtgatggaaaataattcccgtccaatgatggggatggaagggttgaggaggtgggtaggaggaagaactttccaaagaaaaacaaacggaattgattttccaargtctgtgcctacatgggtgtttttccctctaaaaacatagcaggctgagttgattgactttaattatattgacttacagttcttgattgttgttactctttccctggcatctttgggagaaattatagcttgcttttactctgaaataaagatgtttccctttttgcatggtctggtctaaatgcttaatcatatgggaagaaaaagasaagccagtggattggccttatggaaatgaacgttagaggataaacagttaggggcttgatgaaatgttcaaaggcttttcttgctgattttcatgattgtctttattcacgctgttgtcatcctgccagcccaagtacagctgcgtctgtgatgctgggtggatgtyttcacccaacagccctgcctgcacgctggacagagacgagtgcagcttccagcccgggccttgctccacacttgtgcagtgtttcaacactcaaggctctttctactgtggggcctgtccaacaggtacattctcagggccacaagccaggctctgcatgccaggttggcgaggtgccagaaccaattttctttcactattgatgagtaagaagacaattcttaggaggtgttcaaatccagttttgtgtcctggttctgctcgacgatctcactgctatcacaattccacgtcaaaagggggaggcttgtccaaaactgtgctagagtcagactttggggcaaggttagccatagaatttgtaagttagacactgcattgcagtgaccaccaactgaccagatttgagatcaaaagagatactctagtcccacctttcatactaaccagatgtttgtacacatggggaaattatttgacctctttgcatctccaccacagtctagtagctcttgcctgggtgtgtcattagagtatcttgcggccttgacctaaacagaggtatccagctccattatgccctgcagcaactgaatctccagggatgccatatgttgagtcatggaaaacatgggctccgttagtcaaagactgcctgtgtttgaatccgagggcatcttttgttttatgagatagtcatcatatattccacacattttttttttgtaggatgcctactatgagcaaagcactgtgctgggtgcattggtaggcaattagccagacctcaggttcatctgcgctccagggrtgttcttagaaatggagccacaaagataatgtaataatagtagctggttttgttttgttttgttgttgttgttttgagacagagtctctccctgtcacccaggctggagtacagtggcatgatctcagctcactgcaacctccacctcctgggttcaagcgattctcctgcctcaccctcccgagtagctgggattacaggcacacctcaccacacccggctaatttttgtatttttagtagagatggggtttgccatgttggccaggctggtctcaaactcctggcctcaagtgatctgcctgccctggcctccaaaactgctgggattacaggcgtgagccaccacacacggcctggtttttatttttaatcaaagtgttattaaggcattgtataagcaatttttaattcttttaactacaacaaaatcaagacatggtaaaaataagtattactcacattttacaatatgagaacttgagcttaaagaggttgaataacttgcccaagatcgcatagctttacagatagccagaattgaaacccaagtttcttggcaagtttcttctcgccaagaaaccccacacacctattgccccatgtagtgatttttggtttagtggttttctgcgtgtatatatttagatcttgtaaaactggaaagaaatggaaaaaaaaaacctataaagactttttccctcttagttctcaggggcaagcacaatttgcaagcaatcacattttgaaggtaatttatcatggacaatctttaaaaactataaatcagaaaaataaattatttaaattagaagattggcaatgtttttacattcttctttttattgttggagaggaaaaagagaaacaatttttttgttttcttgtttatcaccctatttttcctgaaatatatggtagttatattttataagcagcaaagcaatatatgctgcttataaaatatcactacaaaaatatggaaaaaatagaaaaaaatacctttgatcttatcacacagaggaccatgatgaacatttgggcgtttttttcttccaactttttttcatgtacacattttgccatgcacaaatatgataattttcttaggcagagtcttagaagaggattctacttaaatcaaagaatatgaatatttttaaatctttaaaggtttttaagaattcttataattttaataatttgaattataaatctacaaccattgaatacaatgggaaccactaaagtaaaattcttaaatctcatcttcctaatgacaccattagtcatttgttctccttcctcttctactttattcttcatttgtacaagcacatatgcaagagtttaaaaaattctttccccaaattaggagtatgagcccaatcctccatatgattttaacagtttgtttttgtttttgagacaaagtctcgcccaggctggagtgcagtggtgcaatcttggctcactgcaacctccacctcccgggtttgagggattcttctgcctcagcctcccaagtagctgggactacaggcgtgaaccaccacatccagctgatttttgtatttttagtacagatggtgtttcaccattttggccaggctggtcttgaactcctggcctcaggtgatctgcccacctcggcctcccaaagtgctgggattacaggcatgagccaccttgcccagccacatttagtattttaattaatgtatatacaaaaattctttcaatgtgtgtgtatgcaaatgtaggtatacaggtgtacacatgatattaaaaagcgtttttagtatttggtcacaaagatgagtcataaggtgttcagctatgcttctattgataattgagggttttttccctattaaacagtgctgcggtagacatcctcttacctacttataccagtatactaagatgtatactaccatcttagtatactggtagttttatcacaataggctgagttttaataggtgcaactggcagtcaaagtctatgtattttaaaaattttagtgaatactgccagagctctttccaaataggttatatcaatttaatgtctagctatcagcatataagaggagcccatttgcccactttgttgtcagaatttgattttaagaattcaaaacaacttttgccaatctgataagcatatctcatttttattttatagttccttaggtggagaaggtttttatatgttttgactcttgtatttcttccttgttgacttgtctatagagctaaacttttaaatcctcttgttttcctaggctggcaaggcaatggatatatttgcgaagatatcaatgaatgtgagataaataayggcggctgttctgtggctccacccgttgagtgtgtgaatacacctgggtcttcccactgccaggcctgtccaccaggtgctgcctcggttcaatgtcaacctcctgaccccagcacagggaacacagacataggaatacggaatctagtgctccatttaaaatatgatttctggctgagtgcagttgctcatgcctgtaatcccagcactttgggaggctgaggtgggcagatcacatgaggtcgggagttcgggcctggccaacatggtgaaaccctgtctctactaaaaagacaaaaattagctgggcatggtggtgcatgcttgtaatcctagctactcgggaggctgaggcacgagaatcgcttgaacctgggaagcggagattgcagtgagctgagatcgcaccattgcactccagcctaggcaacagagtgagactctgtcttaaaaaaataaaaaataaaatattatttctgtcttaggagaggaaatagtacagaaagttttgcttatcttgtgaattcaggacacattagtacaactctatgataagaaagaaaaaacattttgaatatcagtagaaaacaacaaactttacaaactgtcaaatagctacagagataatgcagaatttgaaaagttttctgagtggatcacagacttactgttccattgccctcacgaataatttgttaatatcatgcactcctgagttgttttgcatataccaagtttactaaaccacaggcatcacagtaggcatatatcgtaattgttggtttccctccttttctggaaagaagtcttttctgctattctctaatctaaatcgaattactacccaagaagttcagggagtactaagggataaactgaaaccttgtatgtttaaataacatggaactacagtactttgggcttctataataaytgacctctaagaacatcagagtcactgtaatataaaaatattaactttcttagtgtcagcactttctaagtctaccagtagttttatacatatttttttcattagaaacaacccagaacattgcttatgaaatcaggttactaattcttgttatttttcttatttatgaaatttcatttgttgatgacattttatacttatattttttgtttcgatgatagaggatccctgattggtccatttcatgatatttgaatcctagacaggctttgtcctcccatcttcttgacattgtttcttatgacctggctcttgttctcatcagggtaccagggtgacggaagagtgtgcacactcacagacatctgctcagtcagtaatggaggctgccacccagatgcctcatgctcctcaactctaggtaatgactcatctctctctttggctttgggtattgtaatatgaccttctaaaccaattcaacatcttaaacacaaaatcctctgttctcaaaattgttattttgaccttcaaacctaaaattaatccatgccataaaactacacatttggctttcttaaatatgtaataaactatgctctttaatggtctgctctgatttaggaaataaggtaattaagccagttaattaattaacgactgtattccaacaagcaggcaggagaaaaggaggaagaaggcaatgccaccttcttttgaaggactcttccatttctaggccattgcttagaactgagctttgctgcaaagggagtttgggaagtacactctatatttcaggcatcctgagtccagctgaaataaggagttcagaaagaaggaagtagaaaatagatctagggtgacaaccaacagtgtttgcaatgctgcatagaagggtttaaccctgtaatttaacaaaatatatactgctaaactttctccaagaaagattgtatcaatttatgtattcaccgacagtgtataaaaatacatatttactccatctttgacaataatagatattattattatttttcatcttggtcagttttataggcaaaattagtttttccattattttcatttatactttttgattactaataattaatactttccacattttcactgggcatctttctacttgttcatcccctttgctctctttctttcttactgattggtaaagtttctttatgtactaaggacattatctcattatctgtcttatgttttataagtgtttttcctggcatgttgtttttgttttaatcttgtagtggtagtgctattcagaagtttagaatttttacgtagtcaaaaagataaatcttttctcttactatttctcccttcacagtcatgtttaggaaggctttctttactgaactctttaaaaattgtcaagtacatgttcttttwtacttctatggtttctttttttatggtaagatattttatatttttagaatgtattttttatccgtagcatcaaatagagatctggcttggtatttttgctcaaataagtggacccaattccatttcttgaataatcatgtctcttgctatttcaagataccacctttattttttattaatttgtcatatacttgcatatatagaaaagaacatatatgtgtatgtaaacacacacacacacacacacacatatacttgtgactaaatgcttattaaatgattatcaacataccaaagtggttaggagcatgatttctagataaagactgcttgcatttttccctgggctccaccagattttagctgcttgtcctcagtgaagacacttaatctctgtgctttagttcttcatctgtaaaatgaggataataatagcacctacctcagggtgcttcagatgattaaatgagtccttatatgtaaagtgcttgtaacaaatattattacaaaaataactgttttttaatatggaggacagtcataatgttgatgacatgaagtattaataacactttgtgtacttttaggctgcccttctttactgcaacctgtaagtttaccctgggaaacttaaaaaatttctactcagagcttcaacagtttcagagcttgcttactccatttttccctataaatatttttaaaagaagtaattaactataaaaaaatgcatttctaggcaattatttatttaaaagaaatatttgtgttttttaatattgaagtggaatcttgcaagtaatataagctgagaacataacaaaacttgtatttttgccaggcgcggtggctcacgcctgtcatcccagcactttgggaggtcgaggcaggtggatcacgaggtcaggagatagagaccatcctggccaacatggtgaaaccccgtctctactgaaaatacaaaaaattagccaggcgtggtggcgggcacctgtagtcccagctactcgggaggctgaggcaggagaatggcgtgaacccgggaggcggagcttacagtgagctgagatcgcaccactgcactccagcctgggcgacagagcgagactccgtctcaaaaaaaaaaaaaaaaaaagaacaacttatattgtcattcaattctactgtaaatctgtcacattgtgtaatttgttctattttttaaattattcagcagggtttttctatccatctttaacagttcttgctgatggaggaatgtagttaactgccacattgatttccttgtattatttcaaccattgtgcagtagtagaaagaacatatatttctgcaatgagatgtggctttttgctattaagtgagaaatctggaaaactctctggatattaaatttagtaaaattttgtaatgtctatgacgagtatttttaacctaacattgcgtaagaaaactgtcaagatgctggatgctctaaaactmtwgttagctattacctcatgtacatcataattaatcgtggatgttaattcatgttttaaatagacacgatcatttcaaattccttttgaccaagttccttcctaacctaattcgattgccattgttttaaccttgwaccttggcaatgaggagctcatcagaagtgtgggagaagttttggtgctggtattttgttgatgtccccatatatttatgttactatattatcttcaatctgtggttttattgcaaacatcttttagagacttaagttcattctgtgatagctatttagcctgtttaaaactggcagcatgcaatctgcacatccacataactggggacatgtggcctgcctgtgtaagccacactcctgtacaggtgtgctgtaggcagcctacacacgaggggagtgcttgctctctgggctcccctcattctagctgtgtgtgtgtgtccttggccgggacaggctgtctgtgtactggcttcatctgtaaagtggggattataagagagtacctatatagggctttttttttttttttttgagatggcgttttgctctgtctcccaggctggagtgcagtggcaggatcttggctcactgcaacctccacctcctgggttgaagtgattctcctgcctcggcctcctgattagcctggactacaggccaccatgccccgctaattgttttgtatttttagtagagacagggcttaaccatcttggccaggctggtctcaaactcctgacctcaggtgatccgcctgcctcggcctcccaaagttcagggattacagattccatagggctctttattagtattattattattataattaaaaaattttttcttggaaayggagtctcactctgtcacccaggctggagtgcagtggcactatctcagctcactacaacctctgcctcctgggttcaartgattctcctgcctcaccctcccaagtagctgggattacaggcgtgtgccaccatgcctggctaatttttgtatttttagtagagacagggtttctccacattggccaggctggtctcgaactcctgaactcaagtgatctgccctcctcagcctcccaaactgctgggattacaggcgtgagccactgtgcctggccctctattgggctcttgggaggattaaatcagtcagagtaagtccagtgcttgcaacagatagtttcatcctaagaatctccttttctgcattaactcctccatgatgaggaatgtctgtcttccccaggtgcagctcacctttgtgcacagctcaggaccatctgacatatgggctgacagcacccatgtcaacccagtacgtcaataatgtgtggaaggcatttaatggctttcttattttaagataagaaatacaaaaataaagattctaatattttctcctcataccttgttttgtctgcccgtcaaaatacacagactggatgttggtggatccttgtctagacagcagattctgagtttagatactgcatccgaacagaggaggagacctgtatttacacgtttgtttttatttctgaacaggttccttacctctctgcacgtgtctcccgggttatactggaaatggttatgggncaaatggatgtgtgcagctcagtaatatttgcctaagtcacccctgtctaaatggacaatgcatcgtgagtcctttgtttttcctgtggacagagagtacctgagaattagtttcacgcctataaaatgtaacgttataggattcaggaatgtcaagataatgagtcaagtttcagataaggaactgtcgagaactctcagatgaaagatagataatgattttagttcttaggaaaaaacattgagttaattttttgtctcagtggtttatgaagtactaaaactacgcctgcagtttgatctaaataaatctgacatacaaaacaattaccatttaaacctattaataacaagtagactactagaaaatacttacatataaacacatatatatttgtagcacctgttaaatatatcagtaggccaggcgtggtggctcatgcctgtaatcccaacactttgggagggtgaggcgggtgcatcacgagccaggagatcaagaccagcctgaccgacatggtgaaacactgtctctactgcaaaaagttagccaggtgtggtggcgcgtgcctgtaatcccagctactcaggaggctgagaccggagaatcacttgaacccgggaggcagaggttgcagtgagctgagattgcaccactgcactccagcctggccgacagagcgagactccatctcaaaaaaaaaaaaaattatatatatataattatacatatataattattacataaataataattatttttaaatatataattatatattattttatatataataattatataattattatatattatatatctccatggcactacattcctattatttgggttgattaaagtttagtgtctatccatttgttttatggtattatgtgttttttttccccttaggacactgtctctggytatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaaggtacagtcagcatttcttatgccacggatgctcacagcatagcagcagcatcctttagtgagtccctcaacagattcctctgctgaacccactttcttgtccagttgctcagatactgagaactaagtctttccttgcagaaatggtataaaattcacaagctaaatatttataaatctcactgtaagccaagaacttttcttccaaagaataaatacattagtatttgccattttcactatgtcctttttgaatataaaacatgctaaggtattgtcttttatggttttctaaagggaagttttctgaggagcagccacttaatttccctagagtactgcattgaatcaagtcactctccctttccaggatacacagtggcttcccgttgcctgttaaatagagactgggattaattttcaatgatcttctataaccaagtctcactcaatccatctaaccttttttttcactagttccctagaaataacttcactcaagcaagttttctttcgtcaccrgaccccatgtaccaccatgagtattttccactgtgttcatttatttggaatgtttctcccgataaacstcctcacacatcttccttgtttctcatccagatgtgtctgtccctcaggagcacttccctctcaacttcttccataaagtcacttttgactcttctgcccctcacttaaactcctgatttggaatcaacacatttattgagaggttgttgttatatgtttaggrcaatagtagaccctatggaaaaatatgaaagtgtaaaatactgtctccacttatgaactgctcaccttgcagctgaggagacaagaccaaccccaatgggagaacagatacaagagttaaagacatgagctatgttgtgtggggtgaaattgggtgtcacagggacacagagaatgggaatcagtgaaaacataagacatggcagttcatggagcaggtgatgaggcatcagctgagctttgaacaagaggtgggatttctatggaagttgacagaaaaagggcacagaggagagggaatggcagggcttttatctccaaccttcattactcaaattttctctaagtttatcagcagcagggttacagttgcccaacctcttccttttaggaacctctgaaaagcacagttcatcttttcctttgcagtttgtggagagtccctctcaggaataaatggaagcttcagctacaggagcccggatgttggttatgttcatgatgttaactgcttctgggttatcaaaactgaaatgggaaaggtaaatgtagtaactcttgcccaaatgcatattatatttgtatatataaatatggagtatgtgtatattttattacataaaatacatgcaatgataattcaactatcatatattgagtgcttactaagtacggagtgccattattttggctagacatatacctaccttttcataaccttacattaattgtttgaaataagtcacaggggctgggtgcagtagctcttgcctgtaatcccagcactttgagaggatgaggtgggtgcatcacctgaggtcaggagttccagaccagtctggtcaatatggcgaaaccctgtctctactaaaaataaaacaaataaaaaaaaattagccaggtgtagtggcacattcctgtaatcccagctactcgggaggctgaggcaggagaattgcttgaatccaggaggcggagtttgtagtgagcagagacagtgccactgtactccagcctggccaacagagtaagactccatctcacaaaaaaaaaaaaaaaaaaaaaaaaaaagagtaacaaggccaggcctggtggctcacgcctgtgatcctagtactttatgaggctgaggcgggcacattgcctgaggtcaggaattcaagaccagcctggccaacatggtgaaaatccagctctactaaaatgacaaaaattagccaggtatggtgatgggtgcctttaatctcaggtactcgggaggctgaggcaggagaatcacttgagctcaggaggcagaggttccagtgagctgagattgcaccactgcactccagcctgggtgacagagcaagactctgtctcaaaaataaataaataaataaataaataaataaataaataaataaataaatargaggatcctccttttatagatgaaataatgaaaagtaggtgaagctaaacattttttgttaacacttcttagcttgtaattgtaatagttgaatttcaaagtcaagtttgtctggttccaaagtccatgctttctccagcatgaatgattctctacactggttgactgactgcaagccactagttaatctgtaaaatcatgttgttactgagacagtattttagaagatggttgcttagttttatgttgattattgtgcaaaaatggccactgatattaagatagttttcttatcaaatgtctttgctctgccatgttctatactaagtgctccatatacattacagcattccatttttaactctcataaccctgaaagatagaaattattatcttcattttacacatgaggaaacagagcctagtgccattgagaagtgtgtccaggtgcatgtggttcgaaagtggcatgcagtgactcagacacaggccagtcacctccacagcctgtcactctgagccgctccgtgaacgctcttcaaattaagatccaagtccaaggtttttagtgctcttatacccgacattaattacccaggcatttctaaatattgtttctcaaccacctcctggattcataaaaataaaatggtatgtctgaatagataaaattttcccttgaaatcctattaactttttccagcaaactattacagagggcattgtacaagggtcaaaaaacatttttttttcctttgaggagggaggactatttgcgacctggtaacctcacactaaaataaactccaaaataaatttcccagtgggtatgctatgtgaatttccttccttccatttagttttcatgaattctatttcctggcattgaaaacattcttttgaaaaaaaaatattcttaggtgagaaacttgtaatactttyattaccaattcgcaagaaaattcatcttgtttttttcttgattattgtgatttcatatcttctcactcataatggacataatatggtagaaaatatatacaaatcaggatagttcaattaatgaacatttgagtttcatttaaactgttttaagaaagtcatgtagtaataggtaactgatcttaaaataccctagcacagaatttwaaaaattccttatattctttttcattaactgaatattgttgtgattttaggttctgatgaaaattaaattcgacagccttcttttgattgtttatctcaaatgaggttgtcagtacgttttataagttatattactatatttgaagtctgtattctaatccattcggacacatttttgtgtttattctcttctacttgtatgctcagtatttttcctgttattcttgtatgctcagtattcttcctctcattctctactcttggtattactcatcctttaattatatccagtccctgaagccgtccaggccttgcttgtctacatcccgcctactccgcccacacctgagcgtgtcggtctgggctggcgtcagaatcttagcccctctggaatcaacatmcctggcgggcagtgatgaacgtctgtgtgtttgataacaggccacaggttattcagggaattagggtgtacattcttgtgaatggtaatattagccagttcaacttaattcaggtagattttcaaatctccaatttattttactgctttagaaacaatgtcagttatatatttgamataccttggtctggtggacttgacaagtttaatgaaattggggtaaatctatgttattaacattaagattttttgatatattttgatattagttgaagtttgtttttaacaatatttagcacaagttatttagtatatagattgccatatgtactggtggataattagggaatgataggtctagctcttgaaagtgcctcagtatgaatgctgcctaggaagtgggagaaatactttaaaatttacatggaagtaaaagataatatatgtggcctttgtatttttaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccaggtatgtgtgaacctggagaaaaaagcaagcaaaattttgaggttattaagtkttcttaatcagtgttagacttttggatacatgagatgttttgggatctgaagatatataatatttttataatttattttattttattcatttatttattttgagacaaggtcttactctgttgcccaggctggagtgcagtggcctgatcacggctcactgaaacgtcgacctcctttgctcaagtgatcctcacacctcagccttctgagtagctgggactacaggtgtgcaccaccactccaggctaatgttttgtgtgttttttatagagatggagtttctctatgttgcccaggctggtctcaaactcctgggctcaagcaatccatctaatttggcctcccaaagtgctgggattacaggcatgagccactgtgaccaaccataattactttaaaatcaaatcaacctagaatkaattagaatttattttgtgtctaaaggcaacaaaataagcatgaaatagaagggattaaaaaacatgagtcttagttggtcccttatcaaattactgaacagcctttttataagctctactagtagtttactgcaggaataytgaggacattgtccaccccttcatgtagtattccttcatcttaatgatcactcaataattttttctttttgttattattttgttttaattattctattttcttttaagtttttactatgcaagttttaaacaaataaaaagtaaagagatcagtataccatgcccccaattcattcatcaatacatctgtggatcaatttcagcattttctcatcttttttactggtgtttttatctatcctgatgctacctaggcttaacttctgatgcttgaaatctgagagtgtaatttcaactttgttcttttcaaagatgttggatattctgcatttccatataagtttttgaatcaacttgtcagttttcccaaagaattttatgggaattacattgaaactataattaactttggaagaaatgacatcttaaaaatattcagcctgccaatgcatgaamataaactattttwaaatttagttctcttttcatttatcctggcaatgttttatagctttcagtgtctaagtattccatrtctttgttagatttatttacagatatttgatatattatgcttagtgaaatattaattttctaaaatttaatttttcacttgttatgtaaaaatatgtattttttaaatatttgattttgattccatatacattgttaaattcactcatcatgtctaattattttttgtagattcttttggattttttaaacgtacataattacatcatgtgtgaatgaaggatatttttcctcttcctttccagtctttgtaactattatttcttttccttgacttattgccctggctaggaccttcaataccaagccgaataaaagtggtgaaaaggaaatccttgtcttttccccagcagcatggggaaatgctcaatatttcattgttgaatatgatgttagctgtaagttttcacagataatttttatcagatgaagagtgttctttcctatgtcaactactattgctgtataactaatttcccacaaatttagtgttgtagaacattaatcatttgactttgtttytgattttgtgggccaggaatttggaaagaacctaacatgacagttgctacttgaaatctattcagcagttataagcgggtgtcagctgggactgtagctgtctaaaggctggactgggctgaatatccaagatggcctactccagtggctaccaattgatgctggctttcaatgagagttcaactaggctatggacctgagtgcctacatgtggctactctaaaaagtttgtcttagaatagtgaaactttcttcgtggcaattggcttctctcagagcaagcattacaacagaaccagacaggtgctgcgtgggaatttttcagcctatgtttggaagtcattgtgttatttctgccatactcaatgggttaacttagtcacaagctgacccaaattcaaggygaggggacataggcccacttctaaatgggagaggtgtcagaatttataaagaattaaaaaaaaacccacaccttttgttcctagttaccaagaattttaaaaaatcatgaatgaatgttgaaacatataaaatactttttctgactctattcaggtgatcatatgttttttgtcctctattctgtaaatatagtgagttaaattgattgattttgaatggtgaatcaactttgcattcatcaaatattttccatttkttcatggcaagttatgctttttatacattgctagattttatttgctaatatgtatttttaggatttttatatctatatttgggtgatattcttttgtaattttgtcaagttacaggtaatgtcaatgttttaaaattaatagaaaagtgtcctctctttttatattctctggaaggatttgtgtaagattgacaatatttcttaaatgtttgaaataatttaccataaagttaattgagcctgcaggcttccttgtgagaaggctttaaattatgattcaatgtatttaatatagatctattcagagtttacatttcttcttttttcagttttggcaatttttttctcaagaaactcatctgtactttcagaatattttcttactatgttttagtgttcgtaggctctgtagtgatgtcgtctcttttcattcctgatattgataatttatgttatcttttttaccttgataagtcttaccaaggatttgttagttttactaatgttttcaaaattccaactattggctccgttaatgttttctgttgatttttatttcattgattttcctcatggttttatcattttcttcccttgtgttattttgcacctaatgtatggttactttaacaattttttcctagcttcttgacttggaagcattgacaaatgagtttgaacttcttagaatttctaatatatgcactaatactaatgcattttccttggagaacttttatttgcatcccacaggttttaatatgtatgttttcattagcattcggctgaaagtattttgtcatttttattttgaattctctgtgaccataggttttattaaaattatactgtttatttaccaatgtgatcactaatcatgcagtatattatttcaatctttaaaatttgttaagatttactttatagaccaaagtctattttggtgcatttattgtatggacaggaaagaatgtatattctgtaatggttagatgtagtcctctacctatattaacttagtcaagttggtaaatagtgtttttcaaatattaaatttctttactgatttaaaaaaatatttgctttattacttagtcagaaagttatagtaaaatctcaaactatgattctagatttgccagctttttgttctgaaacttttgctttatttattttcttacattatttttatcttcttttcccaatatttcaagcatttatgttttcccagctttattggagcttaactgacaaatgaaagttatatatatttaagatgtacaatgtaatgttttgatattttgatatatgtataacttgtgaaatgattaccacaatgtaactaatatatctatcatacatagttaccattttagtcaatatggtgaaaatatttaagatctactctcagcagttttcaagtgtataatacaatattgttaatgatagtcaccatgctgtacattagatctctagaagctattcattccagagaacataaacgttttascctttgaccaacatttccctattgcccccacctctcagctcctggccaccaccattctactttctgcttctatgagtttaactttttttagatttcacatataagcgagagcatgcagtgtttgtcctcctatgtctggcttatttcactcagcatgtctccctgtttcatccatgttgtcacaaatgacaggatttccttttctttttaaggataaataatatcccatttatgtctgtgtgtgtgtttttgtgtatttatatattgcacwttttctttatccatttacctgttgatgagcacttagattgattccatatcttggctatggtgaatgtatgaatgtattgtgaataatgctgcaatgaacatgaaagtgcagatagctcttccagatatttatttaattttctgtggatatataaccagaagtgagattgctgaatcatgtggtagctctgtgtttaattttttgaggaacctccatattgttttaaatatggctgtaccagtatactttcaacaagggttcccttttctccacatctcatcaatacttgttgtcttttatcttctcgataatggccattctaacaagtatgaggtggcatcttattgtggttttgatttgcatttccatgatgattagtgatgttgagcattttctcatatatttgttgaccatttatatgttttctattsagaaatgtctatttggatcctttgcccatttttaagattgggttagtttgttttgttgatattgagttgagttttttatatatttcagttgtgcttttgtggtcatatccaaaaaaatcactactcagactaatgtcatagggcttttcctgtatgttttcctggattrgttcttcagttttaggccttatgtttaagtctttaattttgagttgactttgtatgtggtgtgggataagggttcagtttcatttttctgcaaatggatatccagttttcttagcaccatttattatagactatcctttacatgttgtatgttcttgccatgtttgtcaaaaatcaattcagcataatatatggacttatttctgggctctctattctgttccataggtctagatatctgtttttaatgccaataccatactgttttgattactacagttttgtaatatattttaaaatcaagtagtgtatttttattttaaatgtatttttaaatcaggatgcctccaggtttcttctttttgctcaagattgctttagctatttggggtcttttgtggtttcatatgaattataggattctttttctattttgtgaaaaataccattggaattctgttagagatggcattgaactgtagactgctttgcatagtatggacattttaacagtattctttcaatttgtgaacaccaaatattttctttttttcattaatstggtatagttttcaaaatacagatatttcactttcttggttaaatacattcctaagtatttaactttttgacactattgtaaatgggattttcttcttaatttcctttttgtacagttagttgttaatgtatagaaatgcaactaattttatatgttgattttatatcctgtaactttactgaattagtttgttcatttattagttctaaaagtattttagtggagtctttagggtattctatgtatgaaagatcatgccatttgcaaacagaccattttacattctaatgggatcatttttcttcagcctgaagaacatattttaatatttctcacagagcatgtctgttgaagacagattccctcagcttttgtttaagaatgcattttttaccttaatttttgaaggatattattacacatagaattttaggttgaccatttcctattagctctctaagaataccacatcagtgtcttgtcacttccataatttttttggggagaggaacctcagcagtaattcttgttgttctcctgaagataatgtgtctttttctccmccctcactgcttttattgtgtgtttatatttaattttccacaacttgattatggcgtatctagatctggttttctctgtgtttgtcctgcttgagagtcactgagagttttgaatctataggttgctttcttttatacaattttgagaaatttcagccaatattttttcaaatattgcattgccacttttttcctctttcttctccttctgagactcaaattacacatatgctgaaggttttgactgtttctaatagttcytatggttttatattcttgccttctttttttgctttgattcyatttggttattttgttttggaaagtctgtaagtactgttgaaatgttcttcaactattttgtcaaccttttcctctaagttttatcataattattttggagtcattgtttggtagcctcagtatctggaatgtttctggctttgctgagattgcctgttttatttattattgggttttggttttttttttactacttcctcacaggcctagtcagtttttattgtgagcaggacattatacgtgatatgttgcaggggttctggattatattatcttcctctcagaagggttgggtttttttctagtaggcacttatgttcctggcagatcactttcattcaatcaaggcttgaatttacaggggacctatttcaaattttccatgaatcctggtggattgccatatttcctagaatatgaatcttactcctgtagcatacttttctcacgtttcaattcagttctcagggttttcataaaagtatctcctttctgactgaatgaggcaacacatcccttcagtatttattatgcagtctctcttcaattcttagcaacttccctcccctccraaactgytctctgttagttagacctgctgtcttctctgtgcatttgcagcttgggaatgagctaaggacccaaggaaatgcctgtacatttttgaggtgccatttccatgcagctgctttccttatagtrtgcagctccaaaaccgccagatgctttggtagccctaaatcrtgagttgtttgtttgccatagcaagggtattgctgtctccttgggcttcacttctttgaattcttgagtgtgtatgggacatactttatatgcttctcttttcagagattacagtcctttgctgtttgttctcaatgcctgaaaatgataaaaactaaaacaaacaaacaataattccttactattatcaatcattaatcattgttcattttttcttaagtgagagcaagtttattaagacagtaaagaaataaaagaatggctactccataagcagagcagtggcatggactgcttgactgagtatacttacagttattttgtgattatttgctaaacaaggagtgaattattcatcagttttctgggtaagaggtgggcaattcctggaactgagggttcctcttctttttagaccatgtggggtaacttcctgatgttaccatggcatttgtaaactgtcatggcactggtaggagtgtcttttagcatgctaatgcactataattagcatatagtgagcagtgaggacgaccagaggtcactttcctcaccatcttggttttggtggtgtttgactgccttctytactgcatcctgttttatcaacaaggtctttgcgacctgtatcttgtgccgacctcctatctcatcccgtgactatgaattccttaaactcctggaaatgcagtctagtaggtctcagccctattttatccagcccctattcaagatggagttgctctggtttgaatgyctatggtttattaccccactcccttttmcaaggggacctttaatcctaagggttgtagagggatgtcagtccattttctgtaactccttcaggatgaataggggtgatgatattcctgcctaactattagggtctcttgtattcagggtagagaggagcttagtcagaaagcgtcagtatggtgagacccgttcataactctgataaaaggtgatatccacagtctgccagttggtgctacagtctgtttcctatgggtcaggggttttctccgtatcgtccctgtggggtttgccaggaagatgttaccagaaaggattcctgatctagaccccaagagagggttcttggacctttcacaagaaagaatatggggtgagtccatacagtaaagtgaaagcaagtttattaagaaagtgaaggaatraagaatggctactccataggcagagcggcccattgttcaaatttatttgtgaaagaaatggattgtttgttctgtagatcatcccacatcttggattttgctgtttatattctacatgccatttgtcatgttgtttgtaaactggtgcttataccaaaaagtttggttaaatccagggggttttatgtggtaaaaaataatcttttcaggagatacatgaaatctgcttttctattatgaagttaacattggtcrgagtgttctgatctcctcaggttgaacttcccattaaaagcctcttttgcactttctctaatggttttagcattctttaggttcagtatttagatgagttattcaytgagacctacaacatgataatagtttgattttattatttcttctttatttatttattatttgaagttctttaatggaatagaagttactcatatcagctatttggttgctctcatacagagatcatgtaggaaaggtaggataaatgcttgattttctctctttttcttttttttaaaaagtattcaaattaataacttggttccttagcattcttcaaaatggtcacttattccattttattttgttttgttttcgatatctgtacatttatatattatatcacatttgatgtgctttaatcaattctaggcatttaaaaatgaaacacttttccgtgttttgtttgttgtgtttgttaataatttgttttcaaaactctggaaaattttccagttagtttctgaacttgttttaaccaaactccagttacctttgaaagctcctttgctttctggtcagaaaagatgttctaggctcttcctgcacattatttacctcaggactgaaaaccctgatttccctaaagagctctgactttttctgtgggaaatggtatttagatctcacaatctgggtgctacggatggctattggtactgggtgtgtcatcgtctctagacctttcagtggacagaattagaaaaaacttttttgttgttttttaaagaaaaaataccctatatattcatagtgatyttacactatattggaatattgagattatagagttgctttttttttttttttttactttacatttctacctcttctctcatacagtaaaaatcctggttcccaatgacatgaacatattatttatgtacttagtcctactgtacatattttcaaaataacaatactaatattattactaatggtatgataactggaaaccatttaagatttctttgttcttttttgtgtatttaaaatatgttttgcttgagcggtatagtcaaattacagtgtttaaggtcccttggaatatttctactctctatggttgtcagctcaatgcaattatttcaccagtttcacttcagttgtgattttaaatatttctttcatttttctcaaattttgctttataattatgtaaaatatatttatagttccaaagccaaatcaatgggcatggtagattatgagaggtctagcttttttttttcctgtcccttccactctgttctttctcccccattagagaacagtttttattagtttttgatttatccttctatttaaaaattaagcaaatgatctcatataattgtattttcctctttcttagataaaagggagcataatatacacactggtctatagttggctttttttcacatcatatatcctggagattactccataatcagagcatagtatgccgctatgtgatgtctcattttctgttcaatcaatactctattgacggacatttggcttgtttccagtcctttggccattttctttttagtcttttgttttttatttttgagacagggtgcgatcgtgtctcacagcarcctcaacctcccaggctcaagtgatcctccttcctcagtctccccagtagctgggactacagacacgcaccaccatacccagctaatttttatttttttattttttgtagcgatggctgcccaggccgttcttaaactgggctcaaatgatattcctgcctcagcctcccaaagtgctgggactacaagcatgagacatcacacccagtcttgtttccaatcttttggaattccaaatgttactgcaacaaaataccttattcacttgtcgtattgtatttttgccaatgtacctttgsgatatctttccaatggtagtattgtttggtcaaaagaaaatgaaatgcataggtttttgctaggtattgctatattctcttatgtagtgatcgtaccatcttgcattctctagcaatgtgtgagaatgtctatgtccccacagcctctccaataatttgttttcaaaactctgcatttttaacattctgaggggtaagaaatggcatctcaattaaggttttatttgctccttctttgtgatgagtgaggttgaacatcctttcatatgtttaagagacatctgaacttttttcagtgcactctattcatgtctctattctttttagaagttctttatattttaggataataactctttgttgcatattgcattttttcttattttgtcattaatcttttcctttgcttatgctattttatgcatttaaaactggtaacttttaaagtattacattgggaaatgcctctttttctgaagaactgagatgttttctcagtaggaacaatgagactcatggaactaatttgtttcattttttactttggcaggaaaatttttatttgaacaacctgtatagctatgtaaatttcatatcttacacatctaaaatgttacctatctcacttatttctaatgtctgtattactacagtctggatttttattatttagtgtttctrtcatttgatttacagtagcatttctcatagaaatctaagccactacagattctttgttaaataaatgtgggtattaatgaagagcaggttcttccagtcactagtcagcaacgttagggggccgatgtggtataatgaggatggtagtggggtcagcatcagaaagcctggctcagtccctcacttgctccattcttggaacagtggctcgatcactacagacatttgaattttttcatttattaaatgaatgttttaactatatgatagtattaagaaaccttctcaaatgaaaattatgtcacacttaaccattttaatatgcaaagtgatctggtttgctgaaacacacagaggttggcagaagttctggaattcyttacaatttcacatacagaaattaatatcatcaaagtgaaaaagatgactctacaatcctggtattcatcgctcagatggttcagccctgtttaaatagtgtcagcatgtgatggctcacaagcacagagcttgacacatgggtgattcatttgtttatcaattgatacttctagacttgtaactttataaaactggaaaatgtaaatcttttttaatttatgagggtgtctaaaactgctcatagttatttaaacaaagtttggcttcttacgccaagggctctgatcattctccataaattatagcatctatacaaatgtaacattatttttccctcttattttagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgaggtaaataattatatttagatagaacatatcacaatatgattaggactcagggcactatggtctagccatgcccatggatgaccccaaaatattagctgtagttaggtgtgtttctcaatagtcagtcaatatctaactcttgcaaagtctctatttttaactgtgcctgtttgttgcttcttcttctgggttccatttgaatctgggaaacagattaccttgccctgctatggtgttacctggaagctcacacccctgccatgagaatgcagaatttatgaaataaacactcagtaatagccatctccttcaatgcagattcaaaccttcagttgtctgtggtaaactggcaaggtctttcacagcttaactgtagcattccacgaagaggccgggtgtggtggctcaagcctgaaatccctgcactttgggaggccaaggtgggcagatcacttgaggttaggagttggagacagcctggccaacatggtgaaaacccatctctattaaaaatacaaaaactagctgggcgaggtggcgggtgcctgtaaccccagctactcgtcagtctgaggcaggagaatcgtttggacccgggaggcggaggttgcagtgagctgagatcgtgccactgcactccagcctgggtgacagagtgaggctctgtctaaaaaaaaaaaaaaaaaaaaaagaaaaagaaaaataatagtgattgtgttgaactgggttaggttcctggaataaagtaatcattattactgagaggagaggtatcagccgaagctccttctgcctacccattagtaaaagattaaaatayggaggaggagaaaaggctcttatattcaaatgccgtttgtacgtaggtgcatcaaaaagtgttgctcttcatttgtagactgacaagataatggagaagattgagttcccaggttgycctgtattttttatcaccataaatctcagccccttgcagcagtgtgaaaaagacaatacgcatttccaagtccattagagaggratagagtcaatgcaattattcataaaggatagaaggatgtggtgtcaaaaaggggctctgcaagtaaaagtcattagtaattcagcaataatggatttgaaacctttgggaatgactggaagatctgtctctctctggaaaatttctgcaaaatggtcatttaaatgttgacagaaaagtgagttatcttgaaattaattttcaataaattccatcaagttaaaattagaggctttaaaaaattcctacacattcatttctggagaccatatggtagaaagtgtcaaccactctgacaatattgaaatgtctctcatttctctttaaactacagtatttcaaagaaccagttaaatattagaataaagttatgctgccatctaactttgatcccagtaagaaaagtaatttgaatagacaaaattgaccatattaaaatattctttagttcattgactcctcggtggtttatatagtatagaatttgcaattacaacaaaattatagagagattgacatgattacatcatagattaaaaaccaacaattagaaaaggatttctaaggtcacgtcattatcattgtagtacttacttactatcaaagttgcatttttaaattcactaacctgtctttctgttgtgtctaatctgatggcacttcctctctacctctgacccttctgaaaacctggaccaagttatgaatcagttggcatcaatggtgttccttcttctgttttctttgcttatattcattttcttctagatcactaagaatttataatgaaaaaaatcaaaagggaaagatctttgattagtaacatcatgacaaaaattcwaactatatgtccagccttggaattgaaatccagtcacaggccaggcgcggtggctcatgcctgtaatcccagcactttgggaggccgagatggtcagatcatgaggtcaagagattgagaccatcctggccaacatggtgaaaccctgtctctactaaaaatacaacaaatagctgggcstggtggcaggtgcctgtagtcccagctacttgggaggctgaggcaggagaattgcttgaacctgggaggtggaggttgcagtcagctgagatcgcaccactgcactccagcctggtgacagagcaagactccatctcaaaaaaaaaaaaaaaaaaattcagacagagagaaggcattggggtgatgggagaaggagacacactttgctgaacctcagccatgagttacatttggatgtgatggggaaacttccttgagcgatcacttttaaatgatagattttatgaagttaatwtccaaagtgacctagtttgttaaaaatctgaccactttgagcttaatgattcatccttttgttttagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttgtaagtaacctaccagttgggggcttaagagggatttgaaggccaatgctatgcttacatctgttttatattttaatgtgattcagaggatgactgactgtcttagaccaagaacatttctttataaatatttctctcatagcttcatattttttctttatcttcccaatgctctattattaatactgcaataccctttgatccctaaattatgggatccacatcatgataaagatgtatgaggcacccaaacttaaataattcagggcaccaggtccctcgtggtgtttgatgtttagttgtgagagaggtttgtgcatgcgagcagtgcagtctctctggattttatcctcggrtcaagtccagctgcacaggggctggggctggcttccagcatcacagtgycccagactctagagcttcacttccagccaaatactattagctgttaggacctcagttgctttgataccttaaaacaaacaaacaacaaaacacaggaaatactctatgatttggatttttttagggaagtggaggattttgtttatgacatctattattgtgcccttaataaatgttctcagaaaaagtaccttttaagtttcaatatcaggaagagtaacaaagaacatctttacttgtcccctttcttcatttccttttctttccacggaatctgstgccaacctcctgttcccctttcaattgttttccrtgcaaatcaactccccctggctacatcttgctattctgtattcattttttctttaatctgcttcatgtatacagttatgtagtttattttgttacatgtttttaataaccatctcaaatcttattgaaatgaagcagagcattaatgtatttaaaaagcaacttatagaagagaatggcagattggaagctagatcacacatctctgcatctatttctttaagccactacagagatgtcccacaacacatcaaactgaaaatcttaaaattagaggcacaagcctatagagggtgaataaaatggatatgtgcttgtgtgtgtgtgtgtgtgggtaaatttttagaaattggatccaatgcctgcaagccagagcaatgccattgccatgacctgttcgtctcttccctgttcttagcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggtaactttcactactcaatcgcccttagatgacattcatcaacatttttatattctgcagagtggtggtcttcaaaagattgttgggccaccagcagccagaatacctgagagcttgttagaaatacaataataactaagctctaatgactaaggtgcaggcaaataaggctgataggatgtactaataagatacagatttattatctagaataattaatacaggaaagaactcaacccagggaagtgaagggatttgcccagatgacccagctagtcaagtggtaataaagtttaagtgttgaatgacccttgttttggaggttagggtttttccttcctttattctgcttgctctcctccagaaatctttaattttgatttaagtgtgggtaatgattgtaatacagggaatatttgaaacagagacaggctgtttttgtttgctgggcctggtatttcttatgctaaattattggtcaagccacaaattaaagtgttgagcaagataaaacattgtttttttgggcataatcattttacataaactagagaagaatttacaattttgtttgtttgtgcaagttaaatccatttattcatccaggaaaaacctatgtgacctcctgtcctcttctttctacatttagacagaggaaacagaactttagcataagatctagctagacttagttgaagtgcattgaccatagcactacagcagtatgtatgtatgtatgtatgtatgtatgtatgtatgtatgtatgtatttatttattttgagacggagtttcgctcttgttgcccaggctagagtacaatgtcatgatctcagctcaccacaacctctgcctcctgagttcaagcaattcttctgcctcagcctcctgagtagctgggattacaggcatgtgccaccacgcccggctaattttgcatttttagtagagatgagatttctccatgatgggcaggctggtctcaaactcccaacctcaggtgatcctccggcctcagcctcccaaagtgctgggattacaggcatgagctactgcaaccggcctgcattttttttaatccagaaatttttatttaagatcatttcagaatgggtatatttattcaatttaggttttctaaagtctcttataaagtatattaaagttttacactacggaagaatttcaaatatttttatgtaaatcaaaattaaattattaacccttttttttttaacttttgagaacagcaaaaatagctttcaattagagagtgcttcctgtactccaggcactattataagactttaaaatagtataacaaattaaatagataatgatcattgtcagcttactgcctgccatgtgtggtaagtgcttttcgtgagttatttcattgaatcctctcaacaaccattattatttctgttttaatcttaggaaactgtagcccagagaagttacttgtccatggttacatgtctagcaagtaatggagctgggattcaaatttaggagatctagttatacttatcttcagtaagaacagaaatgcaattgtgtgacgttgactacaagaggtgtctcatcttccatagggaggaaggtcttgtgaattacccaattccatacctggctctccgatcacgagactaaaacatgaagccgagcatcatgattttctcagatacgcaagaatgtaactataattttcagggaaatttggggccctttctgttaaagccttcatggtgattctctggttctaaagaactatcagtacctctgaatggttcatcctctcaggctttgcagaacactagaactgaatttcagtgagcggttccatgaactcctctgaattcttctgaaaagttygcacaaaaaatcataaaactggctttggaagttttaatttcataaaccagaatggtggaatgttttgtagccagaaggggattaaagttagttcacctaacttcttattttagttcatttgtcagatgaccgtataaccttggacaattctttatctggatctttcagttcctacttcagtaagatgtcctatctatttctctaaactttgggggtagaatcaaggaaataaatgataaaaagaagcttgaagtgttaaaaaaaataatgcaaatgcaaggtttttctggaacaaagttttaactctagccttgaatttatcagttcagagacagccgatgtggctgtcacagttggccagcgaggtatctacattctgatgtaaccacatatcctcaaagtcttgaccaaatttccctcaaggattgttgatggaaaaaaaaaactgtattattcagaaggagaggtcatgtacggtgatttaaatattaatagatagatttttatattatatctttgaccaaccaacctaaaggaatacaaccaacctgtagaattttggcatcagcaaggaccttaattttacaaatgagaaaattgaggctcacaaaggtcaaactctagttattgtcaaagtaaaacttagatgtacctctatgagattctagatggacgtacattgactttggttaaagctcttgtctttaaatcatctctatccattgggaaaatttgtgaactgaacccgttttctaaaaagtatattcacttctcttgttgttcttcagatagtggtcatacaagaaagtgatacaggaaccaaattctaatracattattatgactcaatatattgttccctaaaatgatgtcttcattttttaaagctatctctaaaaaatgaaatatttatgaaaaagaattaaaaaaagaatgttggtatttcgaatactttggtggtttagaggggggttgactttgtcctttactgactccattgatgagtaaaagcagtccacccaaaattttagaaagagtggagaagagaaaagaaattcyacagagatgtgggagaatgatcctaaggacatttactttgcatgtgaataggtgtacttttaagaatcctagatcttctctttgtgtggttttaggtgccttggttgccaggcaaacatatccttcaaatgaagattaaggtaccattgctgagtgtgtatctttcacagatactgtggttttgaaagacttacttttgctcagtaagagagttccataagcactcattaaagaatagattttaactgcaaaagataagaatgatattgacccagtgtagcatatctttctttttttttaacacaagkaacacacattaacatgttaattcttagatttatatatctctcttaagtgaagtttctacttttaaagatatacattacccatggaagatgtgacatggctacaaatgaatgaatacaagaacagatcaattgttagttcatctgtttttgtcgaagagagcttttaaattgtatagaatagttcaatgaaggtgatggaagcatctttccagaataaaaagcagcacctctcattaatatttcataagtgatttaagccatcagaactctgagtgaaggacacataggtagtaatgaaagtttaattttaaatcccagagaagggaagttgtaggctgaataataaattcagaaggctatacgatgttaaggtgaaggcttgaggtaggatacgaagggaaatgagtagaattgttcacccatcaaatctccttgaccaatcccaaagtatctgcctcctctccccagagacactgaggaaccagaaagggggctctacaagagacgcagggagagcgatgtgccttctggagaaagagaagggctttcgagaagttgttgtttcttagatgtggaaagcaaatacaaacagaaaagttgaaaaatataatcaataagacaggaaggagtaatttacattgaattttatttctgaaatctagggaatatacctgttctacaagtggcgttgaaccctaattcatcatattttagacctctatggcaatcccagtaaattaacaaagcagaaattgtacatctcttcacaatataacataacccaagattatttataaacattttaaaatgcccaagtgtgtggaagtatgtgaactctccaaaataatcattggcttgagaaagaaataaaaaatgaaagactacatagaaaatgacaaacaggaaatgctgtgtatcaaaacctgtgagatgtgatgaaactcaactccctggtaaaatctttaagatttaaaagaagagaaccaaaataattgggaaagcaggagagcagaagctgaggcaggaaggtctgtcctcygtctgaaccttttctttcaccaccttcccctgcatccttccctctacttctccctccccgctacactcctgcttcagcctaagcagccctcccrcatctcctgcatgtctttagatgaatgcaaattcacaaaggacctccttttgtgacttcttaggcattgagatgattccactatgagcttgggattgggtgggggagagccaggacttgtggaatgcatgaggcacttgcttccctcaagtggacctgctgctcagagtctcatggctgcaattcacagactacacacctaaatgtcagaaamagaataaggcctggagcaagcaaacacaccacataggctgaatagtattgtgtttttcagttaagtacatattgaaattaattgtaggtcagaaaaatatctttctagagagggtaggataaagggaaaagggggagatcctcaagagtttgtactcttggccaggcatggtggctcatgcctgtaactccagcactttgggaggctgaggtgggtggatcacctgaggtcaggagtttgagaccagcctggccaacgtggtgtgaaaccccatctctactaaaaatacaaaaaagtagccaagtgtgatggtgggcacctgtaatcccagctacttgggaggctgaggcaggagaatcacttgaatccaagaggtggaggttgcagtgagctgaaatcacgccactatactccagcttgggtgacagagtgagactccatctaaaaaaaaaaaaaaaaaaaagagtttgcattcttgagcatattggatttagggttttgacagagactaggaacatttggttagactctgagctctgttgttgtgagcacagtttttccacaactgctggaccatcgtgatgctttttagtgaaggaagaagataggccattcctctagtgaaataattctgtaggttggagtagtgggaggcaggaaacagactgagagatgatagaacacctaatttggagttgtgagaacttgtagagaatacatttttgctgtgtttgaaggagttgcatgctcatgtagaagctgcaaacccattgaacatgcgtgatgtagagcagtaagcaggaataagaggatatggatggaccattatcaagaacattacaaattcctaggtcaaatagagggtatggctggtacttttctgatataaaatggaaacaatattgcatggaaacatgataaaacccttcagctctctgtgttactaaaggcaagatacctgtaagccacagcttcctcatgtgtaatagggatagtactagtagtactagtagaaagagaccattcattcatttatctattcattctctaaatatttatcaaaccacttaggtttcagtcaccatgctagggaatgggtatgtaatatagatattaaataagtaagcacacactacataatttcaagaggagataagtatgggcaggaaagaaacagtactgtaagagaaaagaacagagctactgacttcagtggagcagtctgagtttgcttctcaagggtctttgtatggctagctcattctcatctgtagaccctgtatgtaggatctgcagatgaggagtgagcaatgcaaagaactgagagaaggaggactccaggtagtggtgctaacccagccctagagactgaagtcagaaaaaataaactaaaataattggaaatagaccagggtggctggaatcacacagggatggaaaagagaaatatgagttaggcaggagctagaccctgaagggtcttgtagaccgagataaagagcctgggttatattctatatgcaaggacaaacaattagaatgttccttgtcacattgtgcctgtcacacaatgaatgctcactaaagttaacatcatgatgataatgacgatgatgatgatgatgatggggaggagaagagagggcaggagaaggtgacctactggagtttgcaatcatgagggaaggcacttctaggtaaaacttattcatgtgttcttgattttagaatatcagatcttaaaagatcagattatatttattaatagagatgttagaagggacactttcacaaggcatgaaaaggtttaaaataccaactctaaaaatcatgaaacatactaataaagaacaaaggataataaccaaagtaaatgattttgagatcctaaatggcttctctcatctcttatcctcctcaccccttattctctcactgggggcagggcctcattcctctcctgctcacccagattagcccaaggctcctccctaaggtccagtctttacttagctaagatgtatgtcagcctgaagctcacttcacagaaagccacatgttaaacactaccatacggtgtggttctcttttcagctctcagatggactaagcgtaagtgccagcatatttgaattgctttgaattaaaatttaatgcttattattttagaaattatagtataaaaccaaatctggattcatagcagaggaagacaaatgagcgtgcrtattaagacatggctttgggacttgactcattccagatgttaaagctcacgactcactaggctcaaaagcccacatttaaaatttcatgtaaatggtgtttctcagcaaagtaaattttagttctctctatagaaaatcattcctttacaaaaactcgtttttttttatgagtagtttctcttctggaactagtttaatctgatgaatgtaaaaattggaagccatttggaatacaccatatgctgaacatcctgggacctgaaaccttcagtgtttcctggacgaataaggcaatccacaagaaatctgaacctggtccgtgaaacactagaattttgaattggttcttgttgtttccttgcaaatgcgattcactaaaaagaatgaattcactgtgactcctctgcaagtgatcacggcatggcttcacctgacttagaaaaattcagtttttctgcacaaaccagactcagatattggtcatctttctctaggttatgctgcaataacaaacaattagtagcaacaaccagaaaaatcaaaaacaataacaaaccaaaagcgtctgtggctttcaataacgtgtttattctttgctcacaatagcaggttagttttggatccattgcagttctgtttcctatgtcagtttcctgtgccttcaccgtcctgagacccaggctctagagcttgctgggggaaaagtaaaagatggttgaattatgcagtgacttccaaagcttctatgtggaaattggtktatcacttttgctcacactctgttgggcaaagcaagtcctatggctaagcccatagtcaatgggaagattatgtattaattctccgtatggcagtattgcaagtcacatggcaaaaagcatagatagtcaatccttttacaggaagggaagtgaataactatgtaaaataatgccatccatcccagttcatgagcataaaggaaagaggtttttttttttttttttggtgggggtgcaaatttatcaagtcctagattattgaacgcaatacatgcttcagaggtagctagggtcactttagaacatttgatgaattttattctagtgtctctttcaaaggagttgtagttaaagtattgccatgtctagaatccagggagaatacaggctttcagaattaataaggtttcatttccacagagagagagagaaacagagccaaaatcaattgcaccttctaggttcagggcccttgagccctatgagttcctcttaaaacatttggactacagctgcctttctccttgttaaaatccttgaatttcattagttggggcccaggggaatggcccactttagcttgcagtgatgctatttggctgttttttttccttcttgtcatcttctaatgggcgaaatagaaaagagagactacaatcttcgaagaagcaaatagaaccctggaggattagagagcaggaagataactttgtgtttcatgctttctagttttcaagaactgcagtatgtctgtatctctaacaaaaactgaaccatcatactgtaccttaaaattaatgaatcaacaagaatttgtcaaatacctatttgcaaagttttttttattagatgctgaagggcaaacagaaatttttcccttccctcagagacttactgtttggttagagataaatttagcatagctttactacaatatgtgaaatttgtgttacagatgttgtaagagctcagagaaaggaactagtatgagcctgagtcagtggagaggcatgtgatttttcatgtctgtgtcagactctatcatatggctgaatcattatttatttaatcacctcactattattaggcctttagaatggtttcaattattgttattatagagcagactttgatgtggatctgtatatgtcttttcctgcatcttgaatatccttgtgatacagtgttagaagtgaaatacccttaatacatattgtcagtttattttccagaactttatacttccaccagttatggatgagagtaactgtcgccacatccctaccaactttgaatatcatccttttaaaatctttcctttactggctaggcacggtggttcacatctgtaatcccagcactttaggaggccaaggcaggcagatcacctcaggtcaagagttcaagaccagcctggccaacatagtgaaaccccatctctactaaaaatacaaaaattagctgggcgtggtggcgtgcccttgcagtctcagctatttgggaggctgaggcaggagaattgcttgaatctgggaggcggaggttgcagtgatccgagatcgtgccactgcactccagcctaggtgacagagtgagacttcatctcaaaaaaaaaaaaaaaaaaaaaaaaaaaagaaaacaaagaaaaatcttctctttactacctgtttgccttggcctagataactcctactcagctttcaagtctccgcttaaatgttatttccactgagttttccataatcccctgggtgagttcagagtctttggttaacccagtggttctctacaatttaagactttttaatatcactccttgattattcagaaatgaaatacactgatttaaccccactagacacattatatttaaaaatatgtaaagttgtaagaataacattaagaaaaaatagagtaacagaataaaatcacatttatttcagtatctgaaaacctaggcaagctgtacttgaagacaaaataaagcagttgattgtctggaccccaaattgctatgaatatgacagtacaaatgcaggctgacacagttatgtgggttggtgactaatttttcagaaatagtgactaactcttgacagatttccaggagaaagaatcttcaatttacactctacttgtaatcctggaaaattcagtatgcattaaaattgcacaaaactactttgcgcttaatatgtaaaatagagcgagattttatacccaataacagaactttcacttatgtgaatgtcacacaggttcaggagaattcttgttgtgtgtgacgctcacatttcaggctgcctcgtgtctttggtcccttgctacttactaaatgccagtaatgccccatgattgctgtgataataattaacacaaaaccaaaaaggtactctcacacatttcccaaatgctagattgtggtccctgctgagaaccaytggttaggtaacaatgaagtatcctgcgcttccccaaaaaccgcagtcatcatacttttcaaaaatgttcctgcctattgtaagttccttgtgagcagtgactgtttcatggtattgtcacctgcacagttcctggcatttattcatgccttgataatgttaatgaagtgaatgaattaatatttggatgtctgtatccttcagaataattgtactgaacagcggcggtatatatatccatcgaataattcctgctcatagtagcaagcctccagtgtttcacctccaaaaatgtccagaataacaacagctatccttagtcaacattttccattaccaaacatttggctaaggaattcacactattgtttcatctgtttgcttcaacaatcccatgagcttagatagagtaacttgctcaaggctattaagtgaggtggtttgtaagtgacagaggtaggttttgaacccaagtccatagactgtattcatggccactatactataagagctggctatttggccgggcgcagtggctcacgcgtgtaatcccagcactttgggagtccgaggtgggtggatcacctgagattgggagtttgagaccagcctgaccaacataaagaaaccccgtctctactaaaaatacaaaactagctgggcgtggtggcacatgcctgtaatcccagctacttgggaggctgaggcaggagaatcacttgaacccaggaggcagaggttgcggtgaactgagatcacgccattgcactccagcctgggtgacaagagcgaaactccatctcaaaaaaaaaaaaaaaaaagagctggttattgatttaaaatcagtagtctattatatgaaggaaattccttttttttctaataaaacaggaatgctaacaatgttttttgaatttatggagttatcatatggcttatcttatctgatgtactgaggaagttaatttatagtttataatttctaacctttcttgcactattattattcccatatttgatctggtatataagctggcaatggactgtgaatttatttttctagaactgtgtttaggatttgtgtatctatattrataggtgacatcagtctatagtttttatttctataatctatgttgggatttggtaacagcgttctaacaaaaattatttggaaattattctatgtttgaggatggcttagaataaattatacatgggaattatctcttccttaaaagttttaaagaatgtactaagtagagcatcttatgggagatttttctttttgggggttgagggtgggatgggaataattatttgataatgttttcaattttatttatgacttatgtctgttcaaatcttatttttcttctccttcagataattttaatgttatactttttctgaaaataacccattaaaaacattcatagagttgtacatagatttcacgtttaaaaaaatcttagtatctgtgtctttgtcattttcaattttgtatatttgtgcttatatatttattttctttttagacttgccagagatttgtcttttatatccccacccataaccttcctcaaaaaaacagttcttgaatgtatttatgaataccacatgattttgtatttcatttattaagttttgctcttctttttactgtattcttcctcattttaaggatttttttctaacttaaaaaaattgtacatagagctgggtctcactgtgttgcctaggctgtctccaattcctctcaccttggcctcccaaggtgctcagataataggtgtgtgccactgtccctggccttctttctaagtttttaagttgactccttacattcttttactttctctctctttcatcaacttttcttttttttccttttttctttcaatggcaaaagtagtttagtccataactttctttgattgcagatttggctaacacgtgtattttttcataggtaatattctcattttttattgttttccaagtagtctaaattgtgaatttatttcctctttgacattgtgaaaattattaggagaacattctttaaattcttgtgcttttggactttattggcttaggattttatcagcatttcatgttattgcattgtgcttaaaaatgacctactgctttagaaaataatagaaatatgtaactcaaattggattatcattcattttgaatctgccattttttcatctccaagtaacgccaccattgccgacgtaagtttctttatttgaattacatctctattttatttttctctttaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcggtaaggaaacatataatttttaaatgtctaatttgcctgattgtaatattttaattcttcaaaataatttagtcattttatgtcctcaagtgttaagtggaaaatattctcatagaaatgttatattcggttatctcctcaggcagtattagattttgcaataaaattgrgataaaattattaatatctggacaagcactactataatttttatgcttacagcttgcggggatgaattaactggagaaggggtcattcgctcrcctttttttcctaacgtgtatcctggagaaagaacctgtaggtggaccatccaccagccccaaagccaagtcattctcctcaacttcactgtctttgaaattggaagttctgcccactgtgaaacagattatgttgaggtaagagggaaaaaatctttgaatttgtatttggttgtatattataaaaaatattatgggttgttgtcttcaaatctgttataggaaatgaaagtagtttatgtagaccaatatgtcttatggatacatatgtaaaaatcctcagcaaaatactggttcagtgaatctagcacaaaaagaggatttatataccatgattaagtgagatttgtcccgagaattctaggttgatataaaaccccagaatcagttaatgtgatacatggtaccaataaaataaagaacaaaaactccatgatcacctcaatagatgtgagatctggattttgctggatttgacaaaattcaacatcctttcatgatgaaacactcaacaaactaggagtagaaggaaccttccttaatctcataatggacattcatttaaaaactcacatctaacatcatatttaattatgaaacactaaatgctttgcccctatggtcacaaaaagacaagaacgtctgttctcactacttctattcagcattacactggaaattctagctagagcaattaagtaaggagaagagataaaatgcatccagaatgaaagggaacgagtaaaattctctctattcacagataacatgaccttgtatataggaaatcataaggaatccacacacataaaaaactattagaactaatccattcagcaagttgtgggttatgagatcaaaatatagaaatctttctttttctatacaccagcaatgaacaatttgaaaatgaaatcaaggaaacaattccatttacaatagcattaaaaaataataaacatgaaggaatacagttttaaaaataagtgtaaaacttgtcctctgagactataaaacgtccttgaaagaaatttaaaaagacctaaataaatggaaagacatttaatgttcatggattagaagacaatattgttaagatggcaatactccctaaagtgagctaaagattcaattcaatccccatamaaatcacagcrggctcttttaaaaaaatacataagctgatcgtaaaattcatatgaatatgcaagggaaccagaataaccaaaatgttcttgaaaaattacaaagttgaaggactcacacttcctgatttcaaaacttagaacaaagctacaataatcaagacagtatcttattgaagtaaggatataaatatagatctatggaayacaattgcaagtccagaagtgaacacatacttttatggccaattgatatatgaaaatgatgccaaaacatatcaatggagaaaaatcattttttcaacaaatggtgctcaatagccacatgcaaaaytatggtgctggaccccttccttatagcatacacaaaaattaactaaaaatggattatagacctaaatgtcagagctaaaaccatgaaactcttaggagaaacctaggagtagtctctatgcccttcagtttaggcaaagccttcttaaatatgacacaaaaagtacaaacaaaaaaagaaaaaagaaaaataacttcctcaaaattaaaaacgaataacttgatttttaaaatgggcaaaggaggctgagcacagtggctcacacctcatcccagcactttaagaggtcaaggtggatgaattacttgagctcaggagttcgagaccagcctgggcaacatagtgagaccccatctctacaaaaaattttaaaaatagctgagtgtggtaatacacgcctgtagcctcagctactcagaaggctgtggtaggaggatcacttgagcctgggaggtagaggctgcagtgagctatgattgtgccattgcaccctagcctgggtaacagagtgagaccctgtatcaaaaaaaagaaatgccaaaaacaaaaggacacacccataggatagctataataaaaagagtcagataatggtgtggacaaggatgtggagaaattggaacctttatacactcctggtggagatgtaaamtggtacagccaccttgaaaaacagttggcagttcctcaaaaagttaaacatagagatactatctgatccagcaattctacttttagatatattctcaaggggaatgaaaatatatgtccacacaaaaatttgtatgtgaatatatctacagtcatcatctataataacatatacaaatagcaaaatgcaatcattatttttaattttaaaagtagaaacaacttaagtgtccatcaactggtaaacggataaataaaatgtggtatatctttacagtggaatattacaaggcattaaaaaagaatgaaataatgatccatgctacaacgtggatgaactttgaaaatgttatacagtgtgaaagaagctaatcacaaaagaccccatattgtataatcccattttgtttgaaatgtccaaaatgggcaatctacagagacagaaagtagattagtggctgcctggggctgtggtttcaggggaatgaggagtgactgctaaaggatatgagtgttttttggggggtgactaaaatgtgctaaaattgattgtattctcaaattgatttgtactccattaaaaacatttcagaaataattattcttgaagcagttttcaaaattgatatacaacatatttgaacatatcttctctaattttagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttgggtaagagaytgttcccttttttttttcctcctcttgggcttgtatcagaataagtgaatgatagaaataaattatatgaaaatcatctgtactgtgaaaaattttaaagtacactcaaagacaaagaatrtatattttctaatcaacatttatatcaaaagttaattgttacttattaataagagaaaaatcaggttatcttaagtggcaactaagaaacatttttccttttaatctttgaagaggttattatcagagccttttaatttgaaatccaggtagcttggttacttgctgcagtaattawaatttttatttcaacagcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaaggtaaggttatgtttgtttgtttgtttaacaataaaacttcactgatttcctgcttcagtgaaggatcttaaaattgaccacgttgtgttatgaaaaccaggtgagatcctcatgcttcttaatgaccatttctacataactactctgtagttgtggcctgtaggcattaagttttgacatctgtatatattcatgaagtcaaaaccaaaattaaaataatgcatatatccactacccacaaaactttcttcctttccgttataattccttgcttttgttcctcacccccacccacaggaaaccacaaatctactttctatctctgtagattygtttgcatatcatctaaatggaatcatactatacgtactgaatgtttttctgactttcctcaattagcataatttttgttgagcttcttggatccgaagatttgtagttttatcaaattgaaacattcttggccactggttcttaaaatatttttctgtctttcctccccattagggactctgatttcatgtatattaggcacttgaaattgttctacaactctcttgatagtctgtttgatttcaagcctctgttctctgtgtgttttactttggaaagttcctattactatatattcaagttcactcatcttttcttatgcaatgtctaatctgctattaactttaccaagtgtatttttcatcttagatattgtagttttcattttagaagttcaatttgagtcattttatatgtagtccatgtctctactttacacatgaattttttttctctagcttaaaaaatctgtgagatatagttgtagctattttaatgactttatctactaattcagacatttggattgtttcctgctatggttttatagattgatttttcctctctttctgagttatactttcccacgtcttttcatgtctgggtaatattcagtgggataccagacattttcaattttatgtttttggctgctggacattgtcatattcctgtaagtattcatgagcgttgttctggaaagcagttaagctacttggaaacaggttgatccatttcagttttgcctttaaactcatttgtttcctgtctctgaaggtttgttgtcctacattgcttgatatccagtgttttgagagccattgttttatacgtttttgtccaggatttttgttgtttcaggtgcaaagttaaatctagcctgttattacatttctgttggaaatggaaatcttttgatattttaaaatgtctttatcttgcattttattttctttatttctcattcatgttttaaatatccttcttatcctaatctttcatctttttaactttcttctttttcttttttgggaaggtacttaacacatcaccactgcaaaatacagaacgtttgctgaatggcataaactataatgatcttccccaaatttcatatacatgggcatatacgaaggcatttaaaatatcaattagttcacctacctttattttgatgaagatattaaattttttttcacactgcaatggtattatacaccaaattttctttctttttctcctttagcaattgacgtatccatttcccgtactcaacatttcctctctttttggtttctatatttgttttctttatcatttcttttggttaattttaccaagtgtgctttgatttgagattcctattttattgtcacttcttcctacaggtatttctccagataaaagctcatggcattctgtcttttatcacaactctctttttaacattaatagaatagtttttctgagctaaactgcttttgttcagcagaaacatggcatggctgaatcatcactcttatctctttataagtgagctgtttaaggacaatagattccctctataggggttacgattgtaggcactgttctaagtgctttatatacagggtattaactcatcacattctcaaaacaactctatgaagtaggtactgtcatcattcccattttagggatgaggaaggcaaggcacagggattgagtgatctatgagtttagattagagagatgactctatgattttatgatatattgtttccctttgttgtataagtttattacatttctattaaaaagtgtattaatatgctatatggcaatctagtgtagcttttattaaacttctcatacatgacaactcacatagccagtcacatacctaaaaccatttcagggatataatcatgaacgggacaatctttcgtaagtttgcaaatcttttttgcctgaaatatatttgtgttttaaggttgatgagaggtagagaacaaaacctattattatatttacatgtccaaatttttgttacatcattttcagtataccaaactaaaatacacacatctgtcctttcttggtttggaatagatactgtggaaagtcgatcccgccatctctcacaagcagtggtaactcattgatgctggtgtttgtgactgactccgacctcgcyyatgaaggcttcttaataaactatgaagcaatcagtgcagcaacaggtaacaaaacagcattgcatactcggttttattgactccattgcaaaacagtgctaatagctaaaacacaatgagaatacatcatccgcaaacctgtggcacacaatgagagctatatttagaataaagggtagtgacttaaataccttccttattaaaagtagtgactagataagaatattgtgtcaatattaaatcttctaatgttggtaattgtactgtggttttgttaaaagaacgttttttcttcccttaggaacaatacactgaagttttcagacggtaaagaaatataatgtctccaaagtactctgaattggctgagataataagtgtgaatatttgtgtgtctgtgcatgtgtgtgtgkggggggkggagagagagagagaaatgataaagtaatgggagcagaatacaaatacataataaatctgggtaaaaagaattcaggagctcattcttgcatcttttaaaattctatcagaatgaaaagttaccaaagagactgaatacttatgttaagaaattagaaacagaataacaatgtataaaaattagagactaccgcatgaaattccagggaaaggaatggaagatttcttggcaaaatatgcatttctcaatttgacctaatgaagttaaacttttcagcatttattcctttcattgtatttttcctattacttaatttctcattattactatgccctttgcaaatgaagtataggaaacaaatcccttttgcaggcacagtctttgaggtaagatgtgaaccagagatgctcccagccccaagagcctgtgcatgggattgatgaaggagtcatatttcgttaggctcatgtttccctaggatgtgttgttttttagagactctgagctttccttttgcatcattgtattaaaggacccaaataacatccagcatagacccatagtaggcatatggtgaccatgcttccaagcatttctccgctttgggattaccccagcagcatggtacaattcactgagctccctccagaaagaactggtagcttttcctatgttgggacatgcaccctgtgacacactctggcatcctgagaaccccagatgcttatcttttaaagtccccactccctaaaataaataaaagtttaaacatctcccactcaaaatcttacccaatttcccatttatttctccttcagaggggctggccactactcttcatttcaggcaaaactctgcagcagttcaagttctatgttcaaaagcatggctttagatttgctccagaatcctgagtgtgagagaatcaatcaatacttttctcccaggtaggaacctctgcaggagcagttcattatccagctcaagtgcaagcacatgcgaaatggaatccctggcagttacaataggctatggtgtgtgattgacgtattcactggacttcattcaggtggttaacatccagtgaccaaaattggtttcttaagaaattatagggtgcacacaatttttcatgctgttgtagttttatctgtctggtatgtttggccccaaagcacactgaatattagatcaggatttggagcaagtcacttgaactctctaggccacagttttctcatctgtaaaattaaggaattggatttggtaatcttcgagagatgacttctggctttaatcatctatgaacataattttaatttggtgcatgaataaactggctgtatcttagataacatataatacaggcagggcctcctgaaaatgtggaaatctttgtaatgatatgcaaagtaagacatacctttgtaaaacaattctattaccatcctagcttgtaagrcaatattttgtgcagaaagaacccagagcagttaaaataattgggcagggaggwtattagattttaattctaaaagttttcagaaagataagatacacgtaaaataaaaatgagtcaggaaaagagatagaagcaaactggacaggaaaggaaactataaagaaagagagaagaaaaagcaagcaataaaagtgaaggggagacgatgttttcatagaaactcaaaagattctccagctggcttccctgtgtgataatcattactttggcctctatttggtctgcataaggctgaaatcacagacgagggagtgtttgctttctgtccctgggctgagcccggctggtcactgtgcccgcttgttgttggatgaactcataggtctgactaacacagtcaagccattctaaatagcaatcagatgacgagatccaggaagacacaacacaccttctgtttataattctggagcctgtcacagtttcccatagatcaagacctgagagatcggctctcatgcattgctgagggggggtcctgcagcattttttagggaagggctggtgtcaggagactgagctggtgttgggctggtgacaccaggtggtgggctagtactttaaggcagtggctagacctagaaggcagccagagtcagagtgagctgctggtgtggaaacacagagatgctaggactcattcttttcaggtgtcatcgtatgttggatattttctgcagaataaaatagcatcagggaaaagcatcaagggaagctcagtcatttgccctcatcttactttattgttctaacagaagttatttccagagcagtaatgttggtatttggttgttgatttctagctcctcagcccaacaggtgtgagtttgcctgctgaagtctttcttgtcttcatctgataaaggttaagtttccggatttgagttcagatacttttccatctgtagtttgtgccatgtggctatgatgtcagccccaaaatatgtgtttgggagaaaaaagattggtttcttgtgattactgggacttcctcccttgttactttgtttctgcctttatccagatgtgcctgggaaaacagaaagaaaagaactaacaagtacaggtttaacaggttaaaactcttacgaagttcttagaaactacaagactaagctttaatttaacgtattagattttgctcattcaaactacaaaatatttgaatcctgagagactataattgactaatgttatcaatttaaagtaaaattttatattctattaacatgtattgcatatacattaatatataatcctgctaagagggaactttaaaagtataaacagggacagataaatgtaccggattcattttcaactttaatattagaggaaaacctatgtaacatctagtccagtgcttttcaaactgcaattcatgactcattcgtgagtcatgaaattaatttattcggttgctacttgtgattgttaaaagtatggagtaggatagaaaggaataggagagaaagtatcagagtttatcatacaaagtaaggtgccgcttcatgagaactgtttgtagtatctccgcgcatgggtggctaacgtaaatgtattttttagggtatgtcaagaaagtttgaagcacaaatctattccagttaccttaatttttaaatgagggagatagaagtctaggatgttgaatttatcctcccaagaatacatagctgattggtttgaaagtcagactaaacaactgagtcccgtcttagaatccattgcttttgccatgtctaggttagctcttagaaacgctctaaatgaactgcatataacagctagtaacatttaattcagggctatcatcaaactgtggtggatttttcatatttcctgcaaagcgaaaaccttcacaattgtccagggaaatggccaaggatgatcccaacaacaacaacacaggattagagatgagccctactgggctttcttggcctccctccttcccagggcagggttcccacctactcatcagtgggtggttagtgctgttttttatcagtgatcctggaatgagctcagaagaggcatctagcagtgcaaagttaagaaatgatgacaaacatgcccaaagaggccttctttacactaaacgggtaaagagagttctgtttctattttaaaacttcagtttgggagtgtagtgttctcaaattctagtgttcataaggaatttgagatgggggattttcttgctataaattcaggcatctgggccccacccagaaattctgattaaaataggtctagggtgcttgttcgccaagcaattcaaggggttctaatgaaactttgtagtttatcaaggactctgaaagtcaagccttagcatgtgaattgctgtagaattacaagggagatacaatagtggattggactgtaactgctcatgatggaaagtactattcatgacacagggaaaggggatgctgtagggaggtcagaagtcttggtcctactctcagccttgatactaattaggaatacttttgtttgtttgtttttgggttttttttgttgttgtttttgttgtttgttggtttgttttttgagatggagtttyactcttgttgcccaggctggagtgcaatggcaatatctcagctcactgcaacctctgcctcctaggttcaagtgattctcctgcctcagcctcccaagtagctgggattacaggcatggtcaccatgcctggctaattttgtatttttagtagagacagggtttcaccgtgttggtcaggctggtcctgaactcctgacctcaggtgatcccccygcctcagcctcccaaagtgctgttattacaggcatgagccaccgcacccagccataatttggaatactttggacaactcacaagcctctctgattatttctatcgaccttgaattctgtattctttgctatgagagattcagatattttccctctggaaaaggtgttgtagtaagtcgattcgtcttttaaagatttactttcttactggctagtgttttctcataattttgtatgtacaggtgtcccagcacttctctgctcagttcrtttatcttgtttgttatatttcttactccttagaataaaaatgcaacaaaatgcttaatcatgatattctgagttccctacttgtcttcatccttaaattgacatttcctgtgtagaaaaaccagggattgtggccaggcagggtggcttatgcctgtaatcccagcactttgggaggctgaggcagtcggatcacctgagatcgggagttcgagaccagcctgaccaacatggagaaacccagtttctactaaaaatacaaaattagccaggcgtggtggctcatgcctgtaatcccagccacttgggaggctgaggcaggagaattgcttgaacctgggaggcggaggttgcggtgagagaaaatcgcaccactgcactccagcctgggcaacaagagcgaaactccatgaaaaaaaaaagaaaaagaaaagaaaaaccagggattgttaaagagaataggatttggaaagagggaacttgggttcatattttatcttggccatgtctgaagttaagtgtcttttagaatttaatctccaggaacctgagatctctcatctacacctctctaaaaagtgtggtgataatgcctggctgttttgcaaagttgaggaagacaaaatgagacattcaatgtgaaaaytacattagagttgtaaaggaccatgactttgccagatataaaatatgattctcaatatccaaggacaattttacaatagctactttgcttatttctatatgaatctgcactggtcatctgagagggaaaagaaaaagcaatgaccatgaccgcctagcagaaaattgtagcaaaatgttgagtttgattgagaaggcttcttctttcttaagggagaaactgaacctgtaattatatcttcccttgggtcttcactttgaaggatgctaaaccaaatatgtctgtggaagcagatgatggctcctgggttagctgtttatttagcacattcctagaatatcagaggtcatatggattcattcagaaaccaaacatttcataagtgatttcagaaagcatagcctaaagattgagcctcaatgtaattggatagtcacataaatcatcccataatgcaaagcaggaaggagctggagcagttccccataatctagagtctccctatgagatgcattcctctctccagaggatcagcttatcctatttctgtggctcaaattttatgggactgatatcattgttgctttgtggtttggaaggttatagatgtttctcattttcccctttgataatgagccaagtcctgtgttacaaaaacttatttgaaaatgtttagtgaaggcaaagatacattgtgagttttagaaaagtctagttttgtgatttttgtaatggtccacagaaggcatttgtatgttttttcatttctttctttacattttttttttttgaggttggtcagagagaaaaatatgtgagttttgccaacagttgtctttgatcctcagagatgtgcttttccattgctagttcagttgaatttaggggataggaaaaatgtactttcatttttcatttctttgtaaatgttcttagaccataataaaaggctaaactgatattggatatgaattttcctttggcaatacaagataaaataaaaggcatagatacatttttatctttgcattttgtattgatgtaataataagcatcatgccaacacataaatatccttgtatggaaacacattctaatttaatcatttgtgctttgttgaaaatcacaagaggaaaccaaaacttagtattgatatttttcagtattactattattctagaaggagccatttatattgtcaagggaagaaatgtaaacatctatagagttcagtgatagttaagaggggtttttaatctttcaagaaatagatgcattaagttcagagaatagtaatttttctctctatgaaatttgaatctcataaaactaccatcaggttttaagattaaatatcctattgtttaatacgtgtagcaggggtcccttcaaatatgatgttttatttctctatttcaattttatgtattctttattagatatctgaattatttattggactttctctagagagtgcaacctgtctgtgcacagaactttcaagcttttaacataatatggatttttccctgtaatttcagtaaatttatccataattttcagaattgtgtacacccatttaactacctctccattcaagctatcgaatacttctgtccctccagaagggatcctcgtgttccttttattagtttcctcaacaacctctatgtcagcaaacacacacctggtttctaccaatatagaatagttttaactgtgcaaaaggcagctgtgaacaggaatacatagtatgtattcttttgtgtctggcttcttttttttttgagacggagtctctctgtcacccaggctggagtgcagtggcgcgatctcagctcactgctacctccgcctcccaggttcaagcgattctcttgcctcagcctgcccagtagctgggattacaggtgcgcgccaccatgcccggctaattttttgtatttttagtagagacaggttttcatcatgttgaccaggctggtcttgaactcctgacttcttgatctgcccaaattggcctcccaaagtgctgggattacaggcgtgagccaccgcacccggcttggcttctttcatttggcataatgtgtctggaaatttttcatgttgctgtattcatgtgtttttttctttctattgctgactagccttccattgcatcgatatatcataatttgattatctgttcacctgttgttagatagttgagcttttttttcccagtttttagctattacaaaaaaagctaccatgaacattgacttgcaggttttttgtggacgtattcattctcttgcgtaaaatacctaggagtagaacttctgggtctcatatggtaatgataygtttaactttataagaaagtgccaaattgttttccaaagtggttatgccattttatattcccacctatatrattgacaattctgaaataggagttggggctccacaccagaccagatggaagactggctaaaacagggaagagacagaagcacctctgcataagacatgcccaacagcgccatgacagtgtgccattgccatgacaacacccagaagttaccatcctttttctagacatttccaaataactcaccccttaatttgcatgtgggtgtaaatatgactgcacaactgcgccaagctgctaccctcaacacgttgcctatggggtagccctgctctgcaggagcagtcacggagctggaacactgatacctcagtgaagctgattttttctaccaccagctcacccttgaattctttcctggccaaagcccaaaaccttcctgggtggagtcccaatatgggggcttgcctgccttgcagcagttcttttctccatctttcccaatccttaatattgccaatcttttcatttttrgccactggcagttgcatagcagtatctgatggttttattttgcatttccctgatgactaatagtgctgagtccttttcacatgctttttgacaattcatttattttcttttgtgaggtgttcattaaaaccatatggttcatttttgtttgtttcttattaatgagtcatatgttgtatattctgcatacaaatacgtcctttgccagataaatgtattgcaagtattttcttccagtgtgtggctaaacttttcttttccttatggtatcctttgaagaacagaagttcaatatatccttttatcccttttatggttagtgcattttgtatcttgtctgagaaatatttcactaccgaagttatcaggatctcccacgtgcatccttctagaagttgttttttttttgagacggagtctcactctgtcgcccaggctggagtccggtggtgcgatctcggctcactgcaagctccrwctcccgggttcacgccattctcttgcctcagcctcccgagtagctgggactgcaggcgcccgccaccatgcccaggtaattttttgtatttttagtagagacgggtttcaccgtgttagccaagatggtctcgatatcctgaccttgtgatccgcccgcctcgtcttcccaaagtgctggaattacaggcgtgagccaccgcacccggctccttctagaagttttatagtttgagattttatacgtgttctatgatccattttgcatcaatttttctatatggtgtgagttatgtgtccaagtgtgtttagcaaatggtatttaattgttcaagcaccatttattgaaaagattctccttcacccccactcccactgaattgcttttgcatttttgttgaaaatcacctgcctgtgttcatgtgtaggtctgcttctggaatctctatttcatcacactgctgtacatatttacccctttaacaatagaacattatattacttaatgttacataatttcatattgtatattaaaatctggaagtataaaacctctagattggtacttatttttcaaaattgtttgggctatcctagattttttgtgtctccatattcattttagaatcagcttttcaatatataaaaaaacttgagaatttgattgagattgcattgaatttacagaccaatttggggataaaggtcatcttaaattcagccttccaatccatgaacatattttacctctccatttattcagatcttccttcatttccttcagcaataaagttttcagtgtagagtttgtgcatgtttctattaaacttgttatcaagtgtttcgtgtttttatgctattataaaatgacatgccatattatatatgctattttaaaattttactttctggttgtttggctgatatatgcaacataaatggatttttgtatacatatcttgtattctgcagtcttgtttaactcagttattagttctaatgacttaaataaatcctttagtatatactacatagatgacaataactgtgaataagttaaataagttttattttttcccttctctctctctgtccctctttctctgtgtatgtgtattgctgtgatggctagaactttctgtgcattcttgaacagaaagggtgaggttggaatgttggcctttttcttaatcttgacaggaaagcgtttagtcctttaccacttaagtatgatgttagctttggattttccatagatgccattcatcagtttgtkgagttcccttctgggcatacttgctgagtttttatcctggataggtgttgaatttttctgcatcttttggtatctttcaaagcttttctttttttattctgtttaggtggtaaattatgttgatttagttttctactgtcaaaccaatcttgtgtaatacatcagaactccacctggttctgatctattataacttttacgtgtattcagaattgttatgctaaaattttcttatggatttttgcatcagtgtaagacatactgaactgtaatcttcctgaatttctttgtctggtttggtataggagtaatattggtcttgttagttagaaaatatcttctcctctattttctgagtttgtggaatataaacaatttcttaattgtttgatacaattccaccagtgaaattatttgagcctgtagttttctttgtaggaaggttttatattacaaatttaatttcttcaattaatagagactattaaagctttctatttcattttgagtcagttatgggaattttgaaagaattcatctattttatgtatgttgtcaaatatatttgcacagttttttgtaatggtgtctttctattattttaatgtctgaagattctatagtgacatcccctcttcattcctgaaaatggtaatttgtgttttttttcttttttctttgatcagttttggtagaattctatcaattttaataattttctcaaagaaccaatttttgacattgtttattttctctattgctattgcattttccatttaattgatttctgttcttatattatttcatttaattcttgccttagttagcttttctctagtttctttagataaaaattaactacagatagatagatatagatatagcctttaagcactacttcacttcacctccccagttttttttttttttttgagacggagtttcactctcgttgcccaggctggagtgcagtggtgcgatctcagctcactgcaacctccgcctcctggtttcaagtgattctcctgcctcagcctcccaagtagctgggattacaggcgctcgccaccatgcctggttaatttttgtatttttggtagagacggggtttcaccatattggtcaccctggtcttgaactcctgaccacgtaatctgcccaccttggcctcccaaagtgctaggattacaggagtgagccactgcgcccagccacctcccaaattttaatgttttattttcagtaacttccagttcaaaatattttccaattatcttgtgatttcttctttgttctatggattatttgcaaatgtattatttaactttcaaatatttgcaggttttctagatgtcttattgatttataatttcagttttattgtggttaaatgatatactttctaagttttcaattgtttaaaatttatggagaattgtgttacagccctgcatgtggtctatgctgctgaatgtttcatgtatgcttgaaaaactgtgttgtctgcagttattaagtgtagtgctctctgtcaattggctttaagtcggctgagtgttggtcagattttctatacccctattcatctttatctgtttcattttcggttactgagagaaaggtgttaaaatcttcaactctaatcatggttttatttttttctttaatttttgccttttcactttccttcgtgtattttgaaactattacttcatgcatgcacatttaggattattatgttttactgataaattgtcccctttgtcattatgaaatgtctttctataaatctaataatattwtccttcttgaagtcacttttgtttgatattatttcagtgatttcagctttcttatatttactgttcatatggtatatcttttttcattcttttagttacaacttagtttcaccattatatataatggcatcattatatataatgtgcatgcatagtaaaaarcatataattgggtcctgctttttctgtgttttagttgaagtatttagaccatttacaactaatgtaattatttttatggttgaatttaacataccattatggtagttgttttccattcatctctttttgtgttgccattattctgtcttcattttggtttacagaatattattagtattccattctatttccttcattgtctttttaatgatacctttttttttgtatttttacattaggtctaaaaatatactccttaacttataagcaagttttcttagagttaatatgcagctgctttacatttcataccttccaattcatacctgacacttcatattacacaaattcccctttatacttcacaagtgaaatactgtcatactagtgtaattccatgtgcctatccttctgtgtgctgttttagttatatcttttacttctctctgtgttataaattcaccttactattatttttgctttaaatcactaattctctctctctctctctcttttttttttttttttttttttgagactgagtctcagtctgttgcccaggctggagtgcagtggcaagctcccagctcactgcaacctccaccttccgggtttcagcaattctcgtgcctcagcctcccgagtagctgggactacaggcatgcaccagcacgcctggctaatttttgtattttttttagtagagacagggtttcaccatgttggccaggctggtctcggactcctgacctcaggtgatctgcccacctcrgcctcccaaagtgctgggattgcaggcatgagccaccgcacccagcctacttctctctatattataaattcaccttactattatttttgctttaaatcactaattctcttttaaggagataatgaaaagaaagcctatcatttatatttatacaatgatttatcatttccagtgttcttcattccttcttggagatattttctgtttggtatcattttcctttggcccaatggatattattatttcatacagtacaagtcttccagtgacaaattatgtcagcttctgtttgtctaaaaatgttacactctcgttttttaaaaaagtagttttgctggatatttaaacctgttttccccatctcaacattttaaagatgtattccattttcttcttgcctccattgcttctgtttagaagccagctgtcatccttatcatgatgtccctgtatgtgatgtggcttcccccccgccccaactggcttctgtgttttccttgtttctgttttctaatagattcactctgacatgtccaagtgtagttttcttttatttctcctgtttagtattgactgaactcctatatcttactagacatttttcataaaatttaggagaattttagccgctatttccttctccttttttggcccatttttattaccttcttcttctggttctctaattgtatgtgtgttaacctatttgttgttttttctttgtttttttaaatatctgtccattttcctggagttcttttttctttgttctttagattaaattatgtctattaatacatattaaagtttactgacctttttttcttctgcctacagtttactgttaaacttgtcatgaagttttaatttgaattagtgtaattttaagttatataattttcatggttccttttaataattttctccctttttgggccaaaatttcatatctgtttactttttaaggctttttctttaagtctttgcacatatttttaatggctgctttaaagtctttctcttttaaatctaacacctggatcatctttgaatcacaagatgacattttttttctcaactatgaccacatttttcttgactactgatgacatttcttttcttgatttgattcatattttctcattttttgttttgtttttttaagacggactctcactctgtcgccaggctggagtgcagtggcatgatctcggctcaccgcaagctccacctcccaggttcaagcgatcctcctgccttagcctcctgagtagctgggactacaggygcccaccaccacacccagctaattttttgtatttttagtagagatggtgtttcaccatgttggccaggatggtcttgatctcttgacctcatgatccacctgccttgacctcctaaagtgctgggattacaggtgtgagccactgcacctggcccatattttctctctttttttttaatatttgtaatagttttgggttttatagtggacatgatagattgggacatgatatgggggtcccatatcatgtgggtaaattatgtgttgtagacactctgtattatcttatcttcctctgaagctagtttgatatctagctgattactttgtatctgcataggtttatatctgtacttgctaaagaatatttgtgaacatccctgtttctcgagcccctctaacttgctaggtctctacctccaacttctatgattcctgcaggtcttgttaagacttatcctttggcccggaagttctagagagccctactcttggccatggtcttcacttgtaagatatggccttttaggtgtctcatttgaatgcctgaggtgttaaggaggtatccccattctggaatgggagagaactctaaatgatcttgtttccgcttccagcctagtagcagctcctgtctgacatgctttctgaagtctcaccttatgtattctcagcccaggcttagctaagaatccatgggaagccctactcagatgcccggctttcctctctatatacttcttcttctctgtagaatttccatatagttccagctgctttggcaactctaatctttgcatcatcagctcagtaggactgtcattcactacttggacttcagctcccttctgtggtcaggaaattctgcacaggtagaaagccaaggaaatcaagagtcgtacatcatgagtttcctttctgtcaagaatcacaatcttgtactgcagattgtccaatattttgttcagttttacagttcttaaggagagcagctagtttagtacagttgcttgtcatagctggaattaaaaaaatattaaagaacctcagccaaccaggatagagtacaggaagaagagagagagaggaaaaatgaggtgagaaaaatagaagtcgtaggattggagtttaggggtagtttgaaagagaagaactgaatggagtagggagagtgggaggaacttagatgcatgtaccagtccccttcgtttccaacacatcatgtaataatatttcaacaactacttactgggacctcatctgggccaggtactacagtgatagtaaataatggttaataaagtcttagtcatatcccaaggtttagtaaggtaaatatactcacataaaaacaattacaaaatatgtttggggttcaaattgctatttgcataaaattttattatgctaaataaattaattctgcttggttgggaaaggtttcagccaaccttaaatgatgggtaagagtgtatatgttaaactgtgtattgkcaggggttgttgggtggcgggttaggtaaagggtaaagcatttcagacaaagtgaatggtgtaaatatcattggaacacatcaagaactgtagtttacttttgtgccagcaayagaaaagaagcttggtgagtaaatcaaaatttcagtacagattaacagactcccaccagttgttccagaataatcacattcatgtaagcaagataaagggaaactacccatcattattgccccaaaatgtcattaattcaggttcctccacctgagacctaatcacacttaacattctcccacagacaagttgcattagagatatgcaagacaattgtatttcccytccaggagtacagtgagtaagcaagaacaagtgacgacagataatttcctctaaatatttgatttactggccaaagctctctgtgtgtgggtcaatgagtctgtctrttctgtcaactcagggatactgggtcattgctttcatttgatgtcctttttttagcttagtaagtttcattrctgggtctgaaatattaatagaccaatgctatactcctccccgctctctttatccctcttttctgcctttcctgttgtctcccttctgtctgtcttattcccttcctctctaccttcctttccacttgtggaaatattttggcagactacagagaagcatacttttctatacttttggagttaaacataatctttggtgttaaatgtcactgtgaattccttcaataaagtaaagccttgattgcttgctgtttaaaatagagtaaaatcaaatatctggcgaatgcccattcctttgagagctacacacagatagtagaacctataatatgttctatgcatctctatgttttcaataccaatgattcttcttttctgagcatggggattatatagcagcaactagggaaacagcataactaaacatccttattattattattattattttgactcacaatgaaacacaatagtttattgtatccaaaacctttcagtaggagacctctgtctactcctataccctagatttaggttatggctggatgcaattggaaatacattaaaaatgcatttatttgctgggcatggtggtgcatgcttgtagtcccagctgctggggaggctgagacaggagaattgcttgaactcggggggcagaggttgcagtgagccaagatcccgccactccactccagccttggcaacagagcaagaccctgtctcaaaagcaaaaacaaaaacaaaagcattcaaaccagattttctttgtaaaatatttcagatttggagggcataggagattgagtgggtggtaataaacacagaatcgactgaatagrtaacgttaaaactgttaaactagaaaagtttttaaagaagatatttatttaggacttcaaaattgtccaggtactatgctaaatgttttataaatgacctaatgtcttccttataaagtaaatgaccaccatttactgagtgcatatcatgggctaagcccttgtaatgcattatctttaactcttaaaccttcagtcaaaggtagcaatcctcttcatttgcgagatgtgagaactaaggcttagagaagtacagtaactctcccaaggctgcagagcttgacagtgtttgagagggttttcattcgagatcactctgatccttgagcctgggcccttattcttcaccccgtggtggaggtacctgctttgtcatttctcataaatgcatgctttggtgaaaaccactttaaagggagcttatgaaaaggcaagattgaattatttctaggccctcctgcagtggatcctaatttttaatgtttatggtaatttgcaaggattagaaaaacgtaacactttcaagacttaaagggttgtttactcaagatatatataacaatttcctctccatagcttagatttagtgttggtaattattttgtctttaagattacaaaaactttgtttcagaatgaagtctttatttgcacattccagaatggcttattgaaaatcaagtataggcacaaattaatgaaatacatattactggatgtattataaacatatcaatattttctattttctctcttatggtctgtttctgttcacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcaggtcagcacttttatttatttcattataatcttttcattatttattctcattaataatctttcctaggaagattaaggaaaaaaatatggaaattctctgcaaagctccctgctgtgcactttcttgcaagaaataaagtttgtcatttggagcctgacttaggagaaatacaggaattgcataagattctgtggttattttgaagtgattattttattggaaatacttgaaaataaactccagattttatgtgggcaaagaaacagatgtgctactactctgaaatgatgtaacttgctactgttgaatacctactttaattatgtaaaatcgatgtaaattttaggctgtttgctgttcatttaatctaattatattataaaatgatggcaggatagcaatcttaaagttttcacaaagttttcatgttcaggtaataaaagtctaggcttgtgaatttcagtacaaggcattattctttcattatcatcattttgaaagaatgtgtttaaaaagttatatttgcagtaaaagtaagttagcttatatgttactatctctccatgccactactttgagttaaattaggctaatcattctggtgggcatctatatcaaatgttttatttgggattttaaatctggaatcttatgtattataaatgttattctataatataaagtaaggtattaaaataataaatcataattggaccctatcgtgctaaaatgacataattttcttaatttacagcagttactcactggactttgatgttgaataaatcccttttttgttgtttgtttcaaaaagctacagattataaactagaattaaggccccagaagtttttaggaaaatgctatttccaraattttgctaagtatatcaaatatgatatattacatttcaaaaatttccawatcagaaggaaaacgttgaaagattctctgtaaaatacagcagtatgtttatatagttaatagtatagtttctttatcgtgttttctctgacacatttgccagaggctttattcgaaagggtgaagattaaacatattctctcagtttgtgattggttatataaaacaccataccagctatgaatgwtggttattctttgttaagtcattcaaataygatttttaaaaatttaaaagtgaaaatcgtgttttttagagtaagtgtagtgtttgagagaaattacttcatccaataaactgctaatgtttgcaatcccaaagttcaaattatgttaaatgtttatacagtaatattgtcagtaacccaataaattttaatttctgtattctgccagagatggaggctatgaaaaatcaccattgctgggaatattctatggctcaaatctacccccaacaatcatctctcatagtaacaaactrtggttaaaatttaagagtgaccaaatagacacaaggtctggattctcagcttactgggatgggtcatcaacaggtaaatagcaaagagctgtcttttactggagaagccaatctgattggtttcttgattctgggattgtcatgctctgtccctcacttgtccatgtttgcccagctgtatttaaacttcaatattgcaaataattttaaattaacagcagccatttctttttaacagacaaagggagaaagttctagtttctttttatcaataaataagaatcctggttagaataaggaaattgcattaatggaaattggggctgggtgctgtggctcactcctgtactcacaaacactttgggaggccgaggcagggggatcacctgaggtcaggagtttgaaaccagcctggccaacatagtctctactaaacatagtctctactggccaaccccgtctctactaaaaatacaaaaattagctggacgtggtggcaggtgcctataatctcagctactagggaggctgaggcaggagaatcgcttgaacctaggaggtggaaattgcagtgagtcaagatcatgccgttgcattccagcctgagtgacccagtgagactccatctcaaaaaaaaaaaaaaaaatagaaaaaaataaaaattggatttttaggctataactactctttcatgatgccattttgctgtgcaatttgatttaaaggatagtagaatggcaccagtttaatgcagacaaaaagattcaatttccccagaaggaaaggggtgtgtgtcattccacttctttctcctgtaggttgcgggggtaatctcaccacttcaagcggyacgttcatatctcccaactacccgatgccctattaccacagctctgaatgctactggtggttgaaatctagccacggcagcgcatttgaactggaattcaaagactttcacttggagcatcatccaaactgcactttagattacctggctgtatgtataatgtttccatcatattgttccctgctcccatctcacccaacgcacaatgcacttatttttattttcgagattcaggaaaggggagcatctaaaccgaacatccatataaaaattcaaacaaaataaaaacataaaagaaatttggtgaaagtgaccatcttcgaagtactcaatggctcgatacactaagtatttaaaatatattgatagactattaagatatggtgaaaatctcctgaaagggattacaggatttattataatcattatttatgtttttccacatatgcattgaaaaatcacaatttagaagacagttttggcgaagtagagaagataatatgagtcattccactaggayttttcacagtacagcaattcaccattgttcatttgttaaaaatctaaataaaaatgtattgaagtgtcatgaatcataaactatggaatcaaaaaacaaggaggacagttgacatcagctgtggcattacaatatgtattgggctttcattttcaatattcagccttcagtgtaagctcacacgcttattactgctgcacatgtccacagcttaattgcctgagtttatggcctgagtttataaatacctaaatataatttwtaaggttattttatttcatggctattcttttgtgatgtcatatatataacaaaaaatatatatttattatatataaagatatatttattttatatatatttatgtttacatataaatatttaatacatatataaatatatgtatttaatgcaaatataaacatatgtgttgaatacatatataaaaatatatgtattaaataaatttattttataaatatattatatataatgaatatttataatattttatatataattacatatatttatttataatatatatacataataaatatatatattttttcttcctcacttcttctggattatagtcctttacataatgtttatagtctcaaccatctaacattcaaaatattttcttaaaggtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagagtaagtgtgaataccggcagagtaagtgtgtatactggcagagtaagtgtgaataccagcagagtaagtgtgaatactggcagagtaagtatgtatactcgctgttcagtgcctagagtgggccttcaaattcttgaaacaaactgaaataagtgtaacgcattggtgtgagcaattgaacttcatcttagtttcttctgtgaatcgtttaactccatttgagggagaaataygtattaaatttaatctcatataactaaaacatctggcaaactatagaaacttagaagagtatttaatatgctgagagagttgcaattcagtgaaagatcagtgtaccagactaatgactaatagcttttcatttgcctcacacattgcaatcttgcagtgtacattatattattccaatgtacatagtattctatcacactagtctctaccttaaaaagtaccttaattttattagggaaagctgtggtccatgtgagtcatgcatggaataagcatgttctttacagtagaaaaatctggccattgtacagatgccattttaaatctacttttcccagatagcaacatgatggaattaaaggaacactgagcaaaatgtcaaggggcctggggtttgttctggctcctaacccttgagaaagtcacttttctttgtggtcccatggtttcttcttttagaaaaggagattaaattagatggtctctaaacctgccttctagctctagaattaaatgctttttgaagttagttccaaaatggacattcaagaaaacaatattttcttgaatttgttatttgatagagacttttactttatcaaagtaaagtctaggttttggaaacataattctactgaatcaaaatttatccataattttacacaattatcttttcccacagaatcaaaatttatccataattttatgtaattatctgaaagtggaattaaaagtcacaaaattattaactgtatacacaatatcccttgaattaactgaaagagtaataacatttaaccttgattatgtatgaattttaagattcacattgatttatatctggggattaggctgaatcctagatagttttgaatattaagttttaatatatagctttgttcttcagaaatgtatcactagtacataaaaaggtctcctaagttctatcagagatacatctgttttactatgtaatcatttatctaattttattactgctgtgctaatctatttctggttataatcagattgtttaagggtttcttttttttcttttcatttctgagatatttttctgtcataatttcagaatcctgaaagtgtaaatgagtgcacataagaggcaaaatcagagcaaactagtgagattatctgtaaaatttgccatgggaaattggagatttacaaatagtataaggtctgagtgctgagagtggcccatgtggtttactggaatgtattttcctgggccctgtgttgcccctagtcatcgaggcacgtgatgcctatctgcctaataggtgtaccttctcacagtcttctaaaacaataagattattctttaaaaatcctttatggacaaaactgtgacctaaagattttcaaacagaatgggtttaagtattctccctgctccaacaaagcaatattttgaagcgccacaaatgtacacttttttaaaccaaagttataaatggtgttctacccaccttcagaaagcatatcgtagtaggaatacatctatgaatcacactttcagagacagctcattccatataatgtttatttcccgttctcttttattgcacatcatagagataatatattccttgtttaagtcattaggattggctgaactgggcacccaggattagacatacttagaggtatctggtttggttttgttgaaaactcagctcaagaaaatgccaccattggattgaagactttttttctgtaatttcacattttcctttcttctttaaatcctttctactctgtctattcgcttggtacttcctgatgactaactagagggagaacggagcctttactgtgaatttcatgcagacttttgaatgttcaacaaagccatgttgttactggtttttagcattcccataggattttgggtttttaaactgttgaatttaaaagtcagaatttctgtcccttccacgtgttaacattaaaaaaacagcagcacagaacgtcgaatgcgcttctctaacaaacaaatcagactgatccctgaatataaccaagttattctgctctccacaaattcaagggaatttgatgcctattttaacatgactatttaattttcatgactctttagtttgaattcacttcagtattatttcacatttcttctaaatggaaatcctttcactatgaaaatactgcaccaaatatatatgtgtgtgtgtctctgtgtgtgtatatatacacacacatatatacacatcatatatgtgtgtgtgtacatacacagatgatttttatttwttttttttaaaggaaaatctcatcttggagcacttatgaagtatataatagtggttcttaacagtcatttctttttccagcatgtgagaatgtggtaatagtcaatcaaacctatggcatcttagagagtatagggtatcygaatccttattctgaaaatcagcattgcaactggaccatccgggcaacaacaggcaacactgtgaactacacatttttagcatttgacttggaacatcacataaactgctccacagattatttagaggtatgtattataaagcttgattgatcactgctttttcagatcaagggagatgtgtcaagttagaatccatcatgctttttagaataaaatccctaactctgccccacgcatctataacacaccaaccacccatggtatttgaacaggtatatttcatatttaatgtattaaattgtgaatacagagaactatctatgtttttaggtttcagtgtaacttctggactcattgrcctcatattacttaacttacatggaaggagagtaataacctctattttttgttggttgtttttatgtttgttctctgtgtataagagatcagaaaatgtttgggtatcttggatttatttaagatgtcatttttctagtatgaggtatcatggttttaattgttgtttttatttttaaatgtaagttcatttcagtatatttttatttttgtaaaattgaagtttcaattgttataatcatgaccactagtaacatttattcaactgtctgtatgcaayttcaggcaataaatcttgcttaaatattaggcaaccttgaatataaggtaatatgttatttttgcaataagaaattttaacttaaaaagctttttgataacttgcatatgtaacttttagggctacaaattgggaggttattttggcatctacgtttcatcatcagtaaaataactttttgagtcatctaaggcattatctttatttctgtctatattgttaatatataatacttcaaaaaatccacatataatgttttcactagataccctttctgaagtgataagtacttgctctgataacaggacattttttttcccacctgccctcctacctgcagcctagtgacttaaggtagttgtttttaaggtggtcagtgatttttagaagtcttacttacaaagacttcaacatccattgctggcaactctggggtcatattcccaggaaaaaatatgttattcttgtaaaatgttcttaattgtgtttttacaagttgtataggaaaactagcattggttgaggttggttgaggttaacatatattttccaaatagcacttttgtttatgaaaacaaagagtgacaacaaagcattctgcactttgagagactctgtgaggtcctaactataaggagattcccttgtttttcagagataattttttgggaaaaaattttgccttatatttacaaaagtacaatattacagaaatattagccatagtgtttacccattagaaagttttgtttaccagtattctaagaaaatatgacacaacatgaaacaaacttacaagcacgtacttggcaatggttttaaagtccaccttccttgacctggagttcaactggtcttcacaagcttaatgataccaggatggtatcattaagatactactagaataggcatccatttcttcacatggtgagaccttgtttgtgttttagaaaaagcagaaaagttgctttcaaagccctttgtttataccgtgaacacagcagttggtcatacctccttttaccagttaggactattctgattcccactggactgtgggcttctcgaaggtctgtgctgtctcctactaactttgtaacccaggcacttattatacaggtgggacattacaggagttcagtaagttcaagttgaattgaatatcacagccatattttagtatcagtctaatgataactactaatgaatgagaaagattgaattccaaactggcgtttttgtacgacctcctacacacgcagtgcaatcctacaaattggagcacaaaccaaaataggactcatgatcttgccgagcgttgcacgtataacagtgtgctgggcaccataatcgtgatttggtaaagcrtaatggagaaagctacagaaaggaggatgcttttgaattgggctttaaaggaggctttggcagaaagagggggggaggaaagagatgaaacatttccaggacctgaactccatttctttcgactcatttgaggatgaaatggcaacaaaaaggtgtttaaaaactcaaattaaaaaatgcttgttccagcaactgcagagtagctcattagasccccttatggatgacgtgtctgtcatgttatggtcatgccatttctcttgtgcaacattgacggtgaaagagcaaaaatacaaaatgagaaccagaagttcagaaaggccttccaaaaaaacggcgctgttgccagagggaggagattgttttccatctctgtgagccaagaggccagaccagagcaatagctgcaatagctggtctatgatggaaattttaacacacaaacaaccatttacagagagaaaactcacacacacagaaatctagcttccattattttaatcgcttctgggttttttcaactgacttccccaaatcccaactggatgcctgttactagagccagaatttagttattctgaattaataaaatggaaactacaaaaagacttaattacgtgctggtcagacactatcccgccttgatgagaggaatgggtttgaaaagatcccattggaaaccaaatgcatcctttattatttcaccctctgggcaaaacaaaatatttcagatctggaaataaaatatacagtgggagaagggaccatttgcttaaaggagtgagaccatttgcccgtgcaaacatggggaatcaacctgaagagttctggctgtattttacaacttgatttcagtcttccatttttattttgagtctgagtctccatgcagaaaaggagatttcaaacgagtgattgaatatagaaatggaaatgatagatttgggagaaatcaacatggagatgtataggaagcccagggtatttgttaagtcaacagggagcatgtgtgtagtgagaagaggaagtaggaacactaagaggtgattgtggctgggcacggtggctcaggcctataatctcagctactcaggaggctgaggcaggagaatcactagaacccgggaggcggagtttgcagtgagctgggatcgcaccattgcattccagcctgggtgacgaagtgagaccctgtctaaaaaaaaaaaaaaaggtgactgtgtcatgggagccaagggaagagcagtcgagagaggttgtggttcagaagggtcccttggagatcaatgtgactctggtcagagcagtgtttgtggggcgagagcaggaaccagacagtgtaaagaggtacaaagaggagagtgagtgtagactgaagtctaggtccctgaattctgaggctstctgtaacaaaccagagtaagtgatggcttcttttctccaatccttatccttcatttccctaactggtcctcatctagttcacgtgtgtgggacacactcctttgcatgttctcttgtatgtcagtgcctctttaaatgtggccccagaattggatgcaacagttcaactaaacctggctaggcccaagtaggttggaaccgtattatccagttcatatatttctggtggtctatgctgaagttaaatggggtttattgtagctaagtcatgatattggcctatatcaagatttataatctccatatcacttttacatgaattattatgaatttatgattatatgatttttaagaatctaaacagagatatttttcctaataaatcagatttgattttgtctgagaatcccaacacatcatgacctccctaaatcttcattcattgcttttcagagcattattcatttgcatacagactcattggccactgacctagtacttcttcaaaaataattgataaaaatgtcaaacaagattgcatctatttcaaatactcttaaatgataagttcttttggttaaaattgatctattattaagtgcttttggaatagcactattcaaactactaggtaataaaagctaatatttattcagcatgtattatttgccaggtaattctcacagcaaccctgtattataagaaatattatccccattcgttaggtgagaaaagtgaggcagatataggttgttcatattcagaaagattataagtgtcaaggccggctttctagcaggcactgtaactccacaccgatgctctcagccataacaccacataccccgggagcactctcacagtgtcctgtcaccctcacagggatcatggggaagtgttcctgctkcccccaagtctaccattctattgacactgccgcaaagagaaatcaatgttttgcatgactccatagataagcaggtgccatttattataatcacctctttctttgcttcatgttgacaaattatttttagtgtctaatttagaatttttccaaaaattactgttaatcttactgatctacgagattctagaatgaatctttccccatcttggaagctggaacgttttcccttcagccccctggcagccctgctggttctccttgtctgggctcrcactcttggtggtggcaccgaaacacaatctgagccacatgaagaggacaggcgcatgtgacaggctggttactttgagaaggctcacacctccccacacacaggagaggctgagaagcctggagaaggtgggaagccaagagagtgaggcagattctccactcccacttcctaaggctctgctcctgctccctgactgttcccatccattcccatccctctccccaaaggcttcctctgagtttcagcaacctcggaattttagcttcaacaacatgaccaccccagccttgaccctacaggatcatttacctcaagtgcttgcatacaaccagactttcccttggtgacaaatccccagcacagggagctcatgtgtttgagctcgacagcaaatgcatgggtctagcctgcctatggacgatactcattagggcagtgtagccaagccctctagccggtgatgttcacagattatgttctgggcagaagcagaacttgtgagcaggggcatagattccgctggaatgctaaaactttttttttttaatttaactttcaagttcagggtatgtgcactaccctgatagtagtacacataccctgaacttatttattatgtaggtaaacttgtgtcatgggtgtttgttgcacagatcatttcatcacctaggtattaagcctagttctcattatttttttggatcctctccctcctcccaccctccaccctcaggtaggccccagtgcctgctgtttccctgtcctgtgtccatgtgttctcagcacttagctcccacatataagtgagaacatgcagyacttggttttctgtttcctgcattagtttgctgaggaaaatggcctccagctccattcacattcttgcaaaggacctgatcttgctcttttttatggctgcgttgaaaacattaaccatgaactatgcacccatgaattcaccaagattacaaaatcagctctgtaatcactatacctttcagtgctgtggcatataattcccttaagcctggaaaagttcattgaaaagagttgactcttttatcttctaaactggaattccatgtctcttcttccagtttcaaaatcaaactaggcatgtttctacctcctcttcattgacatcacactctcttctgaaagcatccatgccatccttgtttccctctttcatttgccctagtcacagccttaaaattagacattttttctaatgttcaacaatatttttctgtgccatttcccaaagtttagctagttcgtatgtgtacccataaaatggtcagaaagttccatggagcctcttggatttctgcttagattgatttctttagagggttctccttttttgcmccccccaaaattattcctgattttgtagtgagaatttagtttttcagaatttgccaattttctagaatgttctttcctttttcaattgcgttttcatttgtttttttttttttttatccataggtttatatcttgttttgaagtttgaatccccaaaaccttagtccggttaagtggtcagccatcacaggctctaagttaaggcaaggtgatcactgtctcctattgtcttggtgacttccatattaacaaccacttctttgctagccagaattagtccagagttgcacttctcttcactgtctcctttatatgaagagagcatataaagaattcaacaaatgctacattttttgggggaacaagacatctcatgggtgtccagattgttgaaacagtctccccgtcgccactcctgtagatctcttttggtacattagtgtttatagatttcctttacaaaagattgcagtctctactgaaaagaagctgaggtgggaggataaagtccttataactggctaccaaatctggctgcattccagaatcatctggggatcttgttagaaaaatttattcctagtcctcatcccagacttaaccaaatccttgaggattccccaagagcaagctttgcacaagcccctggtccagcacttgagaccactgttcatagcccacttccaccaagatagcctgttttatcctcacttcaatgctctctcctggggagggaaaagtatcttaataggcatcttgttaacatacatttgcctgctattaaatgttactttccagtgaggacttactcttccattgctatggctgagttatgtattttatctcaccaaggcctggtcatacagttgatattatgtttacctcattatattaaaaatgtcagattcactttacagtttttgtattctgattctaaactttctcccccttttccttatcgggcaccttgaccactatcatcttccattaaatcatttccttattccttccccttttccactaaagtccatttcaagtcctcgtgatagtgtgggggacttcartcaaaggcatttccctccagtctttataacatgcatttcatctcttgccaaatccttgctgatgtcatcctgttcaccccagatgcttatatcacagtttgttgcactcccgtatcctcctttcagttgcaaaataatgcattccaagaggaagaatggataaaaaacatcaccagtatccctgaatcttgcagtgtcacatccatattctccatgtctacagcctaaacaacattttccatataccacgactgagaaacatcgggctcatgggatattgtcaatacttaaagtgatgctagctgttatggagaactcatacattctcagttgcttactgcaacacaggttatttctaatcacatcagagtaaaaggcaggtgttcctggcttccatgtggtagttcatgaaaccaaaggaaggggaagtcaatttgcagaagccacataactgtctctgccacaaatgttggtagatgtttcacaaatagagacctatattctaataaatctgcgatatgccaaattaaaacacaattaagcagggtttgttgttttgttttgcgtttgctgtggtatttcctcaggctgtcactatcctaaatatgcattcttcattcctttatccatgtatccagtcagtaggatatattttagacacttaggctatggacatgtgactgttttagcatcagttttccttgtcatgatggaggaaacacaccttaatcaatttatcacacaataaaaatttaaccacaggcagcgttaagtgctgggagggacaattatagtgcacccagaaggcatgagatgggaactgagctcctttgtgggtcaggaaaggcctccctgaggatgaataacacaccaggtgccaggaggcttgagatgtgagggactggaaggagagcagtgtgaggctctcaggtggacagggacctggcctgcagagcagggtgggcacattaagagtttcagagacctcctggagagcagcaggaggtctttcaaggatgtggtcagatctgcacttttaaaacaatcactctggctaccagaataaactggagggaggtaagagtaacggtggagacccagtaaggggattgctataggccaagggagagagaactccaggtcttcaccattgctggggaggaagcatgagatcgaatgatttcagagcacttaggaggtacaattgacagagatggataacaacaggatgaaggaaagggagacatcagaatatagcctgatagatagaactggacgcagggaaaaccaccaggggagattagtcccaaagagattatccttgcccagaagtctgattaatgaacatctattggacatttgtattccatagaacattctgaggaaaacattattctagagatattttccaagtttatttcattttcccctcatacaaacaagcaaactttgaagttcatgaggcattagagagttattcgcatctcagatgttattttgagaattacagtaatatttgtcattaatggaatgcccatcatgtgctagacastactaccaatactttgatagatataattgtctgtcctcatagtagtccagtaactgagtataagtatgctcacaggagaacagggattgagatggggaaccatactcagtgcaggaagtgtcatcactacatgaagtgatgaaactacgttcacactcagtgctgcacgaatacagtgtgggctctggagtccacctggctccaaagctctttaccagctgtgatcttgggcaaggaatttaacgtctggctgctttggttctctcgtgtgtaaaatgaagataataatccacacacctggaaaatattgagtcctcaggaaatgcttattactcccctccacgccccttctggagagagcccagctcctgcctggtcattcagcttcttcctgggacacttcaggaaatggtttctcacccttacaccagctgacctccatctcttgcaaatgccatctccattccttgtgccctgccagttaggagcagtggctcctccctggcgaggtctatcttcctctccaggcagagttcacattttgttttctttctcttccgagttccctaactcgatccatggacttctccataagggctttgctttctctctgtgctctccgaatctgtttaaaggcaaatttcttctgtccttggaaagaccttgcatccgctctartaagygaagcgtaaatcagtgtttgtgtttgcagtgcacgtcactgctggtcacatgatggcataacagattccaaacaggtgccaaggatgattcttcaatttccaaattgcttggtttaaaggtaaacgccagtctttagctccctattgaaaacagctccaggcactgtgctttctattgttctagaggggagtcactggaattagaactgcctcagccagcactcttctatctggtgactaccatgggatgctaatgacaaagatgtagtaagtcctctagcactcgttcgcaagagaatgtcttctaggcacccagacatatgatagaatgtgctaaattggtagtctctgtacctgcttcagagtgaagcaggtaacttcagaatgaagtttaaacccaaactccactacttagtagctaggtgaccttgggcaagttccttagtgtctatgtgcctcactttccctttctgtaaaacggagtaataagagtcaatgaatccatatatgtaaagagccaaaacaaggtctggcaaatagagaacaaatctataaatgttcactgttattatttgcactgatgctgatgtaagagaaacatctcagtaaggtatagagaaattcacaaatagagagccttcaattctttaggttgagatataattaatgattcatttctcaagacatttaattttcctyttgttttctgcctgcagcctgcatggttaatgcattttgacacttctcactaaggataaaygacaaatgataaaaccaacaatttttgtccacttattttactcaaagctccgttaagaaaaataatgaaaaaaattttaatttcagtgactaacaggagtgttcgtattgtccctatcattttaaaaattgttttggttactctctattattacagagaataaagactttctgtatcctggagtttaacaactcttattttattttattttatttttgagacagagtcttactctgtcgcccgggctggagtgcagtggcgtaatcttggctcactgcaacctgtgcctcccgggttccaatgattctcctgcctcagcctcccgagtagctggggccacaggcacccaccaccacacctggctaatttttgtatttttagtagaaatggggtttcaccatgttggtcaggctggtctcgaactgccgacctcaggtgatccacacacctcggcttcccaaagtgcagggattacaggcatgagccaccacgcccgaccaacaatgcttattcttaagaaaagaactgccacagaaggaaataggaaaaattcttcttcagtagttgatgcctttcaaaatattaaattactaaacctctacctacctcagtttccagaactctaaaatgaagataacaatactacctgcattacagagctgctaggatttttaaattagaataatgaccagcatggaataagtgctaatacatattatctatggttattttaacataaacatagtctcatggattatttttttgtgctctgaagcaggagaccccaatctttttggcaccagggactgtttttgtggaagacagtttttccacggaccgggggtggggtgggagggtggtttcaggatgattcaagtgcattgtatttattgtgcattttatttccattagtcttacattgtaatatatagtgaaataattatacaagtcaccatcatgtagaatcagtgggagccctgagcttggtttcctgcattagacagtaccactggggggtgatgggaaacaatgacagattatcaggcattcgattctcataaggagcacgcaacctagatccctcgcgtgtgcagttcacaatagggttcatgctcctatgagagtttgatgccaccagtactggtctggggactggggctcttgctctgtagcattttgtggtaaataaatctgtggtttccagagcagccttcccagttgtaattaacatcaattggccccactgtgttgaaagcagtgctgcttctcctgcctcccagttttcctacaaaagccactgggattgtagataaaatcctgttttccagttggcgagatgcagagaagcagatgagattttgtctgagcagcggtggatctgagccgactttgattatggctccaccgccaacgcttcctgggcagatgagtcatgcttcctggaactgtctgtcagaggaagtttgcttctgggacttttgcattttgcttagagcttagagataagctattacaattctaagttcagctgctattcaaaaacatgcataaaagctgggaagagtttaccaaacatttcaatttataacttgataccagatatgagtctagcaccgtactaagcatgatacctggattcaaaaaaagtttagaatgaagtatatccattagttagcgaagccagatgctttgtagtgtcgttgagtttagcatgaggcattttagaagaaattttggttttaagattgcctgagtaaaatgtgattttttagttataaaaaattgaaagaagaaatgttatttcagtgtgatcagaatccctttccttaaaaagaaatgctgatcttttctgaccatctttcacaatgaaggattttcgtatgattgcattaatttgcagcagttaatgaaccaacgttccaaccttcaaaagagcctctgctctcagattcaaragaaactctgcgtgtttcctctcttcaaacatgaaggacagaattaggatgaataataatcaaacctaaaataatttctgaactaccctgaagcagtaaaaattccattagatgctcagaacttgaattgtcctatgcacactgcctttcctggttgacctcaggttgctctgctcctcagactggcgaaaggcagggcaaccgaaaggtctcttccactatcagacaggctcatggtatgaataagcatgcattgagcaaaatgctaaattttaaacactggtaatcacagttgtgggtttcagttaactatattgactttctactttttaaaatgggaaagatttccaattgcaacattacagaattttgtttaaacacgtctttaccctgcagttcctacattggctctttatttatttatttattattttttctttctttctttctttttttttttgagacagagtctcactctgttgcccaggcttgagtgcagtgttgcattctcagttcactgcaacctccgcctcccagattcaagtcattctcctccctcagcctcctgagtagctgggattacatgcgcccaccaccacgcctggcgaatttttgtatttttagtagagacagggtttcgccttgatggccagtgtggtctcgggctcctggcctcacgtgatccacccacttcggcctcccaaagtgctgggattacaggcgtgaaccatcgcacccggcaggctctttatttaatagactttcttttcctgatctcactgtcttcagggagagcccggatggcagtcctctggcttcttccagctcaaaggtctatgatttcacgttgttctatgaaccaggttcttctctgttcctgagaccatctgcagcaggtggtgagaattttaagaggcwtaataataataataataataataataataataataaatgtttagtgttttactgtagcaggataattggcagagggaaggctgaggtttatggaattaaattttcatgtatacacaggagagtatgcttagctttcaaagcatttcacttaccactagggagggatttaggagcccttgctccatcagtgactatcgaaacatatgtttacatgaaaccgtcagtccctgaacatctgaagacattattatttttaaaatttttaatttttgtgggtaattaataggtgtatatattatggggtacatggtgtgttttgatacaggcgtgcaatgtgtgatagtcacatcatgggaataaagaaataattttttgtaaataattagcctaattaataataaaaatctagttatgataaaaggaagcattataggcaaaatatgattttaaattaatgctggagcagattaccttacatggtaacatttcagtggattaatttttacatatmaccttgagatacttaagaaaagattatggagatagacaatttaatatttttagtaggccaggtgtttatttgacagtctaaaagggtatgaaattctgagattggagaagcattactaatgcatatctctactgccatgtcaataggtccccaaagatattgctttaaaaataaatttatcagatcacaaaggaatttatagtcattataggaaattgggaaaatgtagaaaaagctagattaaaaaatcctaaattatatcattattactaatatttggtggtattgatttcctgtcatcgctccttgtatatttattttattttaatattcgaaggagattattcagtacatactaacccataatgacttttttcacctaacaatagcttgtgactatttccccatgttatttattatgtcattttcaacattgctcatcccatcatcacaatacagccaccaattcctgttgtgaaacacttagaatcttttcaaatcttcaccattagaaacagttctgagataagtatctttgtagttaaatgttttcccacacccatgattggacaatgatttaaaaaataaaaagactcaaattgtggcttctaataggagtaatatatagaaagcagaataaaaatgtaaattctagtaagagcagacagcaactagccaccacatagaaaggaaacgctggtttttatatgagacagacctgtaactcagggtgacaccaagtaactcaaaatgtggtatttcgatgggttttttgctctcatgcaaagcccaacattatgagtaattgttacttttagatgatatttcatatttcctgccccaccctgtcagcacatggcaaggcggctttttctgtgcctatgtcagggagcatgctatgagtggccatgtgccttatggaggggacttagcctcccaagggccatcttggagtcggctgggatcaaccatgctctgcttatcagccttcctctacatttgcctcatttatccaccatgatttgattttgcatttgcccccttgggctttgcttatccacaatggaagcgctgtatctcctctgtgattcttattatttatttatttatttttttttttgagagaatcttgctctgtttcccaggctggagtgcagtggtgcgatctcggctcactgcaagctccacctcctggggttcaagtgattctcctgcctcagtcttccaagtagctgggactacaggcgtacgccaccacacccggctaattttttatatttttagtagagacagggttttgccatgttgcccaggctggtcttgaactcctggcctcaagtgatcacccgcttcggcttccctaagggctgggattacaggcgtgagccaccacaaccagcctctgtgattcttgctttgcaatttctactgttgttacaggaacatttcaaagcccttcaaatttaaagtaacctraacttggataaagttccaagtttttccaggagatgtgagtgcaaacctcagcaacaacatttttaacaatcaccctaatgaggcctctscacagatcctgctgtggtggttgtttggggtggggaacatctgagcagatgccctgagaattccctaggtcccatccttctggatctccagtgattcagcagcaggaactacagggctgggtaggacccaaaggggaagggaggctgcaacaggaagagatgctgctcacttttagcatgagagccactttgcttgccagtggactctatccacctcaccgtggcagccttaacagcctctggtttcctaactctctttgctgctgtcccctgcatgatctgtcctcccgcaatcccttccacacacacagcatgcttatctccaccccacacaggatgattcgccttggtttctgcatggctgtccgggatgcctcagtctccacaatgcccaagttgtcatagcaacacactgcgaggattggcctccacctcctcactgaattcatcacttccccatctgccctaccagtgacgatttctgtgaactcttttatgtgagtcagctcctgttctctaatccccaacatctttcttttctcatagctattttgggtggtttctctggaaaaaaatgttgattccctttgcctctgacaaagagttagagtaacaatttgagcacattccacatgccaggcctcatagcaaaccttttacgtggtttatctcatttgctgttggcaacaatattatgagataagtaccattatggtgccagatttatagataaagacattttagcttgaagaagttcaataattttcacaaaattgtgttctctaaattttagagctgggctatgaacacagagcctggctctggccacattgacattagtcaagtacattctacaataaaattgctttcctgcttgtgattgaaatataatcttctattagtgacactcacttcaaaatgccactctataaactgattgagtatagttctcaaaaattgaacgatcatcttttcattgagtagaatttttattctatagaaagaataggggattctctactacacccaaaatttctcctcacagcagatgaattatttcaattacatattaagctctaaagaatagaggttttatggaatttgcaaagatttataattggaaatggaccaaattattctccagaagtttctccatgttttaatgatatcatcctaaagaaactcttgagttgctttttctacatgaactatatttaattaattcttaaaattgatctcctataaaaaagaattttcttccagaagaccttccaggaaataaaagaaacaacatttacaaacagtatgaattagatgtcaatctaaaacagaaagggctgagttttaattgtcactcactgtgattctaaaatgagtttggggctgggcatggtggctcgcacttgtaatctcagctctttgggaagccgaggtgggcagattgcttgagcccaggagttcgagaccagcctgggcaacatggcgaaactctgtctctacaaaaaatacaaaaaaagtagctgggcatggtactgcatgcctgtagtttcagccatcaggaggcttaggcaggaggattgcttgagcctgggagggtgaggctacagttaaccttattgcaccactgcactccagcctgtgcaacagagcaagatcctgtctcaaacaaacaaaaaaatagttaagaaaaaaagttaatctctacatcccaagctcatatatataagataattacttgtaattttaatttattacagttttaaatttttagccatgaaacaatttagcaagcaaggcacttgaaagacatatttttgttcttggagatcctgcagttcataaagttgatttctactgaggggacaggtggggtgtctgggtctctgctcacttagaacttgactttcagtgactcctaagtaccctcaatcttacaaaaaaattggatctctatcagtgattgaccacacgtggtgtctttagtgttatatcctcccctttgttatgggtccttcctatttagaagtccacggatcacttcctattgcaactggagtctgaattcactaatggtattgtaaagtatgtgccaaattatcaaacccgcacaaaggaagtagaaactggtaagtatggctaaggcaagagatttccttcctctctgagtgtgtcaagaggagttgagatatttgggggtagggtgggggtggggggacctaagccackaaaatcctaaatgaataatctctttaagagaataacaaaagatttcacagaggaaggttttgtaatatacacatctccgcatctgaagatatatttaatggccaatttgaaaatgtaagcattattttagtaatttagaaaaatacccctaaacacagttatagaaattagatctgcatattcaaggtgagaatcgcaatctttcttagtttttactagtttcctttctgtaactcaattagaacttcaagtattgttcactctgagtagatcttcaggctctctaaaagcagggccactccagcttgcttgtcagtagttgcaatgagtcacagctggaacgtcctgtggttaacattctgctctgaaaacagaatcagaatcagtgagacggctttccatggtaacctgtatttgtatactttgaaaaatgactgttcctttttgtgtggttttgggtggtcaatttgcgcgggaatgaattgtagaggtgacgttacccatctgtgtgaatataaacaaaaaacctgattttattaacggcaaactttaaaaaacgaggtatgagtttttttttttttccttttcgagacattgttctacacatttattactagattggacattatatttaagcattttcataaatgtctatttgatgcttattttaatgcataattttctccccccaaaggcaaaaagaaactaattgtcattcatcagtgttgccccccaaacctactgcctagcccctccacccccacccagtacttttacaatgtgttattaaagaccactgaacagctgagatccaggggtctccttcaatgcgtaatcccatccagaaggaaggaaaaaaaagaaatctctttaagtcacgtgaaaatgccacrtttcttaatcttgcagagctgacaggcaaaaatgctatgctgttcatgaccttgtgcaggattgaaatataattycgcaacatgctgcgacctagtattccgtaagacacatcgagcttagggtgattatagttatggagaaatcttacctatgttttgttggataagggttatgatgacttagcctgggctcagaggcctgacagaaatgaaataatttatgctttggtcactaaattacaatccaaaggttaagatttggggagtgaaagatggtagagcatttgcttgctaattactccactacttgggagcagtatgtttgtttctgtgctaattagtttagaactgtacttcatgccctagaattaagaaaaactctaaagctgagatgaatctcctgcagggaagcagggatttagaagcacaggctgcaaggttggcctctcgccctccggtttctccgcctgcakgagagggtgggactgaacgctaaggtgaaaagcttctgttccgtttcgtttccctcttcattttctgttgctttattcttctcttattctcccctattcattataggggaggcttctgataaatgtgtagaataytagaaacttgataataaatatacacattcaaagcagcagtamgaaaaacagaaaaaaaggaagctacagcagtaagcctgaaaaataaaactcatctttattcatttgcttaaaatgcttaggtttagtgctttggggtgaatgacataataggcttctgagcttgtctttttaaaaatatctgctgaccttccctgaaatctcacaagcacttatgatgagcagccgatttgagaactcagcgagacaggccaaggtttaaaaatctgcgatttatcataaccttaaacaaggccctcacctggttctcccttctacggagtggcacaaagggtccaaatcctttatggtctaagaggagcctgttgaaattgaggattgtatggcactactacctatctaactgtacagagtgcaaataatcgtgcagattgggtcctaagtaaaataaatacagctggcgggggaaatcactgcgttcattcattggagatgcatggggaacctgcctttatcaaagccctgctctgggcagtgaggggaaggccagaggtggtctgtgctttaaggcgactcacaatcagtaggggaggtaagacacacaagcccataacaagaatgcctggggatgtgatcatttccacaaaagaagcacagatgaaaagcaagggctttcaaaggcagactaatttatgcctgactgcagggattaggggyggctccatggaggtgctttgtaacatttggtggtaaagttctccacactcaaatcaatatgtttcaaacaatatttcatgtcataacattttttttcaatgaaaataatttgatcagtctggaattcattgaatccagattatacatttatgcacggacacgtgcaaacacacagacactcacacatactcttaagtagatgtactctccaagggcatcctcgaggaaatccatgagtccattaccaggtattttatgtttcgttgtcatgggcagcttatcccaagggtaactggaacaaagtgtttaaagggaacatgaaggcgattaggtgaaaatgtaatggccttagtcctgaggaagccagtcttgttggattgccattatctttctcaagtgaagagatatagtagagagatttttgtgttttttaatttttatttttcagtttggagatatacagctgataaaatcattaaatgaggtaggttaaggggacacaaccttgcaccctccatttctccttgaagatgtataaatacctcaatggaaaaatggacgaagacatcagtaaacaatttacaagagaagaaatctaaatgcccctaaacatgaaaaaaaaaatccttcaatgtcaaagtaattaaaataacacaagttaagacaattacaaaaaggcagtttttcactgtcagtactagtttaaaacatgatcrtcatcataattgacaaagctccactgaaagaaacacctctgttaactgcttgtgggaggataggttggtataaactttctggtaagaaatttaataatattttataaagagccatatgattatactgtttgttattccctttctaggaatcttttaaaagaaacatttgaagtatcaaacagctatttatatcagcaaaagattggaaatatcttaaatgaaacaacaatagaattataatataaatacattatatttgtggcattttacaccaaggtttacacaattaagtgatatgttcaatgaaaaacaagaaacacaattaaatacatagctcaaatgtataaacacatatatacacctgcacaaataggtatattacacatatatacaaatgaaaaaagtatcaagagaaatttttggatttaatgaaatattaacagtgtttgtctttagtcgaatcaatrtttgtattttcctttttcatatatttctaaaatgtctgattattttacaggtagcatttattttaaaaattacctcttgaagggatggctaccccattttctatgatgtgattattatacattgcatgcctgtgtcaaagtatctcatgtaccctataaatatatacacctactatgtacccataaacatttaaaaatatttttaaattatatcttacaattataatagctgctattcattgagcccccctatgtgttgttaatatgtgaatgcctactatttccgtattctgagcctgaattatactttggacttgctaggttgacataaaaccaaaagttactagttgggtttccaaatttattgggcttaggaatcagatccatctctaataccctctctatgcaatyatcaatttttaattcttatgttgagttctgtgtactcaacccacctcagcagatttacctctaacttttgaaccaaggaacagcttttgctacttgtgtagacttggatttttccatcccacaaaccatgtgtttttatatgggaaagtttctcttcaatttcagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacggtaagccaggtgctgatctcagttgtatttgcagttgctatttggccaagaattttttctttttcagttccaaacttagaaacaataccatgaacaaataatggaacccaggtagtaatctcatgcaagggtttaagaaatatacttagayattggtggaacttggagagttaagtctgttaggattaagagaggaagtgacatcaaagtggaaagaatttggttaattgtaggtgtagtaataaattgccttagataaagaaagaagcagaatgaagtttctagggatgaagagttgaacctgggtatagcaagctaactgcaagttggggtgggagtatctcaggtgcaatggaatagaatgagacttaaggctcaccttgacgttaagcagagaaagggtagggatagactagaaagaatgaaagtcagacagggatggggaaaaggaaggggtagggttggcctgagaggaggagaatttgagctgcgatgcacaaagccaggggcatgtgttgtacttgtcaaacaggaaggggcacatctggatcccacctacgaattggtggttcaggaagcaggtagggatcatcattcctctgaagatgaaaggtcttctttaacaagagatctgaaatgtcttcaaatctcaggtgggccaatctgcaagtggagagccccagagcagtggttcccaaaatgtggtccctagagagcagcgtcagcattacctggaacctgttagaaattcaaattcttgggccccatcccaggcctacagaatcacaaactttgaagtggagcccagtaatctgtgtcttaactggtctccctggtgattaaagtttggaaactactgagaggtgaagccggctgagcttctgggtcaggtggggacttggagaacttttctgtctagctaaaggtttgtaaatgcaccaatcagcgctctgtgtctagctaaaggtttgtaaatgcaccaatcagcactctgtaaaaacccaccaatcagcgctctgtgtctagctaaaggtttgtaaatgtaccaatcagcggtctgtaaaaacggaccaatcagtgctctgtaaaatgtatgaatcagtgctctgtaaaatggaccaatcagtgctctgtaaaatggaccaatcagcaggacgtgggcagggccaaataagggaataaaagctggccaccctagccagcagcggcaacccactcgggtccccttccacactgtggaagctttgttctttcactcttcacaatgaatcttgctgctgctcactctttgggtccacactaccttaatgagctgtagcactcactgcgaaggtctgcggcttcattcctgaagtcagcgagaccatgaacccaccggaaggaaaaaactgyggacgcatctgaacatctgaacaaacaaaatccggacacaccatctttaagaactataacactcaccacgagggtccgcagcttcattcttgaagtcagcgagaccaagaacccactggaaggaataaattccggacacattttggtgacccagatgggacaatcaccaagcggtgagtaccactggacccctttcgcttgctattctgtcctatttttccttagaatttgggggctatataccgggcacctsttggccagttaaaagtgactagcatggccgccagactaaagacacgggtgtcaggctttctgggaaacggctctctaacaacccccaactcttcggagttgggagcgttggttggcctggaaccagcttccrcttttcctgtacttctgggctgagctgagggttgacagagaggaaagccattcagctctggggtcccaacaacaagttggttggccctgcagccatgagtaaaactctcaaagtcatgtcacccaagcaagacttgcccatctatcctatctatcctgacccttgcctcctgggtcctaatgcctgtcagacaaatttcctctcgcctctcttctctgaggctagtccygcttctaaaaaccactccctgtctctgttgcttttctaggttctcctgtaagaatgatttctaatataaactccaggactctgttaccttctttaggcacctgggttcaccaatcagaaagacataatytttgcccaaagccccattgtagggggtactatctggaattttaggatccctcctcagacaagcaggcctatcaawagctattcctgaagctaggatatgggtagcatcagaaattgtatccttcctattcatataagtgaggacaaaaggcatcactcttccaactctggagatcccttcccttcctcaggatatggccctctgcttcatttttggggcataacacctttatacgatgcgggtaaggtcccagtactaacaagagaatgcttaggactctaacaggttttcaagaatgtgtcagtaagggccactaaatccaatttttcttggtcctccttgtggtctaggaggacaggcaagggtgcaggttttggagaatacattgataagggccactaaatctgaccttcctcagtcctccttgtggtctaggaggaaaactagtgtttctgctgctgcgttggtgagtgcaactattctgatcagcagggtccagggactgttgcgggttcttgggcagagggagaaacaaaacaaaccaaaagcacgggcagttttgtctttcagatgggaaacactcaggcatcaacaggctcacccttgaaatgtgtcctaagccattgggaccaatttgacccgcaaaccctgaaaaagaggtggctcatttttttctgcactatggcctggccccaatattctctctctgatggggataaatggccacctgagggaagtataaattacaatactatcctgcagcttggccttttctgtaagagggaaggcaaatggagtgaaataccttatgtccaagctttcttttcattgaaggtgaatacacaactatgcaaagcttgcaatttacatcccacaggaggacctttcagcttacccccatatcctagcctccctatagctccgctccctattaatgataagcctcctctaatctcccccacccagaaggaaataagcaaagaaatctccaagggaccacaaaaacccccgggatattggttatgtacccttcaagctgtaggggaaggagaatttggcccaacccaggtacatgtmcccttctccctctctgatttaaagcagatcaacgcagacctggggaagttttcagatgatcctgataggtacatagatgtcctacagggtctagggcaaacctttgatctcacttgaagagatatcttgctattgttagatcaaaccctggcctttaatgaaaagaatgyggctttagctgcagcccaagagtttggagatacctggtgtcttagtgaagtaaatgataggatgacagctgaagaaagggacaaattctctactggtcaaaaagccttccccagtatggatccccactgggacctcgactcagattatggggactggagttgtaaacatccaatgacctgtgctctagaaggactaaggagaattaggaaaaagcccatgaattattcaatgatgtccaccataactcagggaaaggaagaaaatccttctgccttcctcaagyggctatgggaggccttaagaaaatatactcccctgtcacctgactcactcgagggtcaattgatcctaaaagataagtttattacccaatcagctgcagatatcaggagagggctccagaagcgagccctgggtcctgaacaaaatctggaggcattattaaacctggtaacctcggtgttctataatagggatcaagaggaacagacccaaaaggaaaagtgagatcagagaaaggccacagccttagtcatggtcctcagacaaacaaaccttggtggttcagaaaggacaaaaaatggagcaggccaatcacctgggagggcttgttatcagtgtggtttacaaggacactttaaaaaagattgtccagtgagaaacaagccgccccctcgtccatgtccactatgctgaggcaatcactggaaggtgcactgcccctgagtgcagtggttctctgggcaagaagtccccaaccagatgatccaacaacaggactgagggtgcccagggcaagtgccagctcatgttatgacccttattgagccccggktacatttaaccattgagggccaggaaattgacttcctcctggacactggcatggccttckcagtgttaatctcttgtcctggatgactgtcctcaaggttttaccatccaaggaatcctgggacatcctgtaaccaggtatttctcctacctcctcagttgtaattgggagactttgctcttttcacatgccttcttgttatgcctgaaagtcccacacccttattagggaggaatatattagccaaagctggagctattatctacatgaatatggggaacaatttacccatttgttttcccctacttgaggagggaatcaaccctggagtctggacactggaaggacaatttggaagggtaaaaaatgcccacccagtccaaatcaggctaaaagaccccaccacttttccttatcaaaggcaatatccctcaaggcctgaagctcataaaggattacaggatattgttaaacatttaaaagctcaaggcttagtaaggaaatgcagcagtccctgcaacaccccaattctaggagtacaataatcaaaaggtcattggagactagtgcaggatcttggactcatcaatgaggtggtggttcctctatgtccagttgtactgaacccctgtaccctgctctctcaaatgccaagggaggcagattggtttgctgttctggacctcaaggatgccttcttctgtattctcctgcactctgactcccagtttctctttgcctttgaggataccacagaccacacrtcccaacttacatggatagttgtgccccaagggtttagggatagccytcatctgtttgctcaggcactggcccaagatctaggtaacttctcaagtccaggcactctggtccttcaatatgtggatgatttacttttggctacctgtttggaagcctcatcccagcaggcgactctagatctcttgaaatttctagctaatcaagggtacaaggcatctaggtcgaagacccagctttgcctacagcaggccaaatatctaggcytaatcttagccagagggaccagggccctcagcaaggaacgaaagcagcctacactggattatgctcaccctaagacattaaaacagttgtgggggttccttggaatcatcggcttttgctgactgtggatccccagatacaaggagatagccaggcccctctatactstaatcaaggagacccagagggcaaatactcatytagtagaatgggaaccaggggcagaaacagccttcaaaaccttaaagcagaccctagtaaaagctccagctttaagctttcccacaggacaaaacttttctttatacatcacagagagagcaggaatagctcttggggtccttagactcatgggacaaccccacaaccagtggcatacctaagtaagaaaattgatatagtagcaatagtcagaggctatcaaaataatacaaggaaaggatctcactgtctggactactcatgatgtaaatggcatactaggtgccaaaggaagtttatggctatcagacaaccgcctacttagataccaggtgctactccttgagggaccagtgcttcagmtacgtacatgcacggccctcaaccctgccacttttctcccagaggatggggaaccaattgagcatgactgccaacaaattatagtccagatttatgcagcctgagatgatcttttacaagtccccttagctaatcctgaccttaacctatatactgatgaaagttcatttgtggaaaatgggatacaaaaggcaggttgtgccatagttagtgatgtaaccatactgaagtaagcctcttcccccagggaccagcaactagttagcagaactagtggcacttactcgagccttagaactgggaaagggaaaaagaataartgtgtatacagatagcaagtatgcttatctaatcctacatgcccgtgctgcaatatggaaagaaagggagttcctaacctctgggggawcccctattaaataccacaaggaaatcatggagttattgcactcagtgccaaaacccaaggaggtggcagtcttacactgctgaagccatcaaaaaggggaaggagagaggagaacagcagcataagtggctggcagaggcagggaaagaccagcagaaaggaaagaaagagayagaaagtcagacagagagacagagagaggaagagagagacaaagagggagtcagagagaaagagaaagaaagagaaggagacagagagatagaaagtcagagagtgagagagaagaagagacagagagacagagagagaaagagaaagataggaagtcaaaagaaggagacaggaagagacagagagaaagtcagagagagagagaggaagagacagacaaagtcagagaaggaaagagaggaagagacaaaggagtcaaagagagagaaagggatagaagtagtaaagaaaaaacagtgtaccctattcctttaaaagccagggtaaatttaaaacctataatagataattgaaggtcttctctgtaactctgtaacactccaataccaccttgttgtcagtgtaaacaagggcataacctgaaagcactgaggccactgacaacccatagcattcctatcaaacatccttaacccagcaagtttcctaacaggggatctaaatcttaattaccatacaaaggtcccaccagacataggaggarctcccttcaggacaggatatagatggttcctcccaggtgattaaggaaaaagacacaatgggtattcaggaaactcttatggaagcagagttaggaaaattgcccaataattggtctgctcaaatgtgcaagttgttttcactcagccaaatcttaaagtacttacagaatcaggaaggagccatctataccaattctaagttaatatggatggaatgaggttttattaatagcaaagaaaaattaaaatcccaaacttacaaggttttctactaacgtagagtttgctaaaagttaacagtgtaacatgcattatcctactaycacacactctcaaagcatttctcagacagtttgcaagaaataacaaaatctgtccagtaaggatagtaactacaatcccaaatagactcttyggcagcagtgactctccaaaactgctgaggcctagaccctcctcactgctgagaaaggaggactttgcaccttctttgggaaagagtgttgcttttacactaaccagtcagggatagtacgagatgccacgcagcatttacaggaaaaagcttctgatatcagacaatgcctttcaaactcttataccaacctctggagttgggcaatatggcttctcccctttctaggtcccatggcagccatcttgctattacttgccttcgggccctgtatttttaacctccttgtcaaatttgtttcctctagaatcaaggccatcaggctacagatggtcttacaaatggaaccccaaatgagctcaactaacaacttctatcaaggacccctggaccgacccactggccctttcattagcctaaagagttcccctctggaggacactacaacttcagggccccttctttgcccctatccagcgggaagtagctagagtggtcatcacccaattcccagcagcagttggggtgtcctgtttagaggggggattaagaggtgaagccagctgagcttctgggtcaggtggggacttggagaacttttctgtctagctaaaggtttgtaaatgcaccaatcagcgctctgtgtctagctaaaggtttgtaaatgcaccaatcagcactttgtaaaaacacaccaatctgcgctctgtgtctaactaaaggtttgtaaacgcaccgatcagcactctgtaaaaatggaccaatctgcgctctgtaaaatggaccaatcagtgctctgtaaaatggaccaatcagcaggacgtgggcagggccaaataagggaataaaagctggccacccgagctagcagcggcaacctgctcgggtccccttccacgctgtggaagctttgttctctcactcttcacaataaatcttgctgctgctcactctgggttcacactacctttatgagctgtaacactcactgtgaaggtttgcggcttcattcctgaagtcagcaagaccacgaacccaccgggaggaacaaataactccgcactacctttaagggccgtaacactcatggtgaaggtctgcagcttcactcctaaagtcagcgagaccacgaacccactggaaggacgaaactgcggacacatctgaacatctgaacaaactctggacacaccatctttaagaactgtaacactcactgtgagggtccgtggcttcattcttgaaatcagcgagaccaagaacccaccagaaggaataaattccagacacactactgtsttagagtgatctagccctggaacatgtagtgcttgtgggtctcatagcagtagttctcaaccatgatgctagagctcattggtgtatttcaatcaactggaaagagaagtggagttccaagattataccaggaaccaagcatagacatctaagctgtggccctgctgtcaaaatcagggctgagctctagctgagcacacatgaatgtgtgcagtggttgactmttaacattgttcacattctggtgcactcattataggaatgtcagagctacttataactgaatagccctattatacacttaggagtgctaggcgttctgagattataaactgggctctgagtgtatgtctgttaaaatatgtatggggctttcagtatttaaaaatagtcagtggtcatccacagagctacttgcagcttgaaacgtacattaggaattcccaaagtaaatgagttgtgataactaagcttgtagaagttctggaccttcctcttcatcaagtgagtagatatttatatatttatttatttatttatcaagataggatcttgctctgtcatccaaactggagtgcagtgtcctggtcatagctcactggagccttgagctctgaggcttaagtgattctctcacttcagcctcttgagtagctgagactacaggtgtgtaccactgcacctggcatttttttttttttagtagagttgaggtcttgctatgttgcccagtctgatcttgaacttctgagctcaagcagtcctcctgccttggcctcccaaagtgatgggattacaggtgtgagccactgcacctggcccaagtgggtagattcaacctaagtcaactcatggatccgttaaatgcagggattggattgattcatctctataatacagatgatctgtagtattccgtgattctgaaacacatgattctaactagagacagtgtgaaaagagacagaaaggtcaggagaatcctgggaaatggcccagaatttcaagggctggggcattctccagagcatacgtgctacccagatgctcctgtgcacatgaaccctggggatcttgttggatagaggatggggtctggggcaaggcccgtgaatctgcatttctaacaagctcccrggtaatgctgctggtgctgctctatggaccgctctgaggaacaaggtgagagcaagtgttgagactggagaaatgagatggtagaaagacagtatccctagagactggagaatccttctgagatgttgaaagggcacattgtactgtttgttttaatgacagtaggataatagcaagatctaaagcagagagaactttcccccagggacagaagtgtagaaggtaagaaatgttaaccaggaagcctgggctcagggccctggagagtgttctcagtcctagatgcaccattggaattgcctgggagttttaaaaagtgcccatgcctgggttccaatatccagagacaggattcagttggtctgcagtggggccctgactattgctaatttctaaatgctccttaagtgattcatccgtacagtcaggatggagagtttgggagggcagtgattttgctgattactttctcctaagtggctgcttcctctcccctccaggctgttctagccttactagcccaaggccactctaaggagcttgattgaacggtcatggcaggctgtgcccagattactgtatcaatgggctcttccagccaatgtgctgaatattctggtgaaatctctgagttttatgttgggaacatttttttctaccagttctacttggaatctgtcttcctttgggagagtcaaaggcaccctctgtctattctgctttcctgtttactatttcaaaactttctcccagttgctggaaacttggagccagagttatgcaacaaaatgttgccagctgggaccagaaccgaaatataaaattgttttttaactctgtgctgctcacaatatgtaaattatacttgggaggaaacttctggaaaggaatttttagtcatttagatctgtgcaaaattgactatcatattctacaggtatgcaatgccacaggtacacagagttcaatactctgcatctgaagtaggtctttagtttgagataacctgagaaggggagcccacagagagggcgagctcttccatgggagaggtcccgccatttttgatccattggagktaaatgcaagacgtaaatcatgatgtatcattcacgcatttgttcattccacagacactaaggatgtcttttgtgccaggtactgtgctgagacgggggacacagagtgactcagaccagcaggcctggtttctactctacagagctaggctaggtgggagaagcagacatcacgcaaaaacacacttaaataaatagaaaatcaaaaccatgagtagtgccaagcgggcacacacagggcatctgacttgggcccagcaggaggtcagggatgatctccacgcaaatgagacctctgaaccaaaacctaaaaaataagcaggagttaactaggcaagcaggataaggaaaaggattccaggtagaagaaagaccctgtgataggagggagyggggagagcccgagggacctgagaagtcaagaggatggaactgagtcgaagagaaacagcgctgccaaggtggctgcagagctaagcacataatgtggctaagcgcgcacacacacacacacacacacacacacacacacacgagcagggattctgcagccatggggccaaaataaatttaaaaattactctcaatgctcaagacacacacacacaccacacacacacacacacacggggagggactctacagccacaggactaaataaatgtaaaaattactctcagtgctcaagagacacaccacacacacacacacacacacacacacaccacacacgggcagggactctacagccatggggctaaataaatgtaaaaattactctcaatgctcaagtgtaattgtaattttttttttgagacgaggtgtcattctatttcccaggctagagtgcagtggcgcaatctcagctcactgcagcctcagccttttgataaggtgatcctcccacctcatcctcttgagtagctgggactacaggggtgcaccacttcacccagttaacttttgtattttttgtagagatagggtttctctgttttccaggctggtctcaaactcctgagctaagcaatttgcttgcttcggcctctcaaaatgctgggattacaggcatgagccactgagctggtcataacattcttaaatgcatttgtgtgagtgtgtgtaacatatcagaaggaaaataattagaaaggcttctccttgcacagccccgcaagggatgttctcagaatcaggtggagggctcaggacagccccgctaaygctggtcctggagttgctcttcgtgccctggccaggtcaagtggctttaaactcctagcctcttttcctcagaatcctatcaccttgcaatcccttccccctgccccaccctccccactggactcttttctaaactgtgcagtacgatctccaaacaccaagcagagagttcaaacttggcagcgacatcatttcctgagcactgcttctgaggaagagttcctacacacttcattcatttccccagttcatacacaaacgcatttacaaaatatgcttctttgtgaacgacacaaaccttctattggctttaagaaaacggatctacaacgaggctttatctgtgggctctttctgaacatggccatgcagacatgagacaaagtaacattgcagggccttttatgcgggtcctcaaagagggccccaccctggaaataaagaaatggccacagttgccctgtctctaatcggttcatggtattcagccttgacagcattgtccagcggctgaattcagccttggaggcctccatctgggttgcagggggagggggtgggggataggggtggggaatacagaagtttccgcaggctgtgtgaaaagtggcctcccaaccagctgcacagaccccctcgcctcttctggtcgttgctcccagaagccttctttcacttagtgatggaatccagcatacaaacaaggtcaaggagctttgtgagcgagagagtgacatttgcaaagggagcgaacccttcagctgggagcttgcaggagcagggctaaggggcatgtgatcaggaggtgatgtcacccaggatttccacaaaggaaaaagtggccttttctttgggaagatagatgacatcagcctctcaaatgggggctgggtccattttatcttccttttagctattaaggagatttctcaagccttgagaagtttcagaaattagaagagaacattttaaaaaccgtgtcaacatcttttatgactggctcggtttggatgtaagccagtgccttcttractacctgtgggcatgaggcactgtaccaaagggcttttaaaaaacatctttagagcactggcagaaaaccgccatgaggtcggcagtgtttctcttaaagttagatctttgctccaggtctctttctctcgagtggtctttcattagcctttgtttatcactggtctttcgggggaattccttctcattcaaaaattttattccttttgtgacttagagtacatgtagtacgatttctgggaggttcaccctttaaagacaaaggttttatcttttgtaattctgttatccacttgtcttgtgtgagagaaaatgccttagggtgtgagggtgagtaagctgggctctaggagaagatctgctggacccagcctataatgaacaggcagctacaactgtgaatcatgttaattacatgattatttatatgtcaattacacataacctctgccagcagatattttttgagaagaagtttttcattcattcaaccaaccatccagcatatattttgggcttgttgtctaaatatagagagtattaatttgcttgggctgtcgtaacaaaaatgccacagattgggaggcttaagcagcagaagtgtgctgtctcctggaggctggaagtccaaggtcaaggtgtcggcagggttggtttctcctgaggcctctctccttggcttgcrgatgctgccttttccctgtgtcctcacatggtgttttctctgtgtgtgttcatcctgatagctctgtgtgtccaaatttgctccttataaggacaccagtcagattggattacagtccattcagcttcattttaacttaattgcctctttttaaaggccctatccccgaggacagtcacattctgaggtctgggagttagaacttcaacatatgaattttggcagagatacaattcagcccataccagaaaggaaggagatcacattcttgactttggggagttagtcatagagtaggcaaggcaggtaaaccaagtgtagaaatatatacataatccaggacgccatgggaacacagaaaaaaatagctaggacagcctgcggaagttcaaagagacctccaggcagctttgacatttgaactgagttttaaagaatgggcaagaattgatcagacaaatatctgggagaggaaggcttttctaagtagaagcagcaaggygtgagggcacaaaagttttgcaaagagcaagtccttcagctagaccacacattctctgcattctccattggggcagtatcaactccaaggaggtaaaattggctcttggtagggggattaagaaattcttactctttaatgtataaagcataaagatatacagtacataacagatatgcaatatacttgtggtattaaattttcatggttgagaatttggaaaaaaatgtccgaacaatctccttagggggctgataatgaacaaaaggtgagaaacactagggaaagggagtgatagaagttgacgcaggacacgttatcagaaaccaactgataggaaacatcacaagaatttggattttatcctgccatcagggaaagaccaccaatggatttttaagtgggaaatttagtgatgcaaacagaagtacactttagaataagagttctggcaagtagagggatgcccaagaagaggaagagactgagagtttggtgactagtcagagcagggagaaaggaaatgagtagtgggtgaggcagcgtattaaagagctgtttagggctgggtgcagtggctcacacctataatcccagcacttcgggaggccaaggcaggtggaccatgaggtcaggagtttgagactggcctggcccaccccatctctactaaaaattcaaaaattagccagctgtggtggtgcgtgcctgtaatmctagctactcaggaggctgaggcaggagaatagcttgaaactgggaggcagaggttgcagtgagccaagatggcaccactgcgctccagcctgggcaatagagtgagattctgctaaaaaaaaaaaaaaagagctatttagaaggtaggatgggcagatctgatggtggagtagatgtgtgtcaatctgggagacagaagaaggaatcatggatagctcccgttttcctgcggtrtatgatttggtgcatggtggtgccattattcatagataggaaatcccagataaagaccatgtttgggggaaaattgtgagcttctatttgaacatgctgaatttgagatgttcaggggatgtatcctttcagcaattgctggtgtcagtataaaaattaggtgaggttttgggccagagaaagagactttggaataaactacatgttggtgaatttggagttgtgagcatgatgaaatatatatccaaaactgtgcaaggtatttttaggcatatgaaagaaataccacgttagtctttgtcttcaagctgagcatgatcagttaggaagcaggtgtagaaaactaacagaagtgctgaactgtgaggtgcctattgcaaggctagtaaggaggctggaagtcattggggaaaatcttcacggactctgtgagattttagagcccttgaagaatgatcaggacaagaaatgacagatggtgcctggataagcatgagccaagaaagagagagaaacaagcctgatgtaatgaagacagtgggatatgaggcttcgtagacctcctgggctagattctttagaattctcaaagccagctagactagtgtgaacttaacgtagtaaggaaaagggaaccactgttgttttagacaatggagtgggaaatgtcaagggaggagattacaactggagacatcatagatcacagtgacagaggcaaccccaggggaccattctgggtcctggttactaagagcgaggaatagcggtctgcagagacaagacaactgatgatccaaggtgagtaacattctgatgaatcctcagcaaagacactcaagggctatgtggccagtgctgtgataaatcctggcacagaaaatattagatcaattgccgcattctctcttcctaataatttcttcaaagttataactttgaaatacagactcatgattacctaagttttccagtttgaaaatgattttagggctcttttttgttattgaacaaaaaacttttgttgaacgaaaaaattttattgaacaaaaaatgttcaatttaaaatttttattattgtgtgtccttgctgccacgtggtgaaaaaattcacaacaatctggaagtatgatgttggcaatgaaagtgatttatgaattgtggtcagcaaagattctagcgcaggttcacagggctgggctgtgaatcacactgtctggttctaatctcaggcgcagaccttctctccgtwggtaatggaattgctttcacagtgtcgcttcctgctaggctgtgatagacataatgtcacacagagagaaatggtaaagcacccatccatccgcctccaaagtaacctcaagaatttgatgtcagataaggaaatcctgcttggttttggtagaaatttaagtaaaagagaagcttttaaaaacaactagctctgtttaagttaagagatatttccctaaatgctgactattctttctctcacatttatacatgctatatcccatcctgtttatgatggctttttcagcctatttgatattttgggcttttgtctttgtgatactcttaaaatatttttaagcatggagactggaaatgagttccttcttagtgtggaaccaaagcacaggtttctgcatcgtgatactgagtctgatttgtatttatgacaaattttcacttatatcttttctgcaaagaaattcttaatggacgatgctcatttctaagaaatctgtttctaaataactccttgttgtaaagttgggatagtgactaagaaaatcccacagctcttttggccttgacttcagagtttctccagcaaggtcccaatgatcagaggcagcattaaagctgtgcatatgcagacctttcagaatgagtggaaaagctcactcctgacatttctgcctccttgacgacagcagtaaatacacatccacacagttgaccttcatctcatgttggctctgagtctcttcaccagcaagggcctctcaggagtctcgcctccccattcccatgtcgccactgtttgaaaaagttggagttctatttctattgccactctttgaaacagttataaaaagaaaaaaaaataaccctcaaaccaccatgaccttcccaaatcacagattgcacaatttgtaataacagtccttgagatctgggccaaagaaagggctttctcgaaacttctgtttgtgttctggttccctggcaacaatatccccaatagaggaatgcatgtactttgcaggggattccacactttttcgtatgacacaaaaaccaaaaccacacttttttttttcagtttcaaatatcatagcagccaaaaatgaagtgtagaaacttgagttctaagccaactcagaacaaatgtgacgttcagcgtagaacctgaatttttgtccccagaggtttctcttttcgaccattgacttaaatgttgccatatttgtttcaaacattacatatccaaggacttgttttgtgtgaatgcactgtgtactcagaggaacagaggaagcagtgccaggtggcagcagcattgtctcacaaacagaacaaatctggtggaggacagtaactaccacttataagagttagtagaatttgataatctgtagatcagtaatgacaataatatactctgtccctgatttttttctcctcctagttccacaggctactcaaatatagactattttgaccctgtgtaccaaaataatgmaattgaaggaatgcaggataaataatatagattttaccacctaaatgtaatcttaaatttgtctgaagatattatgataaaaataaactatcttgccatgtaaagagtgaatgaaaatatgattaaacgcttagtgcattggtttaattgacatctcattcactattactgttgttgatgttatcattttaaaacatgactcaacatgtgtaatttaaaaatatgatcttgagaagtgaagccagctggacttcctgggtccagtggggactcggagaacttttctgtctagcttgaagcattgtaaatgcgccagtcggcgctctgtggctagctaaaagtttgtaaatgcaccaatcagcactctgtaaaaacagaccaatcagcaccctgtaaaacggaccaatcagcactctgtaaagtggaccaaccagcgctctgtaaaatggaccaatcagcaggatgtgggcggggccaaataagggaataaaagctggcctcctgcgcaccagtggcaatccactggggttgccctgcacgctgtggaagctttgttcttttgctcttcacaataaatcttgctgctgctcactctttgggtccgcactacgtttatgagctgtaacactcactccaaaggtctccaccttcactcctgaagccagcgagaccagaaacccaccgggaagaatgaacaactctgcacacaccacctttaagagctgtaacactcactgtgaaggtctgcagcttgacacctgaagtcagcaagatcacgaacgcaccagaaggaagaaactccrgacacatctgaacatttgaaggagcaaactccggacacaccatctttaagaactgtaacactcactgttcaggtccgtggcttcattcttgaagtcagcgagaccaagaacccaccggaagaaaccaattccgaacacaatctcatgtctcatcccaataattttcttaaatgagcattatcattcccttattatggatgagaaaactgaggaagaagcctgagacaagttaagtgatgtgtccaaacttacacatccactaagcaatggaatcagaacacaaaactcagtgtgtgatgtcaaactcaaaggccgtgcaataagtagcacgatggtgcctgaaagcaaatattttttccccacagcttttcattgcaaaaaaaggtcaaatgatattgcaatgcaaagaaggtcagagcttatagtaggtaattttataaattcccgtaataataaatgtttttaaaaagatgtgtgcaatcttacccaagtaaatggtgatccagtttcaaaggcttcccactaagtgacacaattcattctttctttaggttcaagtagcaataatatgtgggttggggcggaggggcgcattgctwggcaaaagacaagttcgaaatagctgatgttatttgcaatccttaaacacaatttctgctttattactcatttataaagtgctgttctggagctgctatatatgttgctgatggaatccaccgatctgggagaaaccacggagatcatctggtcagttgccaaggtttagttatacaaactcgcttacaagagggagaagttatattaaagtgaagagtaaaagggtagctgctcccagaacaacttggccrggctagagtggaccatgggaatggggtggagcatgtgaggatttgggtaatttagttgtttttcttcccctaagctaaggacccaggctggctggatgcaggatttgccctgcgaggggcctgcagcatgggatgttgtaatcagagaaaacaaccttgaggctcagatttggacagagtttaaagggtcacagaacaccactgccatggacgtggtgctgcccacctgtgtccatttctccgggtggagtcctctcmctgcagagggaaggttagaggttggaggaggtgagggaaggaatcagggagaggcctgcaatgtaggtccctggaggctctttgagcttttccctgcaagagccctgtgtaccaaaataatgaaattgaaggaatgcaggtttgaataatatttctaaatagaagtatgactgttgaacttggaaactgcctacagagaacatgttttctctgtctttgtttgtttgagggatttcataaagaagctttcagtagccttaggcatgactgcttatttcagggaaggttagtacagttatcttagtctcatttctttccttgtacctttttatactaaactttgtttagaagtcttcaatcatttcaaaaacatccaaggagagggaaaagagattgatcaaatgattgatttctcctgaagaattgtaagcaagggatttctactgggaaaccattttttaatttgattgaaattagtagcttaaaaggaaactgataaagttaatcaaagtgaaaagatgacaagattggctaacttctctaggttaagacgaaagatagtatccttttgtatacaggaaattaaaatttatattacacagaaactccaaaattatggcttctttggatttctttctctttgatgatgtactaaagggaaacacatcagtatttagatctaggccatcttagatagtcagatggctatgacagtcttaactttgagtatttatatgacatcttgaataggaatgtaaaggtcattatatagcggtccacagcattgatttctaagcttcttgtatctgttttccaagtcactgacttcatgcaataacttattctttcactgttttttattgtatctctaccattgaaacccgatgctctactttatatccactgctgtatagaaattagtcgaataaaatggattatcacaaaatatggggcaaggatgaagtctccatggaacatgaaactttctaaacgttcattgactctccaacactaaaaatcgttatgacttaactccctggttcttgggtttacctgtttcttcctgatgtgatacctggccctgtatttgctgctagttttctcaacaatagaccttttctgttttcatgaaaatcttacccttgaccaaccatcctctaaacctcaagatgacaaataggaagtaataattacaagatggaatacagaaagtttacaaatgtgcactccttgaataccacacaaatagttgttaccattttgtacctacctgggagtttggccacctcaattatcagggaaagaatgaggatacattagcttcttagggctactgtaactaagtaccacaaactgggtggcatgggacaacagaaatttgttctctttattctggaggctggaattccaaagtcaaggtgttggcagggtcatccctctgacggctctagggaagacccttccttgctgcttctagcttctgttgattgatggctgtctttggctttctaagccttgtagatgcataactccaatttctgcctctatccacacatgaccttcttccttcttggtgtctgggaccaaatttccctcttcgtataaggataccaagaatattggatttcagttccaccccaatccagtatgatctcattttaacttgactgcatctgccaaggccctttcctccaaaaaggtcacagtcacaggttcctggtaggcataagtctcgggggacagtgttcaacccaatacagggacaactctctcctctcctggagtcacgatgttttgtcctcttcttccttttcactctcttctttcttccttcttttttctcaaggaaattttatgttccttggcctttatattacttgattttcttctttgatttcatctcgtgatcactccagtttgtgtccccttcctcacagaatacatgctatctgactaaatccctcagaaaaatccatctgcacatgcttcatgtccttatgaatttgaggagctccacccttggccttgtgttcagagaggactagtgaccctagtaggacagatgcctatcacttggccacatacctgtgaaatgttggggaattaactggtaacatcaaaccaggaattactgactttttgtggttctcattacatgccagtcacctttggacaactttggccattttaaggagcacatattcctgtccacttccccaccctccctgacctgaaagtttctgttcaaaatccttgtaattacgtttttttatgtttcatagatgtatcggaagtgaggcctgtatactcactccaggaaatagttcactttgccttgggttgggccttccccagattctgagctcttagttaccaattcacatcacacctgccttaccaaaagggtccttgctggcagtttctcttctgtgtcctcccttcctccacaagctgcctttttttttttttttttagatggagtctcactctgttgccaggctggagtgcagtggtgtgatctcagctcactgcaacctccacttcttgggttcaagtgattctcctgcctcagcctcctgagtagctgggactacaggtgcctgccaccacgcccagctaattttttatatttttaatagagacagggtttcaccatgtttgccaggatggtctcgatctccagaccttgtgatcggcctgcctttgcctccctaagtgctgggattacaggcatgagccactgcgcccagcccacaagccgcctttttacacaatgaaggcaaactggccttgccaatgaagcacatctcaaggtcttatagagcagaaagagtttttattgttaagttatagaaaaaaagctattaaaatataaattgagcattttaatgaagcacgtgaacatcctcactaattacttttaaaatttaattctctttcactgtgccttggcttttggcttcgttttaacagcaactgttgatttcccaggcatttcctttaggaatgaagggataagggtgggagggtgtcggtgatgaatcacttctctcttccttttctgccatcctctttgggctttagccatgtgtatttcaagatgttattcctcctgatgccatcagtttatggcatatagtttcaggaaaatgccagccagcaaagcgctgactgcatttgagcagtcgccgggcaatacagcakttactttttaaattttgtgccttggattccatttagctgtttcattactggtttgcttttattaaagctcttatwaaaaaaacacacagatacgaacttaaagatagtacctacataggagattattattaaatgtttcagtactggaattttataactcatggcttgttttggacaaaaaccaaaacaatattagtgaagttcttttatgaaggtattttaagttatctacacaagtaagcaggtttagcaacagcttgtaactcttggttgttatgagttcagcagatcaatgtgcttcctgcagataaagcaagcacttcctttcggcagatgagtgagagtttggaggaaaatcaaggcaaacagatgatcagtcaccagctctaaaacttttataaagattaactctttaaaactgaaaaacataggcttctcttcagggcattattttattccagttcagctgatgtctaatgatgtattctgttagattttgcctcaaagtcaattaaaagatttttgctttgtttacgttttccaggttgctatggtgattgtcttyagtggagggacaggacagtaatgagggcagcattcaacattgttagttccgtgcctttgagctgaagttctcggcaaggcatgggggagagagaacacagaagtggaggtcaggatcggggagggtgggtgtcacaatagggttttgtacccacatctgccattcactaagtgatatgagcatgttccacagctttcttgaacctcactttgctcacctctacaatgggcctgacatcattgttacctgcctcccgttgtcatgattaatttcaaataaaataatgcatttcaaataaaaataattcaaataaaataaaagcacttgagaactgaactaccataaaaatatggattgtcttttaaaaaatttttgtgcaccttaatgaaaaaccaatttcttacctcttctctagctattcatgatagctttttaaccagtaattcctcttctagctccaagtctttgtctcaaatctggggataaagtcttgtgaggatacaaaacacggccaggtgtggtggctcatacctgtaatcccagcactttgggagggaaaggtggatcacttgagcctaggagttcaagaccagcctgggcaatatagcaagatcctgtttcaaaagaaaagagtaaaaaaaaaatgtaaagatagaatacacagcatgtgtgaaaggattatgatatgcacaacatttagctaaaaactttggattgtttcattcattctatgtaacaaccctatgaagtaagtattcatacagctatagatgaaagaaaggttagattacttacctaggaactatcacagccagtttaggaacccatttgtctgaactacagcccatgcttcctctgttacactataatgtttccaaaagttttgcaatctaacatgccaattaagcagttctaaaatcgtgtctactccatgaaaactttctcttaccaaagtgacaaagagccactgtgtctatttctctcaaaactctttattcctcatgtcactgttcctttcttggttggtattttcatctttttcatttttgagacggggtcttgctctgtcgcccaggctggagagcagtgctgtgatctcggctcaatgcgacttccacctcctgggttcaagcaattctcctgcctcagtctcctgaatagttgagattacaggcgcatrccaccacgcccagctaatttttgcatttttagtagagacagggtttcaccatgttgggacaggctggtctcgaactcatgacctcaggtgatctgcccaccttggtctcctaaagtgttgggattacaggtgtgaactaccacgcctggctggtattttcatcttttaaattatcttcttttatcttcttttgaaaggcttttctaaatcattgtcatctattttagattatgaatgaccggtgttaaaaacttctgtatttcttttacattttattgttcattcaaccagacaggtaaccggatgacgacaaggatgttggtggtctaaacatccctgcctgtgttatttcctgatgggtattggtttatataacttctttcctctccagacttgtgtattctccatctctttttcccttccctgtttgttatccctttgtcatgcatccagagtcgcaaatatgactggtaatggcaggatgagttatttattcttatttgtaacttaccagtgattaacatgtaaaggatagaatagtattcaggttgttttcttcaaataaaaacttattgaaattactcttagtaaactgaaggagaagcaaaaagggtttaataacttgcaagaagacatgtgggcaataacactttttatgtctataaatgtctttctttttttcaagagatattaaatatgcttggcttctatagcactgcttgtattatgggcagatgctcaataaacacttatgagtgaatgaaggaataaataaatggaaytgggaagctattttacctctttcaaattttagaaatacgaagacagttaagtttctaccgtaattaccagaattacaacgtgcaggtttgttacatatgtatgcatatgccatgttggtgtgctgcaccctcctagtactgtataattttgaccagaaagtaccactaaattaatctatcctattttgcatttgctgtgaacttttaattcaaatgtttccttttgatatgttaatcctcagaggtagtgagagcatgaaggagaaaaagaaaacttcagagatttcaagccctaactgtttctttccctctttctcatgatcatacaatatttttcctgacagagtatcactkataaaattgaaatttctcagctgggcatggtggctcacacctgtaatcccagcactttgggaggccaaggcgggtggatcacctaaggtcaggagttcgagacaagcctggccaacatggtgatgaaaccccatctctactaaaaaaaaaaaaagaaaagaaaaagaaatttttctttaagaagcatacatatatgtgctattaacaagatatacttaaaagtaaaattttgctctttttattaaagaaaaccttgtggattatttgctttaaatactaggaaaaaagacattgtgggtccatataactatactgtaatttttttaaagcawtactgaatgccccgaatctgtattaccattccagtttacagcgacaatttaagggtattagtatcctgttatttgcgaaggaattcacaaggaaaygtaaaacaattggaaaagacaatggaaaaatgttacacagagttttatgtgaatcaactaagataaaaaaattgaatcagattggctgatgaacgaatgctaaataaaaatgcagaaatgagctatctaaactttcatttccttcttatcttttatatcatgtggccataaagttattttcctctagattttttccattggataatttatttgatactactgatagaaagaaccatctgagctgaaaatgcaagttgagaaaaaaatttcagtaacaggctttgcttacctgtaatgtattttagtaaaaggtggtacatcttaacacgagttacatgaggcactgtgttgtaccactccggaagcatcctgttatagaatgtcctgtgagcggtgctccctggagttgggcattggtacaggagatacggacaatctgtgatgattttggcttcaggaatatttgccatgtgttgttgtagtcggacaaatattttctcatcttttacggtacttgtgtttttttaagattcatcatagtctctaaacaatgtcagcacatctaattttaaacagctttttcgtaggctttagaaataaaagccggaactttttaggacacaggaaagatattgctctgtgcaatacatttaaagtctgaaaacgcagaggttttcaagtgaaaggagactgagaagtcaagaagatagtagtgctttgagctagagtcagatttctctgccgaatcaagattcttagaattctcagtgcttctcagtgcagtggggaattctgcacggagattttttttttaactccttaacttttaaaagcttttcttctaactcactgtacaggaggaatttgcatagagtggacagtagacaagatctcagacttggtgtcttactttagaagccatggtagtttaatgttatgtgaaaaatgcacgtttactcataatggagtgaggaggcactgttacttttattttattttttattattatactttaagttctagggtacatgtgcacaatgtgcaggtttgtcacatatgtatgcatgtgccatgttggtgtgctgcacccattaactcgtcatttacattaggtattcctcctaatgctatccctccccccttcccccaccccatgacagaccttggtgtgtgatgttccccaccctgtgtccaagtgttctcattgttgaattcccacctatgagtgagaacatgtggtgtttggttttctgtccttgtgacagtttgctcagaatgatggtttccagcttcatccatgtccctaaaaaggatatgaactcatcattttttatggctgcatagtattccatggtgtatatgtgccacattttcttaatccrgtctatcattgttggacatttgggttggttccaagtctttgctcttgtgaatagtgcsggaataaacatacatgtgcatgtgtctttatagcagcatgatttatattcctttgggtatatacccagtaatgggatggctgggtcaaatggtatttgtagttctagatccctgaggaattgccacactgacttccacaatggttgaactagtttacagtcccaccaacagtgtaaaagtgttcctatttctccacatcctctccagcacttgttgtttcctgactttttratgatcgcacataaaaagccttgatgaagaataagagaaggtaattggaagaatttaccaaccaataaagaatattaaaaaaaaaaaaaaamagaaaaagaggcccagaaatgttaagagcaaaaaatgttttgttaatcaccaaaaattgctgttggaaaacaagataatttcttttctaattgtgtctctcataagccttcctcaaattttacctcttctgcaaagttttctcttcctctccatactgaaatctctgtctgaattcctgcaaacgatttgagagcctgtgyggtatagtaatgaagtattaagatacaaccagatcacctcagttagtatcctagcatcaattaaccttggaaaatccacaccacctctgtttgcactgatttgctcatttaagaattggatcctaacagtacctacctcatgtggtccttatgagtacggaaacagaaaacacatggaaagcccatatgaggactcaatgaaaggtggcattattctactgtgtgccgcaggctacagcatttgattatttgttgtcatggtctgcctgaatggctttctaaggcatgacatatcaagattctgaaacacatgctgttgtctttttccttggttggatttttctatatccattgtatttttttaatgtaaatttgctgagttaggaactatataatttacttgtttatttcttacagtctttggtacaaagctaaggatttttagcccttaaaattctagttcttagatctgcacgggactgcagaataatgtattagctacaaggacactgaaggcccagggacctgaagttcacgaccacggctcacacggtccattgtacttccgactatgttatgtaattcttaccttattataataaagaaaatctaaaattagaatgacttttttttaaagtacgaaggtttgatatggtaagaaaaaggatcgagcattattgtactaaattatatataatccagtgtttttgaaaggataaacttaataagttgtagccatgatttttttctcattgttttataactgcataattataactttattgtaacttaacggttttctcctaaattaagcattgtatatttttgatggcctttcggtgagttgaatttggaattattttccaygkgctgttgcccactttgaactgactgaacctttctgttttaacaggttgtggtggagagctgtctggggccacaggctccttcagcagccccgggttccccaacaggtatccaccaaacaaggagtgtatctggtacattaggacggaccccgggagtagcattcagctcaccatccatgacttcgatgtggagtatcattcaaggtgcaactttgatgtcttggaggtaggaagtgagatggttttttcagcacattccaaagtttggggtagaacargaaatcactctgccaagattccgaattctttccagtagtcagcagtgttctattcttagacattttaatgagcatcagcccttcggtgatcatttggtagacatgggattaatgtgtggtttgggttttcctgaagcaatgcctgagggccttgcagcagctgagttaggaggtaatgccaggaagccrgagcccaggacgagtgagtgaaggaaaggaggagggggaaccagcagagggagcccctgggggcaacttgggctccatccgctgggaccttctgaaggaccacagtggaggcactggtccgccaactctggttcccattggtaaggactgcacttgggatggctaacacctcacacttgcagtctgagaaagctcccccagaaagagcattcgtgtggcggagcatagagactgggcactgccaacaagcacagggayggcctaccagggctgccgctgctcttcaaggggccgccagggccatctgccgcagagcgcttttgtaaaaaaatggccacctaggtagcatgaggcatttgaagatgaaaattttcccagcacttctgcgaagggtgtgtcttggatcattaaaacagtctttgagaatcttgagcccaaaagtttattataatcaatgtttaattgcaggaatttagtcattagaatatgtgtgtgtgtgtgtgtatatatatatatattttaaatatatagctttaaaatattttgttgtagtttataaaattatataattcattataattatataaygtactatatagttacattatttatgtaatattcttatataattttataacatatatagatatgtcccagatatatgtaatatattatgtagtatattatatacttacactataaattataataattaatmattacaataattaatatttattataacagattattatattatatattttaatgtaagtatataatacactacatattatgtaatatgttatatatagttacatgtatgtaacacatttattatgtatactttgaactttgacctgtctgcaaactttaatatcttccaaatacacacaaaaatcctgtgacctcagctctagggactgctgtagcacagcatgacaaggattctatatccagtagaacctaaattccatgaggctagatgtttgtttgctttgttttactgctatattcccagctccacagagtacctggcaaagagtaaacactcaatagatgtttgtggaatgaatgaaagcatcaacgtctctgattgtcacaccataataatgcacatttagggcactgtacagaggaatttttacctccatgttctcatttaaacattaaatcgttccatgaggtaagaggggaattttattcccattttacagtggtcaaaactaacgctcaaaaagrttaatgggcttttccatgaccacatggaaggggagtggaagagctaataactgaagccagtcactgctcaacactccagtaaatcctgagaccatagatgggtgcagggtgcaaggggtcgataygaatagtatggacgttacaggaaactttaacaaaaactttaattataaaacaagttcttaccttgaaaagaaatggaattatcccctcagtgagagtcactaggaattacttttagtaattcatcacttttagtaatttagtaaagtcatccttctcagtgagagtcacaaggaattacttttagtggctctaaaagacttaccatttctatctctgatttcatttactgtagctctacagacaatttactattgtaattgtaaatgaaatcagatagaactggaaagtcttcacggaaggactgttgccaagtcatgactccatctcagaggagaaacaaggtgcctcctgaaattcacactcacagcacaaagtaggactagcatccatgtgcagaatgttcagatggcctcgctcgcctgcaaggatattgcttggttgcataagaccccttatcacttacaaagggctggaggtggatcttccacagctatgtgcaatgttccaaaccctttattttcatactccaaagtgcatgtgattgttgcccacttggcaaattataaatgggccaattgtgtttcgggttgtgtcatacccattacgggagaaagtagagacaggggctgttccctacaagcaggcctggggcctcagggacgaaatcagggactccaggcagaagcggctttcaaggagagccctatgcctgacagaaatggctgtgagaagacgcacagtctgcttggggcttatttttattatgacaagctgacattgcagtggcctcccgtgttccaccaaaagcagggtttgggggactgttctgaggctcttaaatatttggggaaagtttttttctgaaagctaaaaggagcaaccctctgacattttgttcaaaagccttgttttgcttttctgcaaatgttcatttggaaaacgctgtaataaaattgggctaatggtggtggaatggtttttttcacccctccctagctgctgataacatgttagtagtgggtttaaaagtttgttacccatgatgggcatgtgatctaaaaactttgctgactttctcagcctgcatgtgagtgtagtcaagtggggccttacagccactaagtattgggcttacctgggtttcacaaaatttattcagaagccatttttcccttgaaaaatcagagtccggaaagtggcccattgcaaaaagcagcagctgtttggttactcataaccccggaatgctgacttgattgtaacaataaatggagctaacagagcagaaagaaatgttcaaaacagattaaaaccataggctttgaaatgtcctccatcctgagcatttgctaaaacacatttttaaatctctgatcatcagaccacttctttttcccccaaagtttagtcatatgctgtagttgaatgaaccatgccctgaaattctttccatctttttcttcttttgaagagtcatgtactatcggttttatttgtggaagccagaaggaccattgtttcggtcatggaaacactctgcctgattttactttaatctctgagaaagtctttagagagattctgaactggcattaggcagaaaaggaaatccactccttggagcagtaaaccaggacaattgcttggtgtggacagttacctcagtctggcctctctgcgataggcttttgtgagctcagccttgcaagaagggaagtaaataatgtccaaagtggcagtgtttattcttctagaggcttctgggtccagccaactcatacccattatgtttgtgatctcaaggggatgtttgagcagagaaaacaaagaatattttgccgacgtgcgagttttctttgttagaacttaacacttggcgttcagtggtctttccaaatatgtgctgttgattgggcttgggtgattgggagcacatgctgtcagtttcatgctgtggggactgtgccctaggcgagggggtagggagatcttgaaaatgggaaagaaagctggctctacacaccatgcaagcttgcttctgccatttgcatatgtgtacgtgtcaggggccacacagggctcttcctaaagccctgcttttgatgggacttggggggagtgcacaaacatcagctcctcctaataaaaataagcctgaagcagtcggtatgcttcattcctttgcaattactgtccttgtgctcagccctctgtgtaacagccgtttcattcattttggcctttaccggatggctggggggaattaatcagacaaagaaatcattatagattcaaatcacacactcctccccaaagtaggcttcttgttctcactccctctccccagagaacacttgagtgattttcctatcagtcagcagtgggtcctgagggtgggcaagggccgggggtgctgaggaatgggggcagagtgtcccgaggtgggggaaaggcacagagggagggtgggagggcgctgtgcccagatccccctgagagccgccttcctggctctggtcctgagtgcctgtacatggatggctgcagttgcagttatgaaggtctcagataccaactctttgaaaactgtctcccaaagatggtctttcttttacaaatcgaagtttgaaaagacctgaagatgaggagtcagcatcttctatttgattcccatcctgccttcgccaccctccccagccccacacatacacacaggagataaacaggacccagaggagactgagaaacctgtctgtgaggcctcctggaggcctggcctaggctmtccttgcctgcaagatgccctccgtgagcccaaggagactctttccagaggactatgtcactggggtattggattccagtcagacagacagtttgggagatttggaggagcctacgtggtctgaagtcatgtgtgatagatctagaagtgaaacaagagagttccctgaccaccccgtcgcaggacctgtgacaggggtgtggcacatctgttcggctgtggtgccctcaaaccccttatgggagggggagcatgcagattggcaggtgcaggaacccaggcaagatgctacccacagtacggtctagtggtgggtgcctgtgactctcaaagcccycatgggcaggctacagtattcttttagctctgccatccacagagggctcaagtgttaaccagctcagtgactcttggtacccgacttcctgtctggcatccaggaagaatcaggtcacacacggacttgaaggatggtgaatgtggggattttattgggcgatggaggtagctgtcattggaatggatggggaactggaaaggggatggagtgtgaagatgatcttccccatagagtttcgctgtgctgtggatgatcaactgtctgaccatccccggccaaactcctctcaacgttcagatgctccttctctctccttctctgccacgttgttcttctcctcctctgctcttctattcatctgcccatctgctcgtggagcctggagttggaggtttatatgggtacaggagatggggacgtggcaggccaaaaggcaacatctgggtgtggaaacaagaatgcctgttcccgtttagggccgtgggtttccaggcttggggatggggcctttgccagggaacctccctcttctacccagtgtttccctgtctgctgtctatatcagaaggagccatctggagactaaggcagagtctagggcaatccctgagcagaaaagtgggatgcacttagtcaggttcctgggcatgggcgtgctgggagcaggcacagggagggtgcatagcatccccttccttaggctccaaaacacacccagagagctggtatttccactcctcctaaagaagcatacgtgttatattcaatgtgtggtcttagaaaacattcagtttgcagggtaggtggaaattcctaaaaatataactgggatattggtagccttcagtgaactcaactttcataacaaaatggctttatgctaagactaatcatatgtgccagagttagaaaatcagacatttctttttttaaaggtccccctaaaattcagaaaatcgacttaatattgtatgatctgtaatgtttctgctagagaaagcaggaaagcccacaaagacatgaaaaagacaaaaagaggagatagggaagattctggaataatctactccgtcctcctctgcaattctggctgatgaaacaagcaggcattttatgggtgattgaacttgtgtgttcctaaggcacagggagtgcctttgaaaactcagctcaagtttatagtgcatccccacccagggaggctgagatttcaatctcyaataatcatagaacccaaggagccgggggtcaaaatgagccagagcaagggcctgtaattgcttaaaatattttttaaagtcttttttcctacatcccatgttagatctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggtgagtgagaaaaggaggtttcctaaagtacttaagccgagccctcgttaaatttcatgaaatgcttgggaaaacgtatgaaggctacacactkataacttagtgacatcccaaagggcagcctactgagacctgacatatacccttccctaaaatacgtgataaagtttaacttcctaagggtcaccacatatgtgaaagcaagaatgtaagtgtgtaagtccatggtgagagcagaactagggtgataggccagacccactctccaagggctcrtacctcttaaccagcctccatacctcatgccatagtacagacctttagattcttggcaaatatcaaacttgcaaacattaaatttgtgaatcccaaggaattactgtgtgttctatggtgactttctgcccaagattttaggyagtctaaataaattgcctrttgtatatttttaaactatarcaaaaatctatggcacaaaatagtgtaacagatgttagcatatgcaactactagagatagccacatttgcagaatgcttactgtgtactaggcacttttctaactattttatgaggattatctctagtccttacaaccaccctgtgagggaagtccgcttcatatcctcatcttaccagtgtggacactgaagcttagaaaggttagtgkcttgcccaaagttccacagctagaaaacgtcaaagcacatatgtgattccagactaysttatggccacacttcttcaactctatcataaccaaggtatctatataagagctctcccctaaagttaattatgtaggaatttaaataaacacacacacacacacagacacacacatttagtgtttagattacccctgaatgattctccattattagaaaatagtgccaaagttttctattattggcttatattatcataaatccaagaaatggtgggtcatagagaagacattgaactaacaggtatttgataacatcaaaggaattttwaaaaacctaagtaactgtactatatccgaatattaaatttttaaagggtagatattaaattatttttaaatgcatgcactactagattatcacaattctggaaggaaacatrttattcttccagtatgctatatttttagaggacartgaagaagcagcattccatggctttgtgaaaacgtgatttcatttgcgtttccttttaattatttttaaaataaattttggcatctgtatttaaagtgtttgaagtattytcttagtatcatccatgtcatcccttcttattctgttgggataaatggcttaatgtggatatcaaattcttcagtgtttttagcatcgactaactgattcaagcaaagtaatgtattgatctatacaaccaggtaatggattattttcgagcatccatgattcctctcatgaaataattgtgttccccacttccaggttgtggtgggattttccaggctcccagtggagagatwcattctccaaattaccccagtccttataggagcaacacagactgttcttgggtcattcgggttgacagaaatcatcgtgttctcttgaacttcactgactttgatcttgaaycacaagactcttgtattatggtaagtgacataaatttcaagcattgtctccagtcaaacctcggtcaaaacactgccatataagcatatttagtgaatrtattacttatgggtgtttttaatgtcgawtcataggaaaccaaactattggcaacttaaaatataaggacatttattttttacctaaaaacaaatcaggaagtagataatctctaggttttttagcaagtcagtttctgcgctaccattattagcctgttggcttttcattttgttgttacttcatkgtcaaaaaatggctgcagtggtttttatctgaatgtcctacctgagtctacctctgaaaaaaggaagaagcaatagtgttaactatttctgttttgtttgtgtttcttttaataaggaaagcaaattttccaaaaaagcccctgatatatcattagccagaactgactacaaaagagatccagaaagtatcrtggaatagatttatcataaatgttttagatcaattattattattaagcatctgggattttcacaggattctgcttctcttgagacaaggatatcttgatttgctacttgaacaaatccatgttctgatagaacaggttgggagatgggagtggaggagaaggaatatggctatgaattggtcagatgacaaaaagagtttctgctactgagatgggarrgtttcctkgactcctttacaggacttgcgaagggggtggcttatttgcttggctgcctmgctgaattcaggagggagcacacgaatagacgaatgcaggaaccggggtgaacgaaccctagaactggctggtccctcmtctctggtggragcaggctctgtgcacggcccacggcagcgtccaagcttsttacaatgctcttttagctctgccatctcggagagggtgtctgcgaccccaaragccccaaagggcatgtgttgcaatcagtgctcttttagcatttgccgtccatggacagctaagtgttaaccagctcagtggagggtcagggtgacagccttttacaccctgacctcttgggtacccaagttcttgtccagtgtccaggaagaatcaggtcacacgaacaaattgaagggtggtgaatgtggataactttattaagaggtagaagtggctctcagcaggaaggcgagcttgaaagaggttggaggaagtgggttgcaggagtctggccttccttggctgaactcctctctgaccatagtctccgatgtccagctccttcttctcctcttgacgttcagacacttctctcttctgtgtgtgtgtgtgtgtgtgtgtgtgtgtgtgtgtgtgtgtctgctgagtctggggcttggagttcttatgggcaccagatgggcgcagggcaggccaaaagrcaacatttgggtgggaaaacagggatggttctcactttgagtggcagatccaggcttgagggtggagcactcaccagggacctcaacctcttctaccaagcattttcctgccttctggcccatcactactaccaacacttttaatgaattcctacctgaaactaatgctttgcgcttcatataagagtgaatgaagttctattttgaaggktttttttttctttctgtttttaaattttttggctacctaattttcttttattattgttattattattatactttaagttctgggatacatgtgtagaagctgcaggtttgttacataggtatacacgtgccatggtggtttgctgcactcatcaacccgtcatctacataaggtatttctcctaatgctatccctcccttagccccccacccctcgacaggcaccggtgtgtgatgttcccctccctgtgtccatgcgttctcattgttcaactcccacttacgagtgagaatatgcggtgtttggttttttgttcctgtgttagtttgctgataatgatggtttccagcttcatccatgtcccttcaaagtacatgaactcatccttttttatggctacaaagtattccatggtgtataggtgccacattttctttatccagtctatcattgatgcacatttgggttggttccaagtctttgccattgtgaatagtgctgcagtaaacatacgtgtgcatctgtctttatagtagaatgatttataatcctttggktatatacccagtaatgggattgctgagtcaaatggtatttctggttctagatccttgaggaattgccacattgtcttccacaatggttgaactaatttacactcccaccaacgagtaaaaacgttcctatttctccacatccttgccagcatctgttgtttcctgactttttaataattgccattctaactggcgtgagatggtatctcattgtggttttgatttacatttctctaaggaccagtgatggtgaactttttttttcatatgtttgttggctgcataaatgtcttcttttaagtgtctgttcatatcctttgcccactttttgatgaggttgtttatttttttcttgtaaatttgtttaagtttcttgtagattctggatattagccctttgtcagctggatagattgcaaaaattttctcctattctgtagattgcctgttcactctggtgatagtttcttttgctatgaagaagctctttagtttaattagatsccatttgttaattttggcttttgttaccattgctcttggtgtttaartcatgaagtctttgcccatgcctatgtcctgaatggtattgcctgggttttcttctagggtttttatgattttaggttttacatttaagtctttaatccatcttgagttaatttttgtataaggtgtaaggaaggggtccaatttcasttttctgcatatggctagccagttttcccaacaccatttattaaatagggaatcctttcctcattgcttgtttttgtcaggtttgttaaagatcagatggttgtagatgtgtggcgttatttctgaggcctttcttctgttccattggtctgtatatctcttttggtaccagtaccatgctgttttggttactgtaggcttgtagtatagtttgaagtcaggtaacgttatgtctccagctttgttctttttgcttaggattgtcttggctgtacaggctcttttttkgttccacatgaaatttagagttttttttctaattccgtgaagaaagtcaatggtagcttgatggrtatagcattgaatctataaattactttggacattatggccattttcatgatattaattcttcctatccaygagcrtggaatgtttttccatttgtttgtgtcctctcttatttccttgagcagtggtttataattctccttgaagagatccttcacatcccttgtaagttgtattcctaggtattttattctctttgtagcaattgygaatggsagttcactcatgatttggctttctgtttggctattactggtgtataggaatgcttgtgatttttgcacattgattttgtgtcctgagactttgctgaagttgcctctgtctcagcttaagaagattttgggctgcgacgatggggttttctaaatatacaatcatgtcatctgcaacagagacaatttgacttcctctctatttgaatatgctttgtttctttctcttgcctgattgctgtgacctgaacttccaatactatgttgaataggagtggttagagagggcacccttgtcttgttccgggctacctgattttctaacaaaaagtttttcatctttcatttgtgtatatcaacatttcattcaaatacaaaccagattctcttggttactggatctttcaatgttagtgtcctgatagtttcctacacaagatccaactggctagcttctttcaaatttaacccaagaaaactcaaaggtttgtttacatttttccaagtagtccattttaatggtatgatttcaatattattttacaagattaggttattaatgaaagttaagtttatttatcactgtatattaaccatccaaatgagtcttcagagtctaagttggctaagcatcatgcagactgaaagcgtagaacatccagctactctcctgacaaagaccatttygaaattttggatgacatttacaaacatctttctaaaagtagccartggttcatgaggtagtgtgaagtttctgagtgaatatctgagagaggtgtgagtccagtctttgggaccattttttcctgcagggcctttactgatccacaaaggtttagcagctcttctgagagcctctcaggacaaagaggaccaaagtttgagtccagagctttgttagagtggcagtcttggtaagccattcgtatcttaggtaaaatgaaaggaaaacagccttcactgagactgcattcaatatttgagttacctgagtgaatccccaaaatctgaagccatgaaataatgagagtgaatcttgtatttctcgtgcatctaggcactggacatccagcaaaagcaatttaaaatcttcttcaaagagagatattaacattctagacatcatttctacctataatttttcatgtgtaatagccgattaaataagagagttccctgacctccgttacaggacattcaacaggggtgtgtctcatctgttcaagtgctgcakgttcaaaccccttatgggcagggaaacatgcagacaggggtgcaggagccggggagagtgcttctggactccgggccccatggtagcatctaggggtgggtgcctacaactcccagagccctagtgggcatgctacagtgctcttttagctctgccatcctcagatggcttaagttttaaccagctcagtgtcctcttggtacccatcttcttgtttggtgtccaggaagaatcaggtcacacatggacttgaaggatggtgaatgcaggggttttactggatgatggagacagctcccagtgggatggatggggagctggaaagggggtggaaagggaagatgatcctccccctggagttcactgtcccatggccgatttcttctttgactgaccctggctgaactcctctcaatgttcagatgctccttctcttctctctttctctgctgtactgctcttctgctcctctgctcttctatttatctgctcatctgcttgtctacttttgaagcctgggtttaggggtttatatgaatacaggataagggggtgtggcaggccaaaaggcaaaatttgggtgtggaaacaggaatgcctgttcccatttagggccatgggtttccaggcttgagagtggggcctttgctggggaactgccctcttctacctagtatttccctgtatcctgtgtgtatcaccaacacactatcaaagatagtcatgtacttgaggggacaatataacaaaaatgagatgtaatatgagtaagagacaatagaaacaaatccactaatatgccagatagtaaagttacctggcacacttgctrtacaactgtgattactcaactcatggaaataaaagtcaaactgagaactttcagcaaggaactgcatactatagaaagtgacattgcaatatgaagaagacccaactacaaatttgagaactgataaataccatagctaaaattaacacctcagcagaaggctttttggggggactaggcagagatgaagagataaatagtgactacagagaaacagtgaactggaagataagtcaagaatctactcagaaaaaagtatggataaaaaaaggatgaaaaatatataagagaggttaagacacatagarsacactcagaaaatatataacacacasttaattggagtctcacaaggaaaagagagatatatggaacagaagcaaactttgaagagctactgactaaaatttttccaaaactggtggaagtcatcattaaaaaaatagaatctcaaggaacccaaacagcaaagcaggataaatagaatgacgtacttttctaaaaaaaaaataataataacaaagataaagagaaaatgttacagtcagctagaggagtaggtaggtggggaacagattgcttgttagaaagtagagactaaatgctgacttttcaaccaggattggaagtaaaaaaaatttttttaaagacaatagactgatatattcagattaaagaaaaaaaagtaactaccggccaggaactctatgctctcctaaaattcctttaagaatgaaggtgaggatgtgtatggtagatcacacctgtaatttcagcactttgggagcatgaggcaagaggatcacttgagcccaggagtttgagaccagcctgggcaatgtagtgagaccctgtctctacaaaacagttaaaaaattagccaagcatggtggcacagacctgtaatcccagctacttgggaggctgaggtgaaaggatcacttgagggtggaaggcaggagttgcagtgagcacagatcttgccactgcacttcagcctaggcaacaagcaagaccctgtctgttaaaaaaaaaaaaaaaaaggaataaaggtgaaataaatattgaagcaaaagaagggtcttggcctggcgtggtggctcacaactgtaatcccagcactttgggaggcctaggcaggcagatcatgaagtcaggaggtcgagaccatcctggccaacatggtgaaaccccatctctattaaaaatacaaaaactagctgggtgtggtggtgtgtgcttgtaatcccagcgacttgggaggctgaggcatgagaatcgcttgaacccaggaggtggaggttgcagtgagccaagattgcgccactgcactccagcctggcaacacagcgagactccttctcaaaaaaaaaaaaaaaaaaaaaaaaaagaaggtctttaagagaagtttgaatgggccagagacaaagctacttatagttttgaccatggtgggtattgctctaccccttgtttcctccctcgtctgcatggtgttcttttgtttgatacagtgcagaatccatggaatttaacatacaaagtgtgtcaccaaaccaaagcctaggtcaacagcatgccagcatggctaggattttccctcttgtggtcatgaggagggttttccacctacatgggacataaacacacagacaaggttttctatgaacactgccrtatttcagcatgcagctgggcttggcttaacaaagtgcagcaggaggaaacagcaggagtgaaacctcaaatgtgatcgggtcttaggcacggagatggaaaataaactcaaaaacaagtgctgggaggagtttgggctggtaggtaaggcaaaatataaaatgtaataatagtccaaacaagttgtcagaatcagataatgctgtatgaagtacagttgactcttgaacaatgctgggattagggtcrttggccccctgcttccctgtcgtgcagtgaaaaatctacatacaactttcaagtcccccaaaacttaactactaatacctatgacggacagaaggcttaccattaacataaacagtcaattaacagatattttatatgttttatatattacatactgtattctttcaacaaagtaagctagagaaaataaaatgctatcaagaaaaytgtaaagaagagaaaatatatttactatttattaagtggaagttgatcatcataaaggtcttcatcctcatcatcttcacattgagtgggttggggaggaagagggagggggcgctagtcttgctgtctcaggggtggcagagacggaagaaaatctgtgtttaagtggacccaggcagttcaaacctctgttgttcaagagttaactgtaggccgggcgcggtggctcacgcctgtaatcccagcactttaggaggccgaggcggggggatcacgaggtcaggagatcgagaccatcctggctaacatggtgaaaccccgtctctactaaaaatataaaaagcagccaggcatggcgggaactcgggaggcagagcttgcattgagccaagatcacgccactgcactccagcctgggcgacagagtgagactccctctcaaaaaaaaaaaagagttaattgtagttggaaaatcccagccagtgggcagaagagacattagaagcaaatacctctaagaacccaggcaagacattaaaataagaagtgagccacaccgatagtgtgagtcagcacagtgcttcagctaagaaatctagctctaatatagggtggttctggggctgagcctggactttgtgatattctagctgtgttctttggaagaaagttaacctttcagcttcagtttccttaatggaaatggggataataagaggacctaggtcagatttattgttaggtatttgagataatatagatgacctgcttgctgtcacatagagagttctccacttgtgctagccattatgatgctgctgatggtgagtgttttgggggaggttcatttaatgaggactagaagaagagacagcgcggaatactaggagcagaaatgcacttagaagtcagagtcagacatgcatgcccgtgttcatcgcggcactgtccacratagcaaaggcatggaatcaacctagatgcccatcaatggtggatgggatgaagaaaacgtgctacgtatacaccagggaatgtgacacagccacaagaatgaacaagaccatgtccttttcagcaacatggatggagctggaggccataatcctaaatgaagtaacacaggaacagaaaactaaatactgcatgttctcactcaggagtgggagctaaacactgagtacatatggacacaaagaagggaacaacaggcgccagggcctacttgaggttggaagctgggaggagggagcaagttgaaaacctacccatcacgttctttgctcattacctgggtgacaaaatagactgtacaccaaacccccatgacaggcaatttacctctatagcaaacctgcacatggacccttgaacctaaggtgaaaggtttttagaaaaagaagtcagggtcaggacttgccgtctgtaattctgggcctcaagctcttaagcagaagagcccactttcgaatcttcctcgtagtatagcacctaggatttagcatatctagggctcagtgctctggaatcattgtgaaaatggccgacatcattcatttgggcctggaagccagggaagcgttcacactggaggcgacatttaagtggcagagtctcgccagtagaaatgcagcagtgaggccacgaggggaggctgcaagggaaggatgrggaaatggtgcacgcacatttgggaataaaaaatgagagtgttgtccctggagcgtgaagaaatgcyggggagcatgtggagaccaaggggctacagaagacatctgagctctcttctgctccagttaagaatttgaaattatcctataggtagtatggagtcagtgaaaattttctgtaaaacgggaataacatactcagagctgtattctacagtgacaacaggyagcagtgtgtgaagaatggcttggcagagaaaaagaaagatggtagcatgtctgtttgggaagcaatggaaaaagcttggatcagaggtgataaggtctcatagtaggcagtggtcttgggacacatggagagcgcagggacacgtggagaactgtcacggtggcagtcactagaattagaggctaattacatggtggtgggtggggctggtgatagagatggtggggggaagcctatttgcttgaagaatgaatgaatggccgggagtgatggctcatacctgtaattccagcactttgggaggccgagacaggagaattgtttgagctcaggagtttgacaccagcctggaccccatctctgcaaaaaaattaaaaaattagcctggccaagtggcacatacctgtattcccagtaactcaggaggttgaggtgggaggatggcttgagcatgggaggtcgaggctgcggtgagctgtgatcacaccactgtactccagcctgggtgacagcatgaccctgtttcaaaaaaaaaaaaaattgtgaatgatgaggccattaactgagtaaagggagtagatgatagtgagtttgacttgtaaacttttgggtttaaatattatatagtttgacataagagttcagagcttgggataggatctgagctagacatatacaattgaggataatttctgtatattgggtggttattaaagttgtgggagtaggtatgatcacttttaggagtattttaccaagagaaaggggccaagccaactcytggggaaacactgccatgtaacgggtggatgaaagatcagaggagaggaggctgaggaggtgcgctgagtgcttggtggagaaccagaagagagtggtagcattcaaaccacgagggaagctgaatttcaagggtgggtgatcaaaggtatcaaatcccatgcaggatgccaacgagcgtgaggattgcaacaaagcccctggattccgtctttaataacctgcaaggagcaggattgtggcgggtggtggtggaagactcaaggtcacagtggttaggaggtgcaggagcttctgagcttttccccagagttacggaaatgagtggcataaggagaaaatgggcagtaaccaatgggttaaccaaaatcagtggagagttggtttttwaaaaaaaatggagaaatataagttgtgtgaagagggcaggtggaaaaagagcagctgaatgtgagagccaggcgaacagtagagaaaatcatgttttcagsacagagacaccaagaagcgccagattggttctatgaatgttgtaytttttagaataagaaattgaaacccatggcttggcacaagatttttctgatttataaattcattatgttaaaaattgcataaattgtatacaaactaagtcattttttcttggatgatttataaatcaactttacaaaaagataaggaagttttaaaagaaaacaagactgtccaggtaagttggggtagagatctgctatatatttgccaaatgtgcccacttaaggggacaggaggtctgcagaggtttggaaccagaccaggcaatgccctggcaaggctggaagcttgttagttagttgtccagggattcatgaaggccggagttgaagcaccagccctctatctttacagccagatggacactggacgggaaacgtaccccaaagtccaacatcttacataatatctctgcagtctcagttcatataaagccaatccttcattttggagacattcaagttaatgtcctgktcctrttgcttagacagagttattagcaaagagaaaaatattcagttgccagtgatgctgtcagataatgttggggttcaggagatttttaayagagttcaagtgtactctttaaataccagtgaaaattatgctggaatgggaccagccatcctgttttttcaaaacttctataacaatttgggttgttagaagaagaaatagtaatttagctgtatgttaaatatgatttcacatatgattaactgtcataaacctatagatacatagaatgttaaggttggaagaagaaagcttagagttcgtttgctgttgtcacctaattttttwaaaaaagacattgaggtggaggtggggcagtgcaaaaaataaaaattaattaaaaaataaaaaagatactgagatccagaaatgtcagggtcaaggctaagtagaaattaacagcaggatcagcactaaaacgaaagccttatgcttcctacgaagtgaataagtattttggtaaaatataaaaattgcagttatgtacaggawacggaatggcagactagaaaaatagagggagaaaataaayttagggtcaggctggagccactttgattttttttttttttttgagatggagtttcactcttgttgcccaggctggagtgcaaaggcgtgatctcagctcactgcgacctccacctcccaggttcaagcaattctcctgcctcagcctcccaagtagctgggattacaggcatgtgccaccatgcccggctaatattttgtgtttttagtggagatggggtttcaccatgttggccaggctggttttgaacttctgacctcaggtgatccacccgcctcggcctctgattacaggtgtgaatgctgggattataggcgtgagccaccgtgcccagcccactttcacttctatatctgataagcccagccttcatttgtcaatagaaggaaaagtgttaagaattcaaatatgaaatggaaagtgtccttgctttgaagtcaggaggtcagggtttccttcattactttccccttcggtgccaaatatgtaccagacactgccaggygcttgtttctggacgtgtaccacccctcaccctcttcatggcttggggttcttagtttgcttatttagaaaatcaggtgcctggggaacagaagcagaaagaagaaaactaaggaagaggattcagttaggagttgcatttgtgggtaagaaaaggaggacaagatggcagatgaaatggccactgagggcccagtgacgtcagtggtggtttcatcctcaaagttgaagtcaacctcaggcagccaccaggcttcacatgatctctgggttacaagactatccccatactcttctgggaatacaatagaaagctcttcttagagtaggcctagtccctataggttccaaattgaggcaagctaagcccacatgtaacagccattactcttggtgtcatggaaacaaaggcaaaattcgccaagtagaagaaacaaatgaacatttaaaaatggaacagtagactgggctcagtggctcacgcctgtaatcccagcactttgggatgccaaggcaggcggatcatgaggtctagagattgagaccatcctggccaacatgatgaaaccccgtctctactaaaaatacaaaaattagctgggttttgtggtgcatacctgtagtcccagctactcgggaggctaaggcaggagaatcacttgaaccccggaggcggaggctgcagtgagctgagatcgtgccactgcactccagcctggcaactgagcaagactccatctaaaaaaaaaaaaaatggagcagtaatacacagcctccatcctctttcacagaacccacagcagtagtctttatatcrccaaagcaccaatgtttttgatgcatgaattgttaatagatgcatagmtgaataaatgaatttttgtcatctctgctcctgcaatgctcagtgctttggtggaaaatctcagaggacaccatygggaatgtgctgtactgagttcactccctggcattgttattgatatacaatcttcgtgttgtgagccacatgagcacttagataacatcacagaagtgcgttttctagaattgcatgctgctataatgagaaaagggaaaaactggattttttgacttctrttgaaattgtgatggcatcgagsggagctaatcaggaagctggacttgmaggcaggtttcaacacatttggtaatatatttgcactttctgctcagtcaccttcaagtgtctggtgtaattaaccttgggctctcctcaatgacacatcaggagcatttcttgctaaggaagctgtgggacccatcggctgggcatggccttgtctggtcagcacrcaagtggcttcattacgtttcctttcacgaaggctgagtattaaagtgacctctgrctgacagttwaattgcttaattagagcctttcttctaagtcttcgattcatgtagctctgcaagctcttattgatctcctagaaaggctgcttgtagctcagtgtgagagcaggaagaggaaagtccgttcagcagcaccagctggcccctggagattcctgacctctgcttccagcatcctctttgctcagatcattggaatgtctgctttgtgagaatcagcaaggagcagctcaaagcaagccgaccatggtccaggtcctgcctctcatttggaggaaaacacaaacgagggctaacagagcctggtaccaaaaagcaaaagcaaaagcaatatgattagtaacttctgaagctttttgtggctatctaggagaaagaaagaaaagtgtctgatgtgatcyggaaaaaaaaaaaattccctgtgctcccacccaaagctgcaatgtctgttgttgttccattattcgacaataaaatgcagggtggaacagggcagatacctaacgcagcatcctcttttgttgtatttttgtaatacaccacccatgatgtgtttccttttaaaacactgatggtttccaaagcagagcaaacagacacaggaataatagaactctgggtttcaaagagatgatggaaacaagtcttctttaaatatttactgttttacaaacaaatccatgacagaaaccagtctctctctctcccctcctcttcctctctccctctcttttcctctctctctctctcttttcctctctctctctccctgtctttctgtccctctttctttccctcttcctcttgctctctctccctctcttcctctttccccctctctctccctctgtctctccttctctctctctccctgtctctccttctctctctctccgtctctccttctctctctctccctctgtctctccttctttctctctccgtctctccttctctctctttctccctccttctcttcttatctttccctttctttgttcytctctctccctctccctttttgtctctttctctctctcctccctgtatctctctctcactctctctttcttccctccctcctttaygccccacsacaggaatttttgtttccatctgatacttgaggatgatctttttcaaacgtttatcttgtgacttgcatttgtattaacatgcttagctactttgcttcctggtgcgggtgtcttattaacaaccaaatgctgagccagtgctttgaatctgcaagatgaaggaagagttgagttgaagccacagctctcaatctgtggacacgggtttggtttggcttggtttccatttcagctcagactctccttaaatgtttatttgtgaaagtaaaacgagcatcttagatttcttctcatgtcaacatttccaggaatctttgagtcagtgctcgcaacaactgcaartttttagagtttatagtctcttgtaagatgtgaagactgagtgggagagtgtagmacaaagaaataggggtgaacgcatcgtgatatgagatgtggggttgtgaattgaacttagtattgaatttccaaggagcgtaactggaaaaaaatcactgacaaaggaaactgatgcttcctccttcctcagccccaagaaragatgctataatgagtaatattttcatttccttccgcattcacatttatgactgtaacagcttgtataatttcctgagggatttccctccctatcacttaatgtttcctctattttggagaagttcgtattccaaagtggsaattccattagcagstataccgccatattataacatgtgaaaatacctcatggactctcratcctcaaaatcactttgcacctccatgtgaattatctctcctgtgccctaaatgtcttattcttcaccacatttttgcaccctgctaagatcaaaggcaatccagggcaggagacctgtgttaccatctggagttaaaaatgtagcaaagcgggactggcacagtggctcatgcctgtaatcccagcactttgaaaggccaaggtgggtggatcatttgaggtcaagagttcaagaccagcctggccaacatggtgagaccctgtctctactaaaaatatgaaatgtagctgggtgtactggtgcatgcctgtaatcccagctactttggaggctgagacatgagaattgcttgaacctgggagacagaggctacagtgagccgagattgcaccactgcactccattctgggcgacagagcgagactctgtctcagaaaaaaaaaaaatgtagtaaagcataagggtccaggtgagaargaggccacactagaccagagaatggcggttggaccagagaaggacaaggaggagcttyatatctgaatccaggaatagaatcaagtttatgtggcaacgatagaagttstgggtttatgtattgaccccagacactgygctctttgttacccattctgctaagtgagccatgctgggaatcccatgcacgttcactggaatggaatgcaggacagatgccaaccacttggaaagccacrggagcccartayaagactttctcaaatgctactgaggatgcttgattgcaggttcagatgcaaaggatgggggactcccaccctatttccagagctgctgtggttttctttcttggagaccgtgaatatctcacttagcttcacagaatcatggtctctcaacattctaactgaatgaatacaacttgatttcaccttttctctaggtttaatcatacttggtcggacgtcagacagatggggtttgtatattggctctgcactgctaagcgtgtgattgggcaagtcatgtatgttttcagagctcagttttccctgctgcaaagtggaactgttaagaatcaaatgtaaacaaatgtatttaaagtacctatcagtgtctggttcagataagtatttgctgctattcctaatttttctattacaatgactcctgcttctattactattaackctatgttaaagatcttaaggaatcttttaaaaaaattttctccctgagcaagatgaaacttagtaaacaagataaaaaatccagtagaaaaaaattcctcacttcctactttccaacaatctcagggaatatattcctgtttttttttttttttttttagaaataaaaatacagatattactgaggaagctacaattcatttccccctcaktcatgaggggtgcaaacgatgactgacatttcagtcaggtggtcacgagccatttaatcaccccagggttttgattacagcagagaggggcagccgctgaagtgctctgcatcacgtccaygtcaatcacgtggtctttagtgcttaggcaaagcatgcgtgattactggtctttatttcgtgcaatttaaaaatgtatgctcagctttactttagtatgtgatgttacattttagaaagcgcacgctgtgcactgagttgttttgagactgaatggaaggaagacacaaatggaaggcaggggaaatttcagggtgttgtagtggcctaggcaagatgtaatgaggccccacaccaagacaccagagagggacatggatgaagtagagggaaggagccaagcgatacatcggacaaacagatgttagaacatgctgatccactacatgtagcagggatgggggcggttccccaaacggtctggccgttgggtacatgcttccggcatttactgtggcaagaaatgtaggtaagggagaaatgagagggacaggaagagggcttcagtttgagacactgattttcggggtttgtggaacatggaagagatgatgtctacgatacagttgtctatacaagcctagggcttaggggagagggctggggcacagttgtagatattaggcaatgaacagatgctttggagatcttaaaacagaagccacgtccattaaacttgatacattcctggcggcagcaagaggctagattaactggcgttagtagccatctggcttgggtactgcagtgctgttatatgaatagtgccctttcatgtctgtatgtaatcacttatgcatccgagtgatgaaacactaaagaacttttaatatagattttatttttaaaccttacatgctcctcatattaaatttgtagaatacagaaaagaagaaataagaaattaatgccatccttagtattacaatatagatacaagctattgaaattttggtttatttccctcacaaacacacacatacaaatatatacacgcactcatgtacacacaaacatgcatagttaagataatattatatataattttgtatcttgcctttttcacttcatattattcgaaattttcttaaatagtttctttggctagtcaatgaaatggacgtgctgtaattcagttagccacggtttattattaaccatttggattattaatgggttttttcttttcttgttataacaatgctatgaggagtatctttatatgtgaatcttagtacatttcctattatttcctttatatagcttttcttttctttattgaacactctactatgaaatattttaagtatgtagagaaataccgactatataatgcatacaaagtatataacatacaaaaacttctccctgtccagactggccaaatcttcatattttgccacatttgcttcaagttcttttgttttctcccaaacagaaatgaactgttcaagacacaggtgaagtcccacrtgctcctatcattgatcccatgccctgttccccgtcccagaggaaactgctaatgagatttctggtttgtgattcccatgaaggtttttatagttttttcattatatgcatatatccatacacactatgaaatattattttgcatattttaagactttatgtacatcatgtcacacgctacatatccttcttcaacttgctctattcactcattattctgtttttcacattttctrcattgtaatgcatacagatctaatgcattcttttagtcactacacattctattttatatatgcaccacaagtcatttgcccattctcctgttaatgaacatttaagttgcttgcaatatttttccttagcaactttttgtaccgaatattcttgaagcaatatctgtatgtaaccacctaagactttctctagtgtaaacctgcagaagtggaattgctagcttttaacttttctgtatgttaaatttcgttagaaatttatatatgaggccgggcacagtggctcatgcctgtaatcccagcactttgggaggmtgaggtggatggattgcttgaggtcaggagttcgaaaatagcctggccaacatggagaaaacctgtccctactacaaatacaaaaaattagctgggcgtggtggtgtgtacctgtaatcccagctgcttgggaggctgaggcaggagaatcacttgaacctggaaggcagaggttgcagtgagcaccactgcactccaacctgggtgacagagtgagactctgtctcaaaaaaaaaaaaaaaaaaaaaagaaaagaaaagaaaaaagaaatgtatatatgagaatttctggaacgaaatgagaaaaacttaccttcatacttgtaatcagtttccacaaaactttcaatacattgtcttatttgatctttacaataaccttatgaggctgcaaggggagtttacctaccctcatttttagatgaggtctctgaggtggttactgcaaagagcagtacagcatgtgacttgaatacagcactggacagcctcattcttcggaagcctttgttcttcattccacacccgcagacttaccccagaacttaccagcttaagacaacaacatttacagtttccgtgggtcaggaagccaggtgccactcacctgcrtgcttcctggctcactcatgtgaatgtacacagggttcagttccttgcaggctgttggctgaggcctcccttgactccctgccacacaggcctckccacggagtatctcagaacayggcaccttgctcaccagggcaagcaatagagaggacaagagagagtccaacaagacagaaagtgctagcaagagggcaggaaccatcttttctcacctcattatggaggtgacagactatcacttccattgtattctgttaattagaacmaatcacgaggtctatcccatacgccagggaggagattacacagaggcatgaataccaggacgtggggctcactgagagctgggtcagaagttgcctaccaccccccacccctacaatctccagttggaaaattttcayttcttatctctcccactcctacctacccatatttctggacaacccccaccccaccccttggttctcttttcttttttgcctccatagctttctaattccctacttcatttcttacacagcaatttagctcccactttgtctcactttgatactagaggctaacatctatcacatgcttactacatgccagccactctcctaagtattgtatcttttaacttattcttgtgaacagtatgagctatatattcatattaatccaattttgcagattaagaaatttagcaacagatgagaaagcaaagagaagggggcaacttgtccccaacaacataaaataacacctcccctactatactcatgttctgagagcctatgaagatattttcgtcaataaagattgcttttccggccgggcgccgtggctcacgcctgtaatcccagcactttgggaggctgaggcgggcggatcacgaggtcaggagatggagaccatcctggctaacacggtgaaaccttgtctctactgaaaatacaaaaaaattagccgggcgcggtggtgggcgcctgtagtcctagctactcaggaggctgaggcaggagaatggcgtgaacccgggaggcggaggttgcagtgagtcgagatcgygccactgcactccagcctgggccacagagcgagactccgtctcaaaaaaaaaaaaaaaaaaaaaaagggattgcttttccctctaaaaggaatcctgccaccaacttttaaataatgcaacatgcttttaaataatgcttatttatargacaaaggtgtgtatgagaattaaaaagttccctttgcttggcttctttattttcccacattaccgttctttagaactatgatcacaggcctccagaactagaaatgccaccaggaagggatgttggtctcacacttgaatggttttcctcctgtgtcacttgacatgtgacaaagttgaacacatgttaactttagaaatgatggacatttatgcaaatctcctcaaggtatcgaagcatcaggtatgaaaattaaggccgggcactgtggctcatgcctataatcccagcactttgggaggctgaggtggcaggatcgcttgagccaggagttccacactaggcaatacagcaaaatcccctctctacaaaacatttaaaaattagccaagtgtggtggtgcacacctgtagtcccagctatttgggaggctgaggtgggaggatcccttgagcccaggaggtcaaggctgcagtgagctgtcacaccactgtatgccagcctgggtgacagggtaagaccctgactacaaaaataacaattataatactaattaaaagaaatttcataaatgtttggcttagttctcacttctggctagagctgaggatgtggaggggacttgatagcaccataatatatcatgtgttcagaatactctgggccttggggacgggtccaatgtcctctgcccacattctgcctctgccttctctcaccctgttggtgaagggcccctgggagcggagtgcatgacattggctgtgccctgtggttgggccccttcattctccttcagacctggcatataggaagcctgcccagaaagcagccgagctgacctccgtccccctgtgactarcctcttacccacaattgtgtctactatgtgtttacagcattgaatctatgagggcaaggacagctgtttcttaactmagggttttcctcaaccctagttctcaatttttagagaccagcaactgtcatacatattcatttattcatttgttcatcaaacatttattgcctgtatgtgccaggttctgtactttttaaaaagtctcctatttttatataataaagttaagctttttgtttttgtgggggttttttgtttgttttgttttgagatggagtcttattctgtcacccaggctggagtacagtggcaccatctccactcattgtagcctctgcctcctgggttcaagcaattctcgtgcctcagcctcccaggtagctgggattacaggcacacgtcactacgcctggctaatttttgtatttttaatagagatggggtttcaccatgttggccagactggtctcaaactcctgacctcaggtgatccacctgcctcggtctcccaaagtgctgggattacaggcgtgagccactgcacccggcctcatatgtattttgaatatgtgtgttagtatcttggcattttataaaattctggatattttacaaaaagactggtcaacttttctgtagaaattaaatgaccactccattagatctgcctctgttttaagagcttcggcagttagaattctctgggggacagtggccactttttattttgtggcttcaacttcaaatttttattttattactatcatctagaaatgaattagttgacatgtacaaagttttattttgtttgtatattgccctgacttttaccacttaagtaacgatcagaaaatcaatgctgaggcctagcaaactcttggcagtagacttaagtaagaattatatgttatattaatatatgtgtatccaatagtaatatcatttgctagctttgccttgggaactaaatggaagttaaggtgaaattcatatcgataatttttatgactttagaattgtaaatgaatgggagcaaggtttctcatattttcttccttgaagtgcttttcttgtggaattttataaattgaaactttaaatgtgagttgttttttgtctttttttttttttgagacggagttttgctcttgttgcccaggctggagtgcagtggcactatctcagctcaccacaacctctgcctcctgggttcaagtgattctcctgcctcagcctcctgagtagctgggattacaggcatgtgccactacatctggctaattttgtatttttagtagagatggagcttctccatgctggtcaggctggtcttgaactcccgacttcaggtgatctgcccacctcagcttcccaaagtctgggattacaggcgtgaaccaccacacgaagcctgagaataatgatttgatattataagtgttaaaaacactcaaatgaaagaatttatatttcaaaatctgttaaaaatattctccctccttgatagcctgaggtttcaaaatttcataaaatgacaattaggtacataaaacttaataactataatgctacggtttgaatgtgtcccctccaagttcatgtgctggaagcttaatacctcctctagtgtcaggaggtatggcctttgggtggtgttcaggtactgaaagccttgccatcatgaatggattaatgttgctataaaaagggcttgcaacaacaggttctctctcttctgcacttctgccacttggtgacatgatgttcctccccacaagaggatgcaccattcaaggtaccaccttgaagcagagagacccggctgtaacttgctggcagcttgttcttggacttcccagccttctgaactgttagaaataaatttctgctctttataaatcacctggcctcaggtattctatggtatcacaaagaagcagactgaggtgtgtcatgagcwttttaaagagaagtaacatggtaaatctagaatttggagagagaagacgctgctactcactagtgatgtgaacttggatgacttactagcctacattgaatgagacagtagtttaatagcttagcacttgcctccctgtctttatttttatagaaaatcacacaggttaggatgtttgtgayggagcttgtaaaattataacatgctcatcacatttggggtgtcattggtatataatttgaattccgggacacatgaaaaccttctttttattgagatggagtctcactctgtcacccatgatggagtgcagtggtgcaatcgcagctcactgcaacctctgcctcctgggttgaagcaaatctcatgcctcagcctcctgagtagctgggattacaggtgcccaccaccatgcctggctaattkttttttgtatttttagtagagacatggttttgtcatgttggccaggctggtcttgagaaaaccttctatttttgatccattccttgtgaagtattacttcagccagatgaattttagcagaggtcttgtaattccaggacctcaggggctgggggtaggggaaatagctgggaagtctgtaaagcttctaggtgtgcccctttcaaaggacccccaaggaaatgggtgattcgggtgattttctgaagatttcagccttaatattttagtttacttttgttccccttatttcctcttgtcccttgagaggattccaaccactcagactgaaaacaaggactgtgagagggaagaaacaatatgtacttattccttggacctttgaatttcggagaaaatttttttaaaaccagaagagtcttattttgtgagtccatggacttgcaaaatcttagagttttttcttttttttttttttgagaagtctataaacaccatagaacccattgttccactagtttaaaaaattaagaaatgctagacacttaggttgattccatattttggctattgtgactagtgcttcagttaacaaggaaatgcagatatattcaacatacttatttaatttcctttgtctgcttatcccaggagtgagactgttggatcatatggtagctctatttttgattttttgagaaatgtccatactgtttttcataatggctgtatcaatttacattcccatcaatagtgtgtaaaggttcccttttccccacatccacaccagcccttattattttctaattgggattaagtggtatttcactgtggctttgatttggatttcactggtgattagtgatgttgagcattttttcatttacctgttggtcatttgtatgtcttctcttgaagacaaaaagacttatcaatggatgaatggatttttaaaatgtgatatatataaacaatgggatggtacttagcaatagaaatgaacacaatcctgtcatttgtggcatcatggatgagcctgaaggactttatgttcatggaaataagccaggcacagaaagataaataytgcatgatgtcactcatttgtggagtgtaaaaatgctgatctcgcacaagtacagggtagaatagtggttaccagaggctggggacggtagcagggaggaaattatggggagatatttgtcaaagggtatacaattacagttaggtaagaggaataagttctgatgttctataacacagtagggcacccacagtaaacaatattctggtttataaatattatagtgtgttaaaagtaactagaagagaggattcttaatggtctcaccacaaataaatgataaatgtttgaattgatggacatgctgaataccatgatttgataattacacaatgtatatgtgtattgaaacatcacactatccctcatacatgtgttcaattattatgcatcacttaaaaccaaaataaaaaataaatataaactrtatatattcataaaattgaatcttaaacttttataaaaatgaaaaaatgctattctaaacaaataaatgaataaattatcttgagagaagtaaatagtctgtgccttaagattcaattggtgtattctccatactctgtaaccacagatgttctaagaaggtattcattatcctttgatattaaaactaagacagtattaatagaatattactacaagcttaggacactgtatctataaccttaggacagcataaaaccaagtatagagataataaagacttgaattaaaccaatggtggtgatatttgagagtagactcaagtatgaatgtagtaagaggttttgtagtgatggtttaaatgtcattttgtctactgtttacagtgttcaacgtgttcaaaggaaggattcatactagattggaaattataatttgaattggttagaaaaatggaatttagtttttaatcaatctttgttgaatgaaaatcagtcatcaggtttcatttattggagatatatatatatatatttaaattttgaacattaaataataaaaaagaaaagatttgctgctccagaacagacccacatttgttttaaacttattattgtaagagctttagctcctcagaaagttaaaaatcctattgatatttgattcatgggcttgtataagccaaactgagaatatcctgccaatcatacctgtggctaaagagaacatgcagaatcatacctgtgtgctaaacagaacactgattataatcatcaccagatttttaaagtcacttgcgagtamcttccttacattgaatctccgaactttctatttttttccccaagattttcttatgaaatataaatggcaatttgtttttaatgaaatggccatattttaccttcatactttcagtcacattctaatggttggcaggttgatgcatgcgtcctgctcagttgataccttgcagtgaacaagaggaaagggtttcaattctggactctggaatctagtggtctgattcaacgtgacctgctccctcttaggaattgtgtgacttgggcccattacttaggctctctgtgcctctgttgtcctgttcttaaaaacagaaagaaatttgggaggataaaatgggacagtgtacgtgaagggctgaatccagttcctggcacatagtaagcactaatgaatgggagttattattaatcatccaagcaaaggaactcatttcccccctgatttacacataagagtattcaaaaattcatcyagacactgagttccaagcaaattagtaagcttcaaattttacaaatcaatacagagatttcaggtatatgtgacatagattccatttcattacatgcctggagggtcagctaggtcccagcatggcactaggcaagacagagaccaacagttaaaaagagagaggtaattttcttttccttttttttttttttttttttttttttttgagacagaatctcgctctctgttgcccaggctggagtgcagtggtgggatctcagctcactgcaacctccgcctcccaggttcaagcaattctcctgcctcagcctcctgagtagctttgactacaggtgcacaccaccacacctggctaatttgtgtattttttattagagacgggggtctcgccatgttggccaggctggtcttgaactcctgacctcaggtgatccacccgcctcagcctcccaaagtgctgggattgtagatgtgagccaccatgcacgggcaaaaagagagagaggtagttttctaaatcagccttatatcacccctatcgtttgaaaagaattctgccatttctcttctcttgagcattaccctatcacgaaacttatgaagaacaaacaggtccaacaaatgttgggattctgacaacaaatgctcatcactcatcattatttctcgtctgttttctcatgtgtctattcttgcattacacatttccagcacatgttgtgggcatggcctgtgaggtgactacactggggttgggaaggaaggggagtgtggaagggacggcatttatgaagatatcaagaaatctaatagtggctctgacagaggaagtcctgctgaaattcacgtcagcatccctagaaatgaccaaagacttgttacagctgtgagaaargacaataaagccagtttccctagatccagcaaacgtgtgattatccactagtatatcggcgtgcagacagttcgtggaatacaggccttctagatgtgaatctgaaccactgtttgccctgtctcctttcttgtaggcatacgatggcttaagctccacaatgtcccgccttgccaggacgtgtggaagggagcagctggctaaccccatcgtctcctcaggaaacagcctcttcttgagatttcagtctggcccttccagacagaacagaggcttccgagctcaattcaggcaaggcaagtaccctgtggatcttcccaggcacaagagaaatcttcagtgctctgtttggtgcaacagtgaaatgagacctgtgctcagaaattgatcacagccttctacttaacatgtaaaaaattaaatagaacaaaagaactgtgacttacaattatcccaactcctgatgcttgtaaccttctccttctctgacttcctttggacccgcatctctaacaagtttaaaagtgcttttaagactagaaacagtataaaaaagttttatccaaattcactgatctagcactacccaaggctttacactagaatgggatacactgctatcaattacaagacttgcttgtaatgtattcagatgccagcccctggaagcagtggtttccctcatttctgaatcctgccattgtccaactgaggagtcactgttgttttccatttatttttctttctttgttccctcccttcctcccctcttcttccccttcctctcctccccttccttttcctcatctctctttccctccccttccctttctttccacagggtctctctytgtcacccaggctggagtgcagtggtgcaatcacggctcactgaagcctcgacctcccaggctcaggcaatcctcccacctcagcctcctgagtagctgggactataggtgcacccccacgcctggctattttttttcttttttagagatgggatctgctctgttgcccrggctggtctcaaactcctggcctcaagtgattctcctgtcttagcctcccaccatacctggccatttttgttcttaaatcaccacttctccaagacctttttacccattgcctttcatctgctcgttctaagagatgaaccccttatcccatagtcagagatgacttgtattcagatgaytcagaacattcactacaaatacatttagtctgtgtagtcattatgtctatcttagtcaactcgcttatattctgtagtaaagagctctggatggggacagtgcctggatcgaggtctcccaaatacgcaccatagacctttagactttggagcaagacagactatattcttgttgattttaaagaaaaactagtttcctaatagttcttttgcatgttattattcacttgtttgttgcttcatagtaaaaagtccctgctagctttcatccggactgtaacaacctcctgaaagtcacctacccttaccccatctctctccaaagtcgcctgtaaaagccctgctctgatcatgccattggaatgctcaatgtctgtcccgtctccacctggcctggagaataaagctcaagctcctgcagatgttaaccaagagccccagaacccaccctgacctctctccagcgtcagtcacccacatccctggggcaccccatgctccagctgagcctctatagatgctcctctgtgtctgctcaggcagtcccctccctggcctcccttttctcaccctccaagtcctagtttagcctcggcctcctcctcagcaagactcctcttacgccctccagcggtgaccgcctctccctcttcaagactcacatcgaattttgctcttctctagtaatctacagtcatccttatgaagccttattcaattgagtatttattttcctgaaaaaaagaggtcatttataagcagattatccctatgcctatgatttatgagtgggcagtgtaagtgaatccatgcaagaattttgtttgaatgacttaggcaattcatagacatttaatctgttgctttttgccacttcctacttcctgtagttgaagaataattgttaaaaatataaactgtgctcctgttttctcatggtttatgtacagctctccttatggagaactttcttggcgtgcattttagaaataagaagaaaaatcattgatggttttattcatcaaataattgttttgtacggtcagtagaaatgaaaagcatatgacatgtatgtgtgtttgtgtgttccccagcctgcggaggccacatcctcaccagctcatttgatactgtttcctctccacggttccctgccaattatccaaacaatcagaactgcagctggatcattcaagcgcaacctccatgtaagtaacaaaaatgaaaaagaaaaggcacacaggagagaaggtgtctgtgggaaggtcagtctatgagtaaccttcttatctcagtgctaacaatcgatggccttcctcttcatcttttgcaagtcccaattcctgatgtgcttaagaacaagcatttcctaatctgatagggaagtcatttctacagttgcttctaaatttaaaaacaatttcttttttttcatktcaaggcctagcaaaggttaaaaaacacacacacgcacaacaacacaacacacctacaaccttgctgtattaacaggcgtatgcaggcgtatgagattgggggtaaaccaaaataatcgataaatagtttttgacatgtgtgccttgagtatagctgatgttcaagacagttgctgagtgaacaaatgaagaagagtcacagactggagaatcagtgactcacggrccagaatgcaatgcgcgcacctatccatcaaagcaaacattcataaaacctgggctctcctgcaaggtactattccagcacaggcctagaagaaacattgaataaacgcttactttcttttcttttttggaaccctagaatcttattttctgacctggtaacagtccgatggtaaggacttctgtcctcattttacagacagagaacatcaggaaatgcccctcaaggacatgacagaatggctgcaaagcgggtgatgctggggcccttctgaatcctgtttcagaggagccctgccctcctttgaggtttgcaggaaaatacagtttcaggcataatgtaggaaagkctttaagttcttcactctgcacagtaattaatcgcctgtgtgaaaatagggaagtcacttaagctaatcaggccatgaaaaagtaatctgcaaaatgaagagtttggcttaaatattctctagcactttcccctgggatgtcaggagttaacaaattgctagtatcttcattgacatgcataagatgtggcagccgatgatgtcatccttagccaattcaaacggggaggtggagccccaaagaaagttgccagccagccagaaactgagctgtagataaagaagccccctcccttgaactgagaagtttgtgcctgaggattattttctaatgagttgtaaagcatttagatgaaagatctcactggttcaagaacagcaataggaaaagatcctattctgaagattagggagcttaaagaacaacaaaaagaaaatgtatccaggtgcttgctgttctgcaagtaattcaaaactttcttgataaatgtctctgaaccttagggcactagctctagcctgaaaataaaactgagtgagctaaaatgtgggctccagggagaaaagaatgccttatttacaagcacatgcaaagaatccgaatttaaggaaatgagtctattgagaaaaatgcttctgcgaggaacacagcaatggtgatataaaaactggaaagacggcattttccaacaagatattcccttatagtgcctggaatgaacctacccaggagtcctcttatttaccactgccagtgtttcagatgccacaggcagtttcaaaagcatctattccgttactcttcaaaggaaaccatctattctattactcttcaaaggaaaccatctaggatagaagttgtccccttcccttgctttatcccttcaaccatgtgcaaatccgcctcattcattacttctctgctggagaacccttacatgaaattaccagaagtaaaatttatctccctgtatgttttttaattttaattttattttgtaaaaaaattttattgttaatttttgtgggtacatagtagatgtatatatgtatggggtacatgagatgttttgatacaggcatgcaatgtgaaataatcccatcatggaaatggggtatccatcccttcaagcatttatcctttgtgttacaaataatccaattctactcttttaattatttttaaatgtacaataagttattatcgactacaattaccctgttgtgctatcaaacaggtcttactcattccttctattttttatagtcattaaccatccccacctccccgtcttgccccatctccctgtatgttttatttgccagtactttacgagagagtcttctcttttttcttccagtaaatcatatcaccctctcttttacccactttgaacttgaaagaagcacaacgtgtgcacgtgactttgtagaaattttggatggcggccacgaagacgcgcccctccgaggtacctcagcgttcactcatctacatctgtggtcttggctgtgctttatttatagatccgcatatttataggctgccattctaggttgcaatgtttccaataaatagaaagagcagcctaagccaaataaagatgattagagggtaagaaagcaggcttgaatgtggggttcagggaactcagcctgtttattaatatattcaaacgtgtgaatagtttgtgtatatgttttaaaacatttaaaaattgcagctgctttaaagaatagtggaatgcaacccatcccagcattaggtagcattctatcagaaatttcttgttaatatttgaccaagttcttacattcacatggagtatgtttctttcagccttgtccttagtggaagcgaaaaaaaaagcacttaattagataattaattaattaattccattaaaaatctgtctttttgtttgttagacatcccaataaaattaaagagtgccgctatctagtttctgaaatgctctcaggcaaaacaaacaaacacacacacactacacacacacacacacacacacacacacaccaggccatttaagctttctccgtaaatttcctaacttttgaattttgttgtaaaaacttctcatcctgcactagaagacaaggtctgtcagagaggagactgtttggcctgttgcctaattcccagtgcccaggacagtgtctgagacaatagtgaacaatcaatgaactctccacaccctatgcacacctctcacagcatttgttagtaagcatttgaccaaggataagggtatattatttaacaagctgttacatagcaataccttgcgctgagtactgttctcagtatgttataaatagtaggtcaatccttgtaatcttatgagataggtttcattattttcaatatgcccctttttccaagtgaggaaactgaggcaccaagcacgtaagtcacttgcctaggatcacacaactagcaaatggctgagccaggggctgaatccaggtagcctggctccagcatccacacttttctgtgctacaaaatagtgratattagtgcatttatttgtatgggtccractgggctggagatttttgctttaggtacatgtgtcccttggtcatctaagtttttcctctggtcctattgttcttgatcatgtttataaatcacctctcctatatatagctcctatatatagtttattttaaatcatcaggtattgtctcaaacattgaccctgaatgaagtggttctcctagtggcaatttcttcactttgttttggtctcttgtaattcgagtaaagatgtgtttcctagaaacagcggtctctgccatgttgtcattcattctccttgtcattatcttcattatttaggccgttactgtggcaccgacatgccccatcctatcacatccttcagcagcgccytgacgctgagattcgtctctgattctagcatcagtgctgggggtttccacaccacggtcaccgcatcagtgtcgggtaagaaaccctagcacctgactctagcggttaaaagggatgtggtagaaattcttggtttgttattggggactctgaccttcgtagttgggagccagtttcctgagatcacctctgggccaaatcttaccttcttcccaattaagtgatcgtgttgtcaattctagcaataatgaactctggaagtgtggaggattggttggaaatgtagctgtcttttcagctacatgccatgctatcagatgacttggtgttcttttgttgtttttgagatggagtctcacttggtcgcccaggttggagtgcaatggcacggtcttggctcactgcaacctctgcctccccaattcaagcgattctcctgcctcagcctcctgagtagctgggattacaggcacttgccaccacacctggctaatttttgtatttttagtagagacgaggtttcactatgttggccagactggtctcaaactcctgacctcgtgatccaccagcctcggcctcccaaagtggtgggattacaggtgtgagccacctcgctcaccctggtgttctttttggcttgtttgttaaggcagcccyaacctggggaggagaggaacgaggagctacccaggactgggtttcttagcctcttagcccagagagtgctgttggtcactgccatcttccttgtttttagtggttaaaagctacagaacacctagaagattggtgtgtgcatttcggtgctctactgagagggaaagcaagcatgctgcgttgggttctaggccagggttgaatagaatcctggtcacaaaagccaagtggctgtaggatggtaaacaagtcttttattcttcaaagttaccgttcacaggaagaaacggctttgagaaaagacattgcagaaattccttctaatccaccacactgcatggcccttggtcttcagtttgcagaattgttcccttattttatatgacatgaatgttttaaaatgtgwgatggaaatactatctattcttttacattgataatggctctagcgttctttctcctttrttttatagtgtctgatgcagtctttgctctgatactcactttatttctattttcttccagcttgtggtggaacgttctacatggctgaaggcatcttcaacagccctggctacccagacatttatccccctaatgtggaatgtgtctggaacatcgtcagttcccctggcaacyggctccagctgtcttttatgtaaatccttttttatggtgtattgyttcagtgctaatgaatctgtaggaaagaagttctggtgctaataggatgggcaactcatagtgtacgtgaaatttaggaagtatttttccaaatttcctctgtttcagtcatagtttgagttataaatagcatgaagtttctctcgaccatggttcttgvgtcctgtctaacatttccaaaagtacattcttgagtccttggtgaatgaatgaatctgtggcgcattcatgttcagagtacaggaatcttatctttttttttggaattagacacattaaggttcttccagggaatcactagtattgtttattccagcagagccctcccatctcaattaagcattctttacgcttttatcttatccctacctcaatccacctttccttctatttctgtcagaagaatggttctggggctgggtgtagtggctcatgcctgtaatcccgcactttgggaggccaaggcgggtggatcacttgagatcaagagttcgagaccagcccggccaacatgacgaaaccccgtctctactaaaaatacaaaaattagccaggagtggtggcgggcacctgtaatcccagctgcttgggaggctgaggcaggagaatgccctgaacctgggaggtggaggttgtggtgcactgagattgagccactgcactccagcttgggcaacagagtgagactccatcttaaaaaaaaaaaaaaaaaaaaaaaggaatggttttggaagtttttttaacttccaaacttaaacttacttaaactttaaacttaattttttagaacactttcatattcctcattgcactataacactttttgaaatggactataaatatggaattagtagtaggatcctatcacattctgagtggtcttagattaaattagacagcaacaataatatgtcctagagtagatgtaaaaagcacacattttaatcaactgatagagaggtatatgtgacacgtcacactgataatggatgcttattatatattgagagataagatcctggaatttaaattgccgttttgaattgaaatttatttaccagtctattttacatattactaggctgtggttgggattgctaattctgttttgaagcgaatataagtaacttatggttgagagaagaggattgttttgaggaccctgtcctgtttatttaaaagtcttacttttcttccaagacttgctaatctgtgcatcaggaactgattaaaaatatgggacaactatcctatttgtggaccaagttcaaacatctcaagttgctttttttaatccatcaatcagacagagcctcttcagggtataagtggccttgtgttaaaacaaagacaccctctgcatgccgaaaggcaatgcaagtttaagctgcctcacaggaaggaggttttggtttgtctttttttttttttttttttttttggagacacagtctggctctgttgcccaggctggagtgcaatggagtgacctcagctcactgaaacgtcgcctccggggtttaagctattctcctgcctcagcctcctgagtagctaggattacaggcacatgccaccatcccaggctagtttttatatttttagtagtgatggagtttcaccatgttggccaagctggtctcgaactcccaacttcaagtaattcacccaccttggcctcccaaagtgctgggattacaggcatgagccaccgtgcctggcctggtttgtctttgtcttcactaagagcacagcgttctggatgggaagaaatctatatactttataatgtttaccagacatatatttattctttcactcaacagatatttattaagctcctaatatgtgctaggcatgtagttggcacatgctactctcctatgaggtgccttctatatattgatcaataaaacaccatcattgtccttagaataaaatccaaagcccttcgcacagctttagtaggcctatcagaattgccaaataaaatgatttttttttttggtcttttcctgtttgtctctaccacattcacattgttgactgctctcattcagtggttgccaggaactgagctaggtgttcaagacagataagatttcaggtcttgacaaattactcataagccaacattaagaagctatttaattaaattcattttatttctgtgggataataataacaagtttctataaacaaatttatagtaatttcaaatttctaggactgtgaaggttaaagaagatgtcaaatttaaaacgcataccacacagctagtgcatagcaaatgtttggtgacttaattctctcaatctttaccatttctgaagtatcttctgtgatagctcacaaataaatccaaacgggcagcactaggctctccttccagaggatgggagattacacacacagaaagcaagtttcatctatttcagtgcttaatagacattacattttaattaccatatagaacatcgtaatgactcagctatttcctttctcgcctgtaagaagttaattttgattcctctgagttacttgcttgagttttatttttaaaatggacgttttaggctgcaagatgcctctttttttgcagttgattaatgagaaggcaaggcctgtgagttatttctgccctggtctaaattctatccagatggatgcttggaaacattaccctggggtgtgtgagagcgtatgagaagcatgtgtatcacatcaagttctaaaacatggggctgggattgtggtgaaactgagtagggaagaagactggagaaattatggttgaatctgcaacaaaaaggaacggggagaaataaaacctaaaaaggagttttttgtaagacatatatttaaccatttattacccataatatgaccaaaaatgtgaatatggtaaattgttttcttctgcttctcagaaagcagaaagggaagaaagggagatcattttcctcagaaggtaaattacatgcagttgtctctaaaatctttctattcaaagtgcagtgcaatctttctgaccagttacttcacccctgcggtttggtgggcagggaattgacagaaattgtattttatacttgcagagtgcttttagaaagtgataggtctcagttcaagaatcagaatgagataataagaaacagtgattgtactatttttgttccacatcctacatttactaacagatctaagccaaagggtgtagttgcttataaaatgtaccagcctaaagcaaagacttccaagcatawtaaagctttttttatagtttaatttaatccttctaggtatttgcctaccaccatgtccaacggaatgtcttttctgccatctagcactggattgcagtagtcaagtacttagaaaagaccttcactttgtaatcttctggagcatcggacagaatgctaatgtgcatgttgatcatctaggatcttgctgaaattcactttctcactgagttggttggtggggccagattccttgtttcaaacaagctctccggtgatgccgatgttgctggattatgcactttgcatagaaagattttagaggcaacttcgtgtaatttacgttctgaggaaaatgatctccctttcttccctttctgctttctgagaagcagaagaaaacaattttgcgtatttcacattgttgatcatattatgagtaataaaattgagcctgaatgtatrcacaaaagttggcagccatcccaaagatggatttagaccaattccttgcaaaataaaaaaaagattgaagatagaaatattgtgttataaatcatcagattgtcaaaggagacaaatatgtggtttgttttgtctgatgtggatatatcctgatttcaattatcagttatagcttgctgtraaaattccatctagwctagtccagatggtctatactgtagtgacccaccttggtgggattctgagagccaccagcttaccaccaggcttactgatttggttagagacctaccaatgctagtatctggcttgagagctaggttagagcagagctgaccagttacttcacccctgtggtctggtaggcagggagtgaccagagatgtgcctggtatattgattagtggtagggcttgaggtggtcagagcctccaggctggttatctctaactattctcctccattagctgagatagagccccaggggagcactatacttagcataaagtaaaatcttgccatggataatgttgagcattaacagaaagatacacatgacagagaagtacatttttcctttcctttccccttccccttccccttgccttccgttcccctcccttcccttcccttcctttcccttccccttccccttcccccttcccttccttttcccttcccttcccttccttttyccttcccttcccttccctttttcctttaccctttcccctttcctgtttgttcatgctttcatttcattggggtataaacctagaagtgaaattgctggttcatatgataatactatgtttaactttttgaggaaccaccaaacttttttatagggatggactattttacattcccgttagtaatgcgtaagagttctaatttctccatatcctcatcagcacttcttattttctatttttaaataatagtcttcctggtggtttgtagtgttatctcwttgtggttttgatttgcatttctctaatgactaataatgtttgaaaatcttttcatgtttttattggccattcataaatcttctttggagaaatgtgtattcggtttgttttccattttaattgggttatttgtttttaattttcgagttgcaggagttattttatattcaggatactaccttggtcatgtgtttttattttctttgggtatatatttaggggtggaatttctgggcattaattggatgtacatttaattttatgagaaactcccaaataattattcaaagtggctatgtcagtatgcagtcccacgaggaatatataagacttcagttgctttgcacgcttgtcaacaattgatcttgtcagccttttaattttagcccttatgatgggtgtggaatgatatctgactgtggtatttaagttgcattgctctgatgactaatcatgcagagtacttttcacattcttggtagccattttcttgtcttcttttatgaatatctgttcaagccctttgtccacttttaatttggttgttttttcattatctgtaggaattccttttatatttcaactttgagtcccttgctagataaatgctttacgattatctcccatttccccaccccggtctgtaacttgccttttcatttttttaaatatatatatattttctggacagagtctcactctgttgcataggctggagtgagtggcacgatcacccctcacttcagcctctatctcccaggcttaagccatcttcctgcctcagcctcccaagtagctgggattataggcacaggccaccacacatagctacattttawtttttgtagagagggggtttcactgtgttgctcaggctggtctcaaactcctgggttcaagtgatcctcccacctcagcctcccaaagtgctgagattatggttgtgagctaccacacgcagcctattcattttcttattcatgtctttaatgaaatgtttatttatgaattcaaatttattaattttttatcttgtggttagtgctttttgcattctatgtaagaaatatttgcccatcccaaggtcacaaagatttttctccgtgttttcttctaggatctttatgtttctagcctttatatttacatccttgagaaatattaagttagtttctgtgtacgaagataggcagaggtagaggttctttttttcctctctctccataaggatatccgttattgcatcaccatttgttaaaatgagttttccccttgatttgtcttggcaccatggattgaattggattgacagtgtatttgtgggtccccttctggaaattctttcctattccattcatccatttgtctacccttacaccaataccactttatcttgagtagctcatgtttttaagcagtaaggccaagttttgaaagtactcaactagcacctacatgttccagactctttagatatgttacctatgaacatcatatgaggtagatactatttcctatcctcgactccccaacacatcgtagttgcagaatataagacaagttgaataggtcacattcaagcaccagcgggtgttgttacaaatcccataattttgctgcctctccagaaattaagtacatacacctttgcagcgcatttaagtgccacctaaatgatcccatcatattgccccagttacatgttttaatggtttctttttttttattatttaccttcagccaacccacaccatgtcttagaggtactcagtgttttaaacaaaccaggtatctcgtggttttctgaatatgtcccgcccttctctgcacatgtgccttggtggcatgcttctttgcccaccatctatagtgcttacatccagctcacatgtatatttccatctcaaaaagtcttcccatcaagctattgcagagcaccacaatcaaatatgatgcctctgctttgcaattcttaaacgccactttataactctgatggcactcacactattctgccttatatattttttttctgtattctcgtccagttttgcccactaggaagaaaactccttgatggaagtgtattcgtcgtctttgtagctattggatacacatttcaacaagtccgagtgaaagaaattttttgagacagccaaataatgttgtgatcaaagttaaagaaagtttaaaaaagtgaacgggttaacctagcatgtgatccgggagaatcccaaagtctattctctcaatttaatccctttaaatatttttttcccmaaatcagatctttccagttggaagactctcaggactgcagcagagattttgtggagatccgtgaaggaaatgccacgggtcacttggtgggacgatactgtggaaactccttccctctcaattattcttccatcgttggacataccctgtgggtcagatttatctcagatggttctggcagcrgcacgggcttccaggccacatttatgaagagtaagttgtttctattttagtgatagcttccagaatatgtcttacaaactagaaataataattttctcagtaatatattaagcaagaacaatcctaaactctacactattttcctacattgtctttgtgaattaccttataacatattagaaaaactgaattgcatatgaatggctcaataagggcaagggagagcactctcaatggttctattgttctttttaagctctaatttctacctaatgttaaattagtttttttcatgacgttgtgttagagtctggtaatatattatagtttgggtttggtgtatttatatcaagtgtgtttcatttgatttcataaactctacgttcttcacatttaagacatttagtattactttgggattggcttaagtgctcacatataacaacaataggggattcttctaatagtataaaatgttaaatatttttattctctagctcaacttttccattattggctatttcatatgtaatttcaaactatcagtttttcttgtaaatttctttaaatgttccattcttttgaaaaacaaagtaaaatagataaaccaaaattagagagtggggctgctcaccccaccttcccatgtccccaagtcccctaggggctcagaaccccttttcacatgggaagttgtggcctcttttcacaccatgcaacgttttaaggaccttttctaaggaagtgatagcccagaaaccaaaaaggaggcagtatttctttccctagtcagaaaagaaatcacagtcaattaaaagtccatccttttcaacaccctttgccttttgtttttttcatttgattaaagagcaattctaagtgggtctgatttactactctgtcttccctcctagtatttggcaatgataatattgtgggaactcatgggaaagtcgcctctcctttctggcctgaaaactacccacataactccaattaccaatggacagtaaatgtgaaygcatctcacgttgtccatggtagaatcttggagatggacatagaagaaatacaaaactgctattatgacaaattaagggtgagtttccacatgcaatcaatgttcataaatattrgtgaattgctattggtaaaaataaatccaaggtaacgtctattcaagcatttgcaaatcatgtgggatagtctgctctaaatcatgtttagagcagactgcctctagattacatggacaaaggcaatttcagtattgtatttattattttccatttcatatctaaggggttttttaggattattataattttcctgttgagctttgtctaagcatgcatgtatgtcctaaataagtatttattctgtcttatttcctactatcctctttgtttttatgttagagtattaaaaattttaatgatcatataaaaataaatataaatataaaaatcatggtgatcattgctatccagacattggctaccatatcarttccagaaacacaatcggatgcttacaggctatgaccccaccttattcatcttggattcttggtcatgaatagatcccagtgcctgatgggtgcccaatatgtatgggaatgactattacataatttgtttggtagagtattttataataactgttcatatgaatttgtcctgagctatttaaaaattatcacagaatatgcctcaaaataggtaatttgagattttaaaaccaaaggtaggagatttactaagtgctttgaacatggtgagccctacaagttttggctattttgttgtcattaattcttctttccttctgtggaaatatggactcctttaggatacctgtccactttctctcattaaagcttttctcttcttgttattttcccttctttcttcctaattcctccctttgaagccccaaagcacatttattaagtactgttggtaggcaaccatcctggttcctatttttccatccacaaattttactgtaaatcatcttatgagtgattcccacagtgcatgtttattaatataattctgcaacaaagatgcaaatgttttcaaaacattaaattaccttcaataatattttatattctctggcagtatgtgttttaagctaaaattaaatgtttactcatttgtcatttttttgttatgataacattgtaataatataaggcatcttttttattttatctttttatgaagaaaaatatagataatacaatgctctattatctgtttttatgtacagatctatgatgggcctagcattcacgcccgcctaattggagcttactgtggtacccagactgaatctttcagctccactggaaattctttgacatttcatttttactccgactcttcaatctcrgggaagggattccttctggagtggtttgcagtggatgcacctgatggtgttttamctaccattgctccaggtgtgtttggtaataaatgaagttmtttttaggactgatatgtgcaggccaatgtttcaaaggatcctatcataacaggggtcagatataaaaataagtacagccccaaagcccttccaccatatgttcagatgttgttttaaattcataaacactaccttttgtagaaattgtacgtttctttctaaaaaatgcaggtcccattatatwktttatattaattaggggcttgatatccataagatcgtctacttacaatttctagagaccactttagaaatccctgaaaatttgatttgcagatactacacatgtacattcacacacacacacaatcagttagttaaggatcaactcataaaagtaactatttttcctctgcattttatttcaaatgtagcttcagaaatgcttcagtttctccttagctggttgtaaatttccatgtttcaaagtaaaatgggccgaattttaaacttttattttacttttttacattcctaatcccctcagtgaaagtgatattgagctagcattgtttggggagacttttttcttgaaaaatttttaaatgagaccgggtgcggtggctgatgcctgtaatcccagcatttttggaggcagaggtagacggatcacttgtggtcgggagttcgagactagcctggccaacatggcaaaaccccatctctactaaaaatacaaaaattagctgggcgtggtggagcgcgtctgtagcctcagctactcgggaggctgagacatgagaattgcctgaaccaggaggcagagtagagtttgtagtgagccgagaacatgccactgcgctccagcctgggcgacagagtgagactccgtttcgaaaagaaaagaaaagcaatttatttaaatgaatttgagcgtttcttatggatttcaggattgacatagaagaaattaatcagatatttcttggaggatattctaagtccttgaatgcttgattggaacacagaatcacggtatctcattgaagaatattcgaactctgaacttgttctatgacttaaaagattagcctatttgcttctaacttcttatatcagcagaagtcactaatgaagataatttgtacttatatttatttaatgtcccttagtattccattctgaaatgttgttcctacctctctaataaggtgctttcatgacactgaatacaaatctcttacttaaaatattgatctgtctatctaagagcaaagaaccatcagcaagactgacaaatgcaatttagaggcaacatttaaatctggatggatatatccagagctcttagaaataaacttgagttaagctttcttttatatttacaaccctcaaggtagaaaaggaattatttacttgtgtaaaatattataccaacaaattttcttctaatattttattacgaaatttcataattatatgatgtaagtggacaggtgaagaagagagccataaaccttatttttcttagtcaagaagaaaaagaaaaaaggaaagtaaggggtcaagagaattttagagtttactaattatctagatggcataagtgattatcctgtaatgataccacactgtgaaagtgtcattaaaacttaaaaaaccttaatattttgaaatatgtcaacttattgagcattgtcctatcagtatttctttctttttttttttctttttttttttttttttgagatggagtctcgctctgtcgcccaggctggagtgcagtggcrcaatctcggctctctgcaagctccgcctcccgagttcataccattctcctgcctcagcctcccaagtagctaggactacaggtgcccaccaccacacctggctgatttttttgtakttttagtacagatggggtttcaccgtgttaggcaggatggtctcgatctcctgacctcatgatctgcccacctcggcctcccaaagtgctagaattacaggcgtgagccactgcatccgtcctgtcctatcagcatttcttatacacacatatatttattttaaatcaacgcatatttattgagaatttattatggatacactgagaagactaagaaaggaaaatgaggtacaatctctactctccaggagcttaaaagtaatgggaaccaggcacagtggctcatgcctataatcccagcactttgggaggctgaggcaggagggttgcttgaagcccaggagtttgagaccagcctgggcaacagagggagaccccatctctacaaaagattaaaaaaattaggtaggcatggtggtgcatgcctgtagtcccagctactcaggaggcagaggcaggggaatcacttgagcctacatgctgccagtgagcagtgatcatgacactgcactccagtgagaccctgtcctaaaaataaatacataaatagtaaaaataaataataaataaaagagattgggaaagaaaaaacactcatatgtgagttaagtaatggtatcgtaattaaatgggtacatgacaaagcaaatggtaacagtagcaaataagcaagggaagaaaaatgagcttactgtggactagggtcaactgaaggaaattcaatgtgtcaagtaggaaaagcagtcagtgtgtcagtcaggaaaagctcagccatatggcggtaacaaacaatttcaaactcttaggtgctgaaaacaacaggtctccttctacatgttcctctcgtgttaactgggtgcctctcatcatccatcacttcctaactcaggctgttggagctgccattgtctgcgatattgcctgagaccatggcagtaggcaaaagagcccttggatgtctcggtttaaaagtgctcactgtaaagtaacacatgccttttgctcatagttcattggccaaaactggtcaaatggcctctctcagccacttgcagaatgcagttctaccatgtgtttggaagtggagacaaaggaaatatytggcaaacagcactaatgacccacagtcattataaccatattttacaaattcaagataagaaatatttcacatagaggaaaaccttaaaatttgaagatactggataacattcagcattcagattttccatgtgaaattgctttaaaaaaatctgtagcctacatagtaatagggtaaagaaatcaggacctagttctacaacattttatattcacttcctgttggccctgataagattcaaacatattatggtgtacaagttgtaaacttctgaaatggtgaagattggatctctgaaatatattgctacataaaagtgatggcaaaaataattgttaaaatcaactttttgagaactctggaaatagaccaaagccttatagcaatctgyggcatatttattcaagaaaaatcactgaatctaagtaagagtcatttttgtggcattctcttcctattcccatctctctctctcctcctagctttgtagtagcctcatgaccacagtagctgtgaaaatgagcagctttaacagctgtgggtggtggggccgcagaggtccagaaaacagcgcatctcctcagcattgccattattccagttcagcaacttcctggaaaactgcattctcaggtcttgtcttcacaggacctgggcaagagctcactcttttgtaaacagccctgtccctggggtctttgccgaaaacaatcagcaacagctgtttcacatcacaaccgtgcaaggcagtgacaccagttacagctaatgagaaactgaccagtaaacttgaaaggaaaaaatggggaaggagatgcccactggggctttgaaaagctccgacatgtttctggaaatctagaaggccacacacatagcccagctgtgcacatgcccaaaaatagaccccgagaaggacctaatctgtcaactcaaaattgcctagatataaattacaaaagtaactacgcaaaaatgataaagaaacatgagaaacacaggaatgaatacagttctacctcagtaatacaggggatcctctacgtgtctttattgatgcctaaatagtcagcacttgatattaaatgggttatatagcaaaattatggtgaaaatggagaacacaatgcattttttttacatcaaagatcaaytgcggaaattgcagctttccgaatcagtgggttacatacgatattcattgatttctctgagaaattgtttcaattggttgcttcttttcagtagagggctgtcactttcaagtgaaaaagtgctagctagcgtcttttccattagggctgtgtcaaagatgttgctttctattctacaggtgcttgtggtggcttcctgaggacgggagatgcacccgtgtttctcttctccccgggctggcctgacagttacagtaatagagtggactgtacgtggctcatccaggctcccgactctaccgtggaactcaacattctttccctggacattgaatctcaccgaacgtgtgcctatgatagccttgtgatacgagatggtgagaayattataaagaatgctgagtttcaaccctgacacataattagttctagtccattatcatcagacttgcatactgcctccatccgtttggtttggaattacacagatattatggtcaaggaaggcatcagtaccagaaatggctacaacttctgaaggacatagaaagtattaaattaccggtcacagaatatcaggaatagcacatttctataaggaaaaaaggcttttttagaggcttaagaaggaaagaatagtctgaatgtcaacattgttcacctgtcctattgagatacctctgagataaatattgatattttatgtttctggctgaaaaaaatacttataattgtaatgtgactggacatagtggttcacaccataatcccagcactttgggaggtcgaggagaaggatcacttgagtccargagttccagaccagcctgggcagcagaatgagaccctgtctctaaaataataataagaagaatataaaatagtaatgtattcatttctctttgtcccctgaatgtgggtagaataggtagagttaaggggtgatattgttgtattctttcctttgtacacaggcatggtgttgctatgtgacataaagttagagacataaatattgctgatgtatgccttatacaaaattgggcttcacagtctgcatggactggaatgaaggaggacagcagaaaggccacatcctccacgtcagtatttctcagtgtggcccccagatccacagcatcatttgttagatgtacatgttctcagcaaaaagaaacgtgtttgtctttggcccacaggttgctagtgtgcaagatcttgtctcccttatccctgatccctagacccctgccgagtgagaaaaatcgaatggtgaaggtgctttatgtcccttctgtagaggcagaacactaagtagagactcaaatcaatcatacacacatgatgagatgtcaaagcatgacactccccctttttcccatcagcaatcggctatcagcacgttgcacagaggagtatcaaagcaccagaatgccctcttcacatctaagccttcctgtgcatactgaaatttaaaacttttcatgtaatggaaaggatgtgcatccttgcacacatattctagtgttcagaacctactagaagttttaaaaaatatctttgaaaaaaatcttaagtaggtaactgcatctatgaagtaaattatggttattcttttaaaatcacattccattgagttgtttttgttccatcactaacttctcttggaagcagagagtctggggagcagtccttttttcctgtgtggctttgcacaggtcacaaagtggctccaaacccsttctacctgtgagatagacaaatacctccctcacaggctttttctgaggattaaggaaagtaataaatgaaatctttttagcaaaagtacaagcattttgtagatgatgaatttggaatagtttagatttcagtttacttagatggaaatttctaagagaggtttaatcagtgcccttgctcaggcacagggcggcttgaaagagctaaagaaactcaggtgcgtgccaaaacaacacaaatgttttaaagtggttatgcggcctttccgtatggattcctttttatgcactggcaatgtgagtagatgctcaataaggttccttccttcctcatttgtttaattatttattcaagaaatagttattgagtgcctrgtctgtgtcagttggtgagtattgtagtcatttacacattgttaatatatttttatgactaaatttgatgtttttttttttttgagacggagtctcactcttttgtccaggccggactgcagtggcgctatcttggctcactgcaaactctgcctcccgggttcatgccattctcctgcctcagcctccctaatagctgggactataggcacccgccaccgcactcagctaattttttttttttttgtatttttagtagaggtggggtttcactgtgttaaccaggatggtcttgatctcctgacctcgtgatctgcccaccttggcctcccaaagtgctgkgattacaggtgtgagccaccacacctggcctatgactaaattttaaatcccacttcaattatttgttctttgcccagccagccttttgcttctgagtagcagaagcatgtaacattctgaagcaaatatctaaagccaactggccacagacaaagatacttataggctattcctgctcatgcaattggcctgtcatcacaggcctttggccgtatggaggctgtgaaccttcctgggctaccccagagagggtcatgcagcattcttgggagaactgagtcactgtcccacctgcttattcattttatagagttgccatggttcaaaatgaatcagtttcttccagaccacgcatctacccattctgtataccaaagatccctccaaactgagagtccatgaaactacattggtcctagcaaaacttttaaatagaaaagaaattgtataaaaaaatcagtaatcctttaatctagttccagatcttaagtgtactttcttcatgaccttagataaatcatttaatagcatggttttggggcatctgaggttaatctgcaaaggttaacatcactgttaacttctatctctatgcccttgcatacagcaaagtggcttgtaactcctgtaagattcagttcctcatatacaaaatggggataaaaataaatgcccacctaatagtgtcactgtgaasataaaatcagatagtacatgtgaagcacttaaaggggtatatastaattgctcaataaatgtcagtcttgaataatcttggggcctcagtgtctatatctgtaaattgaagaggttggactagagaaagaattgccaagttgccttctagtgctagcctttactgttctttgacttcccctcctctttaaagattaggctcaagattaggctcaatctttctgcaatctatatgttgaggttttggaaggctccagaaataccccagtactcagtatgaagactgaaggggtggatgggcaagtaacaaaccatctgtgatttttgggtcatcttcccactaatgagtaggctaatcaacaagcacttattttgagataagcattgtttcaccagatgatctggagtgaattttagaaaagaaatcaaaatcaatagactcaactcactttcatccagtgataaaatatacacgtgaactaataacatataataaacttcaaaattttgtagtacaggtaatcagagaataagtcaacaaaaaataatattgggtgaaatgtgtagcaaaatagcataatgaagtgcacttactataaatgcaaaagaactataagagatacacttttgaattataaagaatgcaaaagtttccagcgatcagaaaccctccaaagaatgccattttgagcattttgtatttataactctgccattacatttgtaatcacaagaatagaaaataacttattttctaaagtggttaataatgaatgagtttcaagttgtagtcagtgccacaaagaatccatgtggctggttgtataaaagggcatatttactcatgtctcatattctatttttgttttttataaactcgaratttattaattctctgccttaggacaaaagagaaaaaaacaacatattttcccagccacggcatccaagtctgctataatcccctttgctccattttggtttcagccggcacaggggctttgatcaaagcttatatccaagataatcaagatgaaaggagacgtgtggtgcccctgctgtcctttgtgtctctgtgggggtggggcacagttgctggaactcttctctcaccctccacacaaatgtgtggttgtttttataccaaaacaaacaaaagcaatgaacaaacacagatgaaaagttttgtttaaaaaaaccccactggcactgaagaaagggcacatacaattgcataccttttggtgaatgatattgtaacattagtgtaggatctgaggtcaaagagccaactgtttttttttttcttttacctacttgaccttcagcartcagagtaactgaggtcagagtctctaatcgacagacatatcatcactgggtctccatcgcttcccaatcccaggtactctgattttgagttttagtgacagggagaactggcagccagtttttagaaagacggtggaaactgtcaaagacgtctttatcaaaaagggtaaagaacccagcactttgggaggctgaggagggcggatcacttgagatgaggagttcaagaccagcctggccaacatggtaaaacccctgcctctactaaaaatacaataattagtcagaagtggtggttcacccctataaaaccagctactcaggaggctgaggcaggagaatcacttgaaccccrgaggcagaggctgcattaaaccgagactgtgccactgcactccagcctgcgcaacagaggaagactccatctcaaaaaaaaaaaaaaarrggggggtggggtggggtgggggtaaagaaaagggcaggaagcaccattgcaagctggagccagaatgatatcacccctgaggggtccttctttttgaggatcccattatctcctacgagtcctgatgttctgagaaaaatgtgtgagctgctttggctaagctgcaaatgattgtagagtagattctcaagatgtattttcatgttgttccctttctttcaacgtaggagataataacttggcccagcagctagcagttctctgtggcagagagatccctgggcccatccggtctactggagagtacatgttcatccgcttcacctcggactccagtgtaaccagggcaggcttcaatgcatcctttcacaagagtaatgagttcaaatattttttaatcccatgttatctcatctcctctcttttcctctctctttctctcttcctaatataatgtttttgggcaccaggacacaagacaagtcagaggacatgggtctctgcccaggctctggatggctggctccccttacatcagtgctgagtcctcatccaaagcactggggccaagtcgtacaaaagtgtgctgccttcaggtctctggtgkggcatcttcgctccaaaggaggtgtgtccagggaatgcatgagagagagctttaaagcaatttttcagcctagctgagggctggaactagatagagcacagctcatatccataactcatcgaaggagcaaaacgtcatcatttattctcataaattacttggttgaagtcagccatctgagggttggcaggaagagtttgttgctcttgaaatatgaatttgatgagtcaaaagcrggcaccatatatgggataccatcatgcacagtatgattgagacttttcaaacttgacatgtgaagtccagtaacagccttaaatccaaactaactgaaaggtgataaagtagtccaaggaagagtgaaagactctcatgttttgatcaaaaaacataattttaaagtagattctcaatctaacattaaaaattaatctaatatttcctccatgcttatatataccttttataaagtagggagcaactgaagataagttgtgttcctcacgctcaagggaggcaggctgcatagtggcttaagagcatgggctttggaactagacctaagatacattttcacctctacaatttaactagctgtgtgagatgtctgcccttactgatgagcttctrgtccctgacaactggagaattaatgcctcctccttttatcctcttcctttatctcctgccctctcactctcatgtatatattactatgtatcgcaactcattatacatacatacatgtatacacatgtatgtatatagtaagggtggaaccattggaattaatatgtgtgtttatatatgtatataatatatataaatatgtgtgtgtgtctatgtatatatacatacttggcagctcccggtctagaatgtatttcaaatttaacctgtgagtggtataatggactttggagactcagaagyggggaggatgggtggggtatgagggataaaaaactacatattaggtgtaatgtatactagtcagggaaccagygcactaaaatatagacttcaccagtatgcaattcatccatgtaacgaaaaaccacttgtatcccaattagaytagatagatagatagatagatagatagatagaaaaaaaaatttcacctttgaaagytgaacactttattcccacccttttccatgccaccaccccccaattctacactcctcataatctcagcaaatggaaagtacatttttctcattatttaagtcaaaatcttgatgttatttttgacttttctgtttgtctcacacttaaccatcaacaaatcacactggctctaccctcacaatgtatctagattccaaccacgcctctccatttctgttgctaccagcctagcccgtgcacctatcatctctccttggcctcaggcggtcccctccttattggacactctgctcctgtccttccctgtcctccaccccttacagtctaaggactgcacatagagtgacattttcaaacttaagtgagatcatgccattctgatgcccaaaacccttcaacatcttcctcttcttattcagaataagtcttttcagtttcctgcatgacctagccatgctacctttggaatctctcattctgcctcatccattctgacttccatgatgtacctctaacacatcaagcctttacactgttttctgaactggaatgttttctcccccataactatctggcttgatccttcatttcattcatgtctctgctaagatgttactccaatgacgtggcttttctaacttaactctaacaataaagtacccttctccctcctctcatccatttttctttatagaatttatcaccatctcacatatcatgtatttgtttattgtatgtcttccccakctataaagaaatctttatgaaagcaggtaatttgtcttgtttacttacctctgtatcccagatctcaatgaccaccacaaactgagtagccaatagcatgtgctcaatacatgcttgttatgataatcatttcctgcactctggctttattttcaagcatttttattgcctccactttgaaaaccccccaagaaaactaagaaagcataaaaatccagttgccaatgctatttaaataaccgacctttgtttctttgtgggaaggctgcggtggatatttgcatgcagacagagggatcatcacgtcccccaagtatccagagacttacccatccaacctcaactgttcttggcacgtcctggtccaaagtggcctgaccattgctgtccattttgaacagcctttccagattccaaatggagattcttcttgcaaccagggggattacttggtggtaggtcttgctgctaccctttctaattacattttccatagacttcattcagaaaacaaaatgataatttttctctcctgggacataaatggataagaattgcgtactccttcttttgcaatgtaaaggagttgatgmaattttaatttgtctttccagctaagaaatggtcctgatatctrttctccacccttgggaccccctggaggaaatggtcatttttgtggcagtcatgcttcatcaactctgttcacctcggataatcaaatgtttgttcagtttatttctgatcacagtaatgaagggcaaggatttaaaatcaaatatgaggcaaagagtttaggtaagtattttcactgagaattatatctgcttttcctgcaattgcttgatcttctttgatataaaattttcttttctgaaccaacagtaatagaattaataagaatgcctactctcaagtacttattatatttgatacattcaatatctcatcgtgactacttttcaagtaaagtatcattatttccattttaaagataaataaaatgaggcttggacttttccaaggccacatacctaattagtgaccaaagtgaaattttccatgagtataaaataaactattcttcttgatccctggaattccttagacctttccattataagatgtctaattgtaagttaattctagttacagaaacattataagacttacatttgccttattttgtaataatttgtatgctgttttcaaaagaacacataattttttgattctattattactgatttaattatatattacatgatatctgtaattgcttgtacttaattacacttgattataattgcatttaattctactgtaatgatttgattttgatgacatttgctttttagtaatgtttaattgaataaataaataaataaataggcatcacttcaaaaaaagggagtaatgtcagtagaaagtaatataataataaatttttcctttgtcccaccagaagttagataatatagatttcaaaatgatcctatgacttgaatcccagattcatatatatatatatgtaaatgaaatcatatgttttattgcacattgtatgagatttaaagtcaacatggtttctttattttggtaaaagagatgaataagagtcttcaccaactgacacacaaaaataagcaaatagcttgagtaaggtccagaacaccagggaaggagctttggtcacttcccagagctctggcacaaggagggagctttaatgcagctctgtgggcacccgcgccattgctttctaagctgggaccttctcatccctccatctcttgatgctgagctttgcagctgagtcatgaatgggcagttttcacctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacctctgcctcccaggctcaagtgatttcctgacccagcctccctagtagctgggattataggcatgcaccatcatgcccagctaatttttgtacttttggtaaacatgggatttcaccatgttgcccaggctggtcttgaattcctgagctcaggtgagccacctgccttggcttcccaaagtgctaggattactggagtaagccaccgtcctcagccaatagactcagtttgatttatatttttaaagtcaacatttagtggtaattcagatacactaagagatacactaagggtgtgtttgacattgcacctcttctattcctttgtggattcactgttcatgcaagtatggttatggccattactttctccctgtctttcttgaagcttattatgactgctgttaacatcagacttaaaagtcttttgatttcacaacctgttcttggcaacctgaaacaacagcatcactgttatttctctctacttaccaactcaagattgttccataactatagccagccttctacttcccacgtctatctggctatcttcccaccatatctatttccatgccactcccacttctcagcctttaacctaggtccttttgtgaacattttttgacatcaaatcacctagttttataccatttttctccagagacactccttcrctrtggttgattgagatttctaggaccctgtggtagatgccttttattctcacctgattaataggcctgttaattaattagtcaaacatttacaaggtgttycacatcatgcaaaccaccgagttctgccaaggagttcacagtgtggtaraggagacagacaagcaaaggcacaattagaacatgatataaggctgggcacggtggttcacgcctgtaatcccagcactttgagaagccaaggcaggaggatcacttgagcttaggagtttgagaccaacctgggcaacatagaaagaccttagttttcaaagtagctgaacatggtggcgcacttctgtggtttcagctgctcagtaagctgagttgggaggatcacttgagcccgggaagttgaggctgcagtgagccacgatcataccactgcactccagcctgagtgacaaagcgagaccctgtctcaaaggaaaaaaaaaaaaaaagaacatggtatatggtataataagtgctagaaagaggaatgcacagaacagaaacacctacttcagcccaggacatcagagagggttccaggggaagtggatgaagagatttgcccatcagtgataaaaagatgtgaatgcatagaaartctcaatgttacaagtcatattcaataatttgaaagaattcactactgctagagatcagagtcaaaaagagataaacataatagtgatgaagcaggcaggaatcactctgctcagggccctggatgccaccctcagttagttaagatgttaatcaaaaggttatgggaggcattggaagtttttgctccaaagcctgaacagcgtgatcagattaaaaacactaatgtagctgcaacactgaaaacattggagayggggaaggctgaagagagagagaccagatgaaagagtaatttagggaaaaaatttactccctgaactaaggcaatggcagtaagaaggtaggagagagggcatatcaaagatattataaatacaggattgagtgaatttggcggtcagttggatgtgaggcaggagggaagggatgggaggagccttaggagcagttgttaggtttttggctgggtggatccattcttcccacagacatttatcaagaactttccatgggacagacactgtatcaggccccggggatgtggcagtaaacaaacaaaatccatgtcctcatggaacctaattctagtgttaagatgcagacaataaataagtaaaatatataatatgccatatggtgaaaggtatcaaggagaaaaataaggcagtaagagtggatgcagagtgtccataggaagaggggctgatgctgtcatcagcagactcaggtatggagctctggatgacgagcaaatgagaatgttcatttgagacaagttcagtttgaaatctctgaattacctccattggagatgcccagtaagtggtcggaacaggaatctcgaggtcagaacagggatctagactgaatctgtaaatacggaataatcaacagactgcttatcatttaagtcatgaggatgtatgacagcaattggggaattattcagagtgagatgaaaggcctacaggaggattcctgagggcctccagcaatgtcagggaagccctggagagatgcgcccaagggccagaggaagaatgacatgaagagtaaaaggaggagaagagcttggtgtcagaagccaagggacaaaaatgtaaagaagaacagtgtgatcaactgtgttaaatgctgtggatataaaataagaatttaaaaagttctttgggcatataactgtgaggtgacttgggagaacatgagtgctttcatagggttgaagaaggaagggcaaaaagagagaaggagagagacagacagacagatagggagagagagattaaatagggcaagatcctggaggagacagtaggatgggaacttgatccagagatacaggaagttaatgtacagagggaaaaatagagtgtagagatgcagattaatttattgaggatagtaataaattaggggtaacaaatggaagagattctcatctgatttcttctactttctttgtaaagtggagcctaatgtaatgtgcttagaatcaagaggaaatggggaaagtcaagggcttagggagtaaagttccaaacagccattgtagtttatatgaaaagtaatgggtgaattgcttggctgtgttgagatgggagaacatatatttgcaggggcatcaatttccttgaatgaatggcttgaattgaacacaaccacggagttggtattttgcaagggaagtttgaaggaaagacacgaagcaagggagttggagctcatcaaagggatttgcaatttagagtttcagagatgggggagttggaagtatgacagaattcaggatgtgactgtaagtggatgagtgacagtggacacaaatgttctagagttgagcagatcaagtatgtgtatggctaagtgattggacaggttaatttcattggcattgtaagtacttttactcctatctggtttgtttgttgaaaatgccaaagaatatttattgataatagaaaaatattttttgataatgctttggttttttagaaaagaaatattaaaaagctcctttatcctctggcataacattactaataaattatttcattccattgatcttggttctcaaatgcatctaaatcctgaagaaatstaatgaatgaatgctccccgagttgtgcaaagatatatctgcttagtcttttaaatataccaagatcatagctctgcatcattctgctgtactgaatgctcagtgggaagctgtaactgctagcatacttacatgcttatcgaagtggtggatatttattcatgcttctgtgatgttctgccccgtgcaccatgtgccataatcatttggttggctttaagaaagaatgaaatttccaatgagaayagataaatggtctggcaaaataaaaagtgtcacacctcgtagctccctcgatagcaaattgagaatttgtttgctggaaaagaaaatgaggatcataacagatgaaaggaaatggagacaaaatacagagaagtcgactttaaaagatgatttgtggccattgactgcatccccttcaccagatcatagactgatttaagtgtgtttgctcacagcctgtgggggcaacgtctacatccatgatgctgattctgctgggtatgtgacctcccccaaccaccctcataattatcccccgcacgctgattgcatttggatcttagcggctccaccggaaacacgcatacagctgcaatktgaagatcgattcgatattgaagtaacacccaagtatgtcacttccattttcatttttttcctaccccaagttagtattttttaaccgtcatgtctcaaaacagtccatttctttcagtagcacatactgcaaggaaatctaggggaaaagggaaatgcttaatggctcaggcctgaaaacacagtcggccagccactctcccatcagctgagccggttatgtacgtggatactgtcccttgtgaccctagacacttcctgcaagggacactgagggtggctacttgagattgatgttatccattcttcctcccacaggaaatatatcatgtttctgatagatgaatatttatttgaccagcctcatattcggtgtcacaaatgataaaatgtctgtttaacaaatgggaatttgtgtggtgtgtcaccaggggtcagcactgtcggaacagtactaaagcatgcacagtataatttctcagtctttatttaataagagttctgaaaggattacaaaacagtaagtcttactatgttgaagagaaagaaaaactatattgatcgtagaaaacatttttctctttccttgaacaaaagtatgtatacatttgcatgaatgcagctgtggtgcaaaacttggatataagatcttctgttgctatttctggcactgggtctaatactacttttccactcatggagcattaattggctaatgtgacttcctgaagaaacgttagatacatgcttatctacttttatggacacagaaaattccagttgggacgctccattagtcccaattacagagctgttagagaatttatctttgtcctgtgaaatgtatcaagtcattgtgtggaacaaaatatttgttgttttttgaaattcctagggactaatttgaaagcaacatttatgtttgtaaaaccaatacagaatatggaagggaagtaaatattcttgaatgtagaacatgtaaaacctgtcttttgagctactaataaaagaatgtattattaggaaaaatatcatacagcattttaaagtgacatggcttatgctgattctatcatagttttttatgctaagaaatgatgatttaataatatcttcaaagaaagtaagtaaggttgtcattatcaaaataagcatctgaccatgtaaatttaacagaattttgttcccacttcagctgtacttccaactaccttgagttgcgggatggagtggattcggatgcaccaatactttccaaattttgtgggacatctttgcccagcagtcagtggtcctcaggagaggttatgtatttgagatttcgatctgacaacagccccacacatgtgggattcaaggccaagtattctataggtaataatttttttaaaacttttattttaggttcaggggtacatgtgcagatttgttatataggtaaattcgtgtttgggggtttgttgtagagattatttcatcagccaggtactatgcctagtacctaatagttattttttctgctcttctcccttctcccaccctccaccctatcaaatgaaagaaaattccgtgctcatggataggaagaatcaatattattaaaatggccatactgctccccaaaatttacagattcaatgggattcctatcaaactattatgacattctttgcagaactagaaaaaactattttaaaactcatatggaccccaaaaagaacccaaatagccaaggcaatcctaaacaaaaagaacaaagctaggggcatcacaatacctgacttgaaactatactacagggctacagtaaccaaaacagcatggtactggtacaaaaatagacacatagaccaatagaatggagtagagagctcagaaatacggtctcacacctacaggcatctgatcttcaacaaagctgacaaaagcaagcaatagggaaaagattccctatccaataaatgatgctgggagaactggccagcagtatacagaagattgaaactgtaccccttccttatatcatatacaaaaattaattcaagatggagtaaagacttaactgtaaaacacgaaactataaaaaccctgggaaacatttttatattaaataagagttattatagaatgaatatgttaaaacttttttaaaaaccatgactttttaaaaataagtctatttgcctaattttaaaaatattttaatgctagaaataagtaaggagtgtaaatgtttgaaactacagtcattaatcaactttaatttctcttttaattttcattttaaaaagtaatcttagtaaacttaaatattttatattttctctaacttatttgtgaagaaatatatgtggttaaatcaaactcctgtttcttcagcttactatgaaatacagtagttctctcttatccatggtttcatgttccatggtttcaatgcccttggtaaacagaggcccaaaaataggtgagtacagtacaccaagatattttgagagaccacatttacataacttttctaacagtatactattatgattcttctattttattattagttattgttgttaatctcttatgtctaatttatacagcaaactttatcataggtccatatatagagaaaaaaacagtctatatgtctgtatagggtttggtactatctgaggctttaggcactcactgggggtcttggaatgtatcccccaaggaaaaggaagaaatgcagtatgtttattactttaagtaataaaaccatttaagaaccaggtaactctatttagcacagtgtctttgaattcctcatcaaatataaaataattaaccttttttttctctgagtctctagtgccaaatcagtcactggataaaaagcaaacatgtcagtggggcatggtggctcatgcttgtaatcctagcactttgggaggctaaggcaggtggatcacgaggtcaggagttcaagaccagcctggccaagatggtgaaaccctgtctccactaaaaatacaaaaattagccaggcatggtggtgggcacctgtaattcctactactcaggaggctgaggcagagaattgcttgaacccaggaggcggaggttgcagtgagccgagattgcgccactgcactctaggctgggtgacagagcaagactctgtctcaaaaaaaaaaaaaagaaagaaaaagaaaagaaaaaaagaaagcaaatatgcctcttcagcattttgatttccttatttaaaaaatgagcggttgaagattcactataatatggtcacaatagcacataatttggtatctaataggtttagacacaaaccaaacaaatatttaataccgcgaaagttcagaaagcctagtggtaacaatgtttaactacaccatagatcgtgttatatcctgagtcaagctgcatataattcaattagctatcacacccagctaataagacataattgaatagtaattttcaaggccctgagatatcagttactgtagtgaactgtttagttgagagtaaaactaggaatggcaggtgtccccacagtaccccttccagctgagcttgggttcagtctttaggatcaacacagggtactaggcaggccagatcagcctatcagttggttcttgagatgaaacttacttgcgactattagctcttacatagtgtcccaaaagaattaatgtgacattacagaatattccatttagtcatcatcttctgtttcccattattgtattggacttgtggtatcatttctgtttacatcaacagtagaattcaaataatgaggaaagcactaaccgttttcagaatttttaaaacttcaattcagagtcacttggcacctaaaagttttcaaatgtgctggtgaaatgaagaaaacaaaatttgtaatagaatcaatctttcttgcttgcttgctttcttatttatttatttatttttattttttgcagctcagtgtgggggaagagtaccagggcaaagtggtgttgttgaaagcattggacatccaacacttccatacagagacaacttattctgtgagtggcatctccaggggctctctggacactatctcaccatctcttttgaagactttaaccttcagaattcttctggctgtgaaaaagacttcgtggagatctgggacaatcatacctctggttagtaaaatatatctgctctcttttgggtgtttattttcacatgtacttattcagcctctgaagtttcttcacttccaagaaaggcaaaagcacatctatactctgcagagaagtgcagactaatgagctttgggcagtactggtgattctctccctcaattctaccattaacaatggatgcccagagcccaggtgtcatatagcccaccctggaggccacttggggagagcaacggtagtgggaaggcacctcttgctgctgagacatcccattgccacatgccgttatttgaggggtgttctatagcttgagatggggaagggatcatgcatgtctcctagtggtagcataaggcagatacttgtcactgttgtctcagatcattttttcaaccaaatgagcaagccttcctcattgtgctgagatatccttcccctaattggttgcatttttttcacttcttcatgtatttgaatatgttcatttttattcatgttttcctgttgtcttgacagagattaacgtttcttcataggcagggtcttgttttttattattttctttgtacacacaggacaccttgaatagagggtaaaggaaatcaatcacttggacatgtatatttaattatttgtctctcacaggaaacatcttgggcagatactgtggaaacaccattcctgacagcatagacacttctagcaatactgctgtggtcaggtttgtcacagacggctctgtgactgcctcaggattcagactgcgatttgaatccagtatggaaggtgagttcattgattcattcaacacaacattgagcacctgcattggacagacactatgctaggcaccagtgttaaaatatttgaaaaacaaaacaaaacatgacccctattttcttggaccttaatcagaaattcacagtgataaatgaaaaattacagctgtgatcaatgctataagggaaaataactagtatcacgagagagataataagaggatgagagttatactgtaatgcccaccttaagagagtcctgtagttactcagaatttgtcttactgcaaacccaacaaactcaaatgaaataaagatcttgttcagaaaaactgggtacttaacattaactttctgattttcctcttttttttttttttgtgaacatggggtcttgccttgacctcccaaagtgttggggttacaggtgtgagccaccactgctggccaattttcttgattcttttttttttcttttctgagacagtgtctcgctctgttgtccaggctggagggcagtggcatgatatcagctcactgcaacctctgcctcccgggttcaagcaattcttctgcctcaggctcctgagtagctgagattacaggcgcacgccacgacgcccggctaatttttgtatttttattagagacgggatttcaccatgttggtcaggctggtcttgaactcctggccttgtgatctgcctgcctcagcctcccaaagtgctgcaagtgtgaaccaccatgcctggcccgattttcctgattcttaagttcattacattcattggtctctcatttcttgggccatgatgataactaaattgctgcctgtggactatcacccatggaaggcagggttaaatattaatagagataaaaaatgaatgtatatgttcactaaaatcctcatgcacataaataaatatggagactaattttatctagaaggataatttttaaatacctgaattttgagagctttcttgatggaaggaaacattttgatttgattgaaagttttcttggctttttccccacgtcagagtgtggtggggatcttcagggctctattggaacatttacttctcccaactacccgaacccaaatcctcatggccggatctgcgagtggagaatcactgccccggagggaaggcggatcaccctaatgtttaacaacctgaggctggccacgcatccgtcctgcaacaatgagcatgtgatagtaagtgttccctgccgcctgagatgttatattccatcatttaaagagtttaccgacccataaatcatagtcagaaaactaggtcaggaaaattgccatctatgcaactataactcagacaaattctaagtattgttgaaagaacaaaatcacagtaacctgtcaaaataattgtaaaagttgtttgaagagamtatcagctatcactctgtgcatcagggtcatagaataaattttaagagtgaatgatcacgacaaatggcaaaaccggagaggctgtgggaagctaagcctacagcagcacacagctgaatgggaccagagtcacagcacaagccaccacgaaagttctgagcaggtgggtggtcctgcataagcactgctctctccaggggtacagagggactcttggtgggagagcactgctacgtgacctccatgtcaccaacctccagtggtttcacatgtgtcttcagcactctcagcttcctgcagtgaaagaaagcaaatgagatccctgagtgtgaataacaaatagattgttaactgtgaagtgctgtgcacacatatgtgtgtgtagataggaagattggattaatattagtaaatttatccacccaacttgccccttctgcagtgtttgttatctcagtaaataattccaaacttctggttgcttgggtcaaaaatcttgatgtctattttggaatccttcctctcacaccctatatggcatctataagcaagtcccattgggtgtatctttaaaaatatccacaattgaactatttctcatcatatctgctactaatacccccaccgttcacttggattattttagaaagttccacctcgtccccctggttccgttctcctctccctacgttctcaacacagcagcatgtgatggttttaaacctcaatcggatcatgttgctgcctttgaaaatcctctaatggcttctcatctaactcagaggaaaatcccaaattgcacctgtggcccacctggctgacattatctgctgcccctccctcttctacctgtttgtcttatctcaaactcctctcttctttgctctctgggatccagccacctggcctccattccgttccctgaatgtgctgagatgctccccatctggctgttgccttcatctggaatgcccctccccagatggcggcctgctccacaccctcacttcactggggtctctgctcgaatgccttttaatccataaggtctaagtaccttatattacagaccccaccctggcctgacccttctctgccatgttgttttgcagcacttcacacctgctgccatacatcattttgatttgttcatcagtttattgtctgcttcccccactagaatgtgagctccttgaggtcaagccacagtttcattcactgctggggattcactgaatccccagtgcctgtacataatagagataaataattgttgaatgaatggatagtagaggtactatcattatcccttttataacaagccacttttgttttcagtttaatcgtctcctgttgggtagtgaatttcaaaaatatgaaatatctttgtatcttatgaccactttgtattgccgtaaaatgatctyattcaaccttcagattttatttccaagttctaatatctgaaggactgaactgttttctttcagatcttgaaaataagaaaccaagtgtgttttcttttatttgagagccaggaaattttggactaaggttgtttattataaagaaacttttttcctattattgattgaattatataaacaaagatgaagtagaaaaaatactaaccactcccactataccacattttgattcattttctcatctcttcttggcaaagcatactttatgtacttgtaatcatgtgatataaatccacttgaattctgattttaatctatttttctggttataaatataatggatgcttattgagcaatatttggagagttcagaaaataaaaaatataaagatatttttaattctactcatgtattactaaaattttgatgtatgtgctaacagttgttttttacctttgaaattattttcatagtttaaatcatactgaatataatgattatcaggaattttacaagcagagtattcacatgtcctttaggaaagagaatatgaacagtcatagttttagatctcaaataaaagttacagtcacaaccacaaattccaaagcagatcttacttgtcatctccctatcccttaattatcaacttataactcttgcagctactgctggtgggttttatgtcattatttctaaataatattcctattctactactccttgctttttttggacattatctatccacatcctactctagaagatgagacttacccctttgccaccacaaacacacatggggtatgcaatgtttatatactttcccaatcgtctcccaaaatacgtatgtcacgcttttgcttaaattgctgttcagttgacattaccatgattatgtaaacaccattcacaactgagccaagtagtgtagtatggcaacatttgcttttgttttcctaaggaataataataattgggtcctctttacattttcttgggttttatgcattgatcaccaattcgtccacaccctctccaccccagatgtgcatctctaccttctgtagtaaaacatatcagttccatttcttttcctcagtaatatccttccttgagcctttgtacgtcagctgcaagcctgatgctagctgtcatttcagaatttccctttgccatcaaatgtgcaagttccttcattcttctcctgggctagagagctgactttgtgatgctatgcacgtccctttcttggttaatttcctcttttggtgaggcataccctcttgcggctccccaaggaaatgggcaagggcaataaatcttttgaaaaatggtatacctgaaattatctttattttaccataaatctttgaaaagtatatatttaaatattttatatgtttgatatattaatatatatgaatatattaataataattttgaagttttgtgttgctcatttggggtcagttttcttcatgttcctatctcctgtttactaatattggtctctgccttttacattagtcacttccctaaatgtctgctgatccttggctattcattcgtatttaagaatgaattactgaaaggatgactggtatctctgtatgcatgagggggccctgactctttagcaaaacctgcaaacctacaaatgtcatatccacaggtcttttctctyggggaggttaaaactccagcgacgaatcactttcagaattaatttttcttctgagtctttagttctaatgtccacattcctttttttgaaatgtatttttatatgttcaatgtttattttggttcctctttaccctgctccaaacaagggcatgtgggttggcctttgcccctactctatttgattgagaacttgccgaaaagaggaagaagaaagatgaaagaggaagaagaagaaagagaaggagaaggaggaggagaagagggagaagaagaagagggagaagagagggagaaggagaagagggagaaggggaaggagaaaaaaagaagaacaataagaaggagaaggagagaagaagaaaagaagtagaagaaggagaaagagaaggaggaggagaatgagaaggagagggagaaagagaaaagaagaagtaaaagatgaaagaaaaaaaagaaaagagtgaagaagaaagaagatctgctggtgcagaggaggcagctttaactttcattgcactgcttcctagctaataccttatccagctggaatgagcctaaaatttctctaaacccacctgcctatctgactctctgtacagacagagaaaataaaaagctatgccacccagtgtgtcctacaataagacctgtgtctgatgttgtccctgctcatagcagatcctaaatctcacgtgcctgcttcctatccatttgtactctgagagttgtagtttctaagtacaaaagggattagaggacaatgatgggaattgcattctggttgcttctaacagcagaagtccatgtgataaatggatgactataacatgttcagtcattgtgattctatgccaaaggcagactcagaggcaggataacagccattgatcacagtttccgacatgtcccattaaccttatggttggttctaatcccttttgattccatcaatgtggtgcccattcctgttttcagcattatagaaatatttttcctcatctgtttctttatgcattacttaatggtttggaatcagagggatggtttgaatcccagttctattattacatcatctttctggattctggtatcttaatctggaaaacagggatactgttatctgcctgggagggtgttttgttgattagataagacaggctgagtggatgataagcaaagactggcatttttgtctgctcagtaaatgatagcaaactcttcttctggtccagtgagccagaagacactttacaccagaagcccccagagagctaaatttgattaattatagtaaatttaaagagatgacatcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaatyagccgggcgcggtggcgggcrcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaagagatgacatcttttgttgtggagtgcattctccttctgcataactgttagtgccatagtctgagtcattatttctaatcttgagtcattcaaatccttttaaaaatgggaatatcaaccattcaatcaatgaattattgttcagttatttcatctagattttttttgaactgtgaaaaccagtcatgcaaattcatttgattttataaagcattggaagaatagtttgcgaattattgtaactatgtgaatgactacagctattatttaatattttagagtcaataataatccattattggaaattcaaataagtaagaaaattgaagctttgaatccataactaatgaggaaagaactattatgtttaattgcagatggagattgatttttcaaattacttttcaaagtatttaaaaatatctgcttgctgggtgctgtggctcacaccagtaatcccagcactttgggaggccaaagcaggtggatcacctgaagtcaggagttcaagaccagcctgaccaacatggtgaaaccccatctctactaaaaatacaaaattagctgggcgtggtggtgcatgcctataatctcagctgcttgggaggctgaggcaggagaactgcttgaacctgggaagtgaaggatacggtgagccaagatcacaccgctgcactccagcctgggcaacaagagcaaaactctgtctcaaaaaataaataaataaaaattaaagtaaataaagaaaaatatctgctttattatgtacatgaaatcatcagaaactgatatttaagcttcccttccwagtaacaaatgtcctgatgcattgttaagaaaaactgcccatcagtgagctctgcagaccacattgtaagcacaatggctcatctcctttacattgagagcacagtttccagttgcaaagtgtatagcagcttttaatctatcaccacatggcaggaaggcattactgcaatactttcattctagtgaaatcaccctgaagtcacaaaatgtgctcggggtaacagtggcttgtggcactgcgatagaaacctgcattgttaggtcattcattttggggcagggttcccataaaaggaagtgggtctgggctggaaatatcacctcctaggaaatatgcagtaagatggattgtgtgcctgaaggttaaactctttttccaacaggtattcaatggcattagaagtaactcaccccagctagagaaactgtgtagtagtgtgaatgtaagcaatgagattaaatcttcaggaaacacaatgaaagtcatttttttcacggatggatccaggccatatggcggcttcactgcttcctatacctccagtgaagatgcaggtaatgtaggatgttgtaaatgccccccattttaatcaggggcactgcagatgcccccakctactgccaatggcagcagagccatccattttccctttagtgatayttgaaatctttgacataagacaaacacacataagcagatgaaaaacgcactgcagacagaaaaaaagctttctgatttcagaaagaaactgccatagtgaatttaaaacttttaatgctattagattagcttctagcacagtttcaggtcatgttaccatgagggttggtgacctgttccgtagtccctggtcaattcttttgtgctgaaagaaaccatctacctcctagagggtaacttagtctcagagagtaattaattttgctggggacagaacaggctttattgtttctagtcatctatccacacacatatttccagtgaaaataaatgggaggtttgatttgatatagaatattccaaaattaagcaagatatggcctctaattataaatatcctcctatttcctgaattgggttcaaaattttaaagggttttaaattttagaagtgggagtgttttaaaatttagaagttttaaaatttagaagtgggagtgaatattaaaagaaaaacgctaagttatttcattggtacaagaagcatctgttcctttattaaaagggggcaaattaatggcaaattaatgtcctattatckgtttgatttaaaataatttattagatcaagtggagaattgctaatcaagccattaggacctgccaccattatatttatgtattcctctaaagtaaatattaatgaacagtaggcctcaatatttggacctattgatacagagccaaacgcccaccacttaatctacagcaacaggaaaatagagaagttgttgatttttgcacatctttcctttataaacttgcagaaacttccataatttgcatgccttttacccataagcttgactgcatctagaaaaacaaatcaaagcagtaatgttgatgttttagttactgttcctgtattgtttatctcttccgttgtggcctgaatcttactactactttctctgttgccttctgttttcttagtgtgtggtgggtctcttcsaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgagttctatctaagaatgcgttytcccatttatctacaatattctttttatcttttttgttgttgtcgctgctgttgttgttgttttgagacaggagcttgctctcttgcccggactggagtgcagtggtgtgatcataactcactgcagcctcaacctcccaggctcaggtgatcctcttgcctcagtcccccaagtggcttggactacaggtgtacatcaccacatacaactaattattaaaattttttgtagagatggggtctccctatgttgtccaggctggtctcaaactcctggcctcaagtratcctccctctttggcctcccaaagtgctggggttacaggcatgagccaccayggctggcctacaatattcttcatatgcttggagactactaacaatgaagggagtcaaatggctctaacataggtacacacgatccaaaagaactctgttcgaagccataattctgtgtgtgcccagctgaggaaaacgaaccccaggaacagtgagtgaggcggatcactgtacaactagactctgtgttacagtcacttcgtttcccggcatgtgacttttgccgaagcgagagtccactactatcaagactcctttccaaggagactgggacttagcatgctcagcatgtgttggcagtttcctgaacttccaggatttatgaaggggctgtgaaattctcctgaggccttaggagttaaaagaagttttgcaatataccagatggagaaacacatggaagctatttggggaaataaccccaaagcagtcatttgtcttggttttcgtgatggaaaaggattgcggtgtactcaataaaccataattctcttaagaatttttaaaactctgtattcaaagaggatgaatcaattttctttctttcccatagtcaaggtgtaggttattcattaggttgcttccatgattatgctgacacgtttttctcagtaaataaacaagtagatagaggaagacaataatattgtaaatagtacgtaatcatccatactgtaaaagttttgctgagttctgtgtaatcccaaaatttaaagaaaaggaggctgaaagcagcagaagctcatcagttagttggtggagaagtccttgggaaactgagaggtcaatgttaattacctttgagaacgtgagcgacagaattttcaggaaggagaatttgatagagcctgtacccacgggccaagggcctcagccagagagtcctccaacctctctgaggctgaagagtctaaaaaggcttataagggaaagggaagttgtggtttgagaatgttctccatggaattctgataaaccctcaccccctctgcctgtttcaaaaccaccggcttgtggtmttaagcagaacagctgtatctcaaatttcagtcagctaaatgctgtcttctctttatttgctcaggtttagaggcagttaaaatactatatatcattgatttagaagaccagtgatgtttatctgacagaataaaaagaaagcagataaatgagagctctgttggtgctctgtacatgttcatcaaacccacgaaatgtaatcttcatgaaaaatattaggctcagatctgacagctcttggcctgaatgccgaatatggagtccatttcagttgattgaatatagtgaagaaatctttcaaattttaggcaatgatcactttatcttgaggatatattttatcactgttggtattatatttcttacaccctacaaaaggtgtgtccaaaagtgctattttaattcattgtatctctgtttagatatgctgaaataactatgaaaacacaaattggaacaaaatggtgtccatcatagaggttcatttcaaaattgctttgatttttttgtgtttgttttacccccttggagggactttctgttgcagttaacagagacacacaaatattgtgcaatgtctgctactaaatcagaatttaagtgtgtgtcaatgaatatcttgaaatttgtttttatcaaattcattgaatgtatttctcaaaagctgtatcaatgatggcacttggtatattattttgttcaggtgatgctgatgggcccctgatgtggagactttgtggtccttcaaagcctacattgccattggttataccttattctcaggtatggattcactttgtcaccaacgaacgtgtagaacacattggattccatgcaaagtattcctttacaggtaagaattataattaagatcttgataaaattacttataaagattaatgatttttttccataaagatttcatatatattttgttagatttatttctacatagctattagttttgttaatattatcaatgagattttctaaattacattttttaattggttgtggctgatatctagaaattttataatttgcataatttaaaattattatttaattttaaaattattcaataataaactgcataattttaaaattattaaattttaaaattatccaataattatttaataattaataataataaataattawtaataataattattatttaataattttaaaattattttrtaatttgcataattattataaattttataattttgcatacatgtaactttagtccaaagatctagctatcctcttattagttttaatatgttgtctatagattctctttgatctttctgtgtaaacttctgcaaatgttagttctttatgctttcagtcataatacagaatttcattttcttgcatccttttgctagctagggccaccatcgaatattgaacagaaggaatgatagcatcttgtttctgacctggatgtgactatgacattttattattaaatatattggttgctcttaagtttccaataaatatcttttgttaaagaaagtcccttccatccttagtgtgaaaaagctttttttaaatgtaaatgggcataggattttatcagatgattttctgcatccattgagatgattcaactttttctcctttcataagttaatgtgatgaattatatgaaagatttatttctcttggtaaaccatccttgcatttctgggataaatcctattttgtcatgatgtgtgttttatacatataatgggtattatttgctagtgttttgtgttggatttgcatatgcaacattcagagtttgtgctggaaaacccagccctactcttgactgcttcccttggcaatgggaggttttctagtcccttttcacgagcatgccagtttgtttagattcccaacttcttgtaaaagtctcaattccagtcctgccttctgtggagacccagagccctatcttctcctcctacccagtcatcaaaacctcagagcccaaccctgggacccaaacctgcattctttaccctctcagacttcactctttcactttcactcctctcactttgagtacacttactgcttctagattttggggagctgcttttctttccattgagtttgctatgaatcaaaatatgttttagttatggttttatctaacattcctttgtgttataaccaaatggctggttgaagaaggagtgaaattgattatctactcactcaaccatcttgccagttgattttccttcatcagattcaaagaagagtcaggtttcagtaaacagtattatttgtattgaacatcagaccatattattcttcagaaatgtatttgtttttcaattttcaattttctatgctaataccgtatggaattttgttattcctaaacttttacccaattttacttttcttctatttaatttcatttattttatacatatatatacataaaatatacatacacaaaaaaatacaaaatatatatatacaaatatatatactatatatacacaaatatatatgtactatatatatacaaatatatatatactatatatacaaatatatatagtatatatatacatatatatactatatatataaatatatatactatatatacaaatatatatactatatatagtatatacaaatatatatatactatatatagtgtgtatatatatactatatatggtgtgtgtgtgtatatatatatactatatatggtgtgtgtgtatatatataccctatatatggtgtgtgtatatatatatatatacacactatatatggtgtgtgtgtatatatatactatatatggtgtatatatatacacactatatatggtgtatatatatatatactatatatggtgtgtgtgtgtgtgtgwrtrtatatatatatatatatatactatatatggtgtatatatataatatggtttttttttgagatagagtcttgttctgtcaccctgactggagtgcaatggcatgacctcggttcactacagcctccaccttctgattcaagcgattctcctgcctcagcctcctgaatacctgggattacaggcagacgccaccaagcccagctaatttttgtatttttagttgagatggggtttcaccatgttggccaggctggtcttgagctcctgacctcgggtgatttgcccacttcggcctcccaaagtgctggtattactggcgtgagccaccatgcctggccttactatgtttttaatcacaaaatctgatggttatgattactacttactttggcattatcggttcttttttttacttctgttttattgagagggttaccaatctcatttcagattgtggcggaatacagataggtgacagtggagtgatcacaagccccaactatccaaatgcttatgacagcctgacccactgctcttsgctgttggaggccccacaagggcacaccatcactgtgagtgctaatgactgggtgaaatgcttctgagacaatagaaccacaatagcctgtcctgcatgaaaatggagctcttttattaagcaagtgattagagaaggctttgattctacaatgagatcactgtttttccctaacattttctcactagagcacatacattggcatttattattcatgaagagtgaaatctcttttttaagcatagggaaagatatacacagaagataattctgcgtcttagagagaagtgtattcagtttcttaatatgtgttgccatcccaaaccagggaaatgtcttttctcaaaatttccaagagaaccttcaataaggaaaaaaaagtagaggggaagggagaattaaataagagacaaaaatacaaattataaaaataaaaacaaaattaaacgatttgtaagggccttatcttcgtaacagttgataaaagctcactgacaaccattttcttttttctcctgcagctcacatttagtgactttgatattgaaccccatacaacttgtgcttgggactctgtcactgtcaggaatggtgggtcccctgaatcacccatcataggacaatactgtggaaattcaaaccccaggacaatacagtcaggttccaatcagctggtcgtgacttttaactcagaccattcattgcaaggtggtggattttatgctacgtggaacacacaaactttaggtaaaagaaatgtttgctccatttgattttctttttagtgatgtatagtatgaactcataatatgtacattttgtacctactttacatcaggcttagttctaaatatttgcacatgtcatctcatgcagcaaccctggtgggataacacaatatcaatacctggcatctctattttgcatgggcagagactgaggaagcatgggttgatcatttgcctagatacatagccgataattggtagagtcgggatttgaataaaggcaattcagtccagaaactttgatctcaacacttcatgatgctgccttcatcggcaaaagggtatggcacaacctgggaatctcaagtaatagaaacatgagttggaatcccaagtgcttgaaaatatctggagcctaaaagcagaatgctgagtggtgagctgagggcaggaaaataagtccacaacataaagagccttggtttatatgttatcccttgaacaatgggaaactgttgaagagttttgaaaacgaaggtgacaagatgagatttgtaatttagaacaaatgctgtagtgaatgggtcctgagtcaaaatatgacagatttcattttaaaagaatagtttttgtgcatagaaagtataaacattgtgaaaattctcagaaaatacaaggacttgtatcacatactttattagggatttctgtaaatcttgtatatcacacaagacaattatttctggtagagtcacagttattatgaagctctttgttgactgagtcagacttcccctggttaacaaccactggctgttattgaagtgagaagggagttttaggtgaatccctgatttccaggggtttcacagcaaaagattcggagaatgcctctttaacttcattttgttttgtatgaaaattctagatttttcttcctttgaatctacataattaattttgatccatcagtcagtttcaatatgaatcaatcagattgcttaataaaagaattttccccaactcaaaatcactttctctagtccagttagagtaacgttgcaaatggagtgtagagtaatattctcatgtgtgaatggtaataaaatacagaacttagcattgccaggttacatatactacataggctcaaagagaataaaaatacagctcttgtttggagacaggatggaaatctatcctctctatggcacggattagtgttcttggttgaattcaatatcattgtaacacaactgtaacagctgaaattttctctcaatttaactcacctttccatttatggagagagcttgctgtgcacctgactggaagatgatcacttgtaaaaaatgatgaattgaaatctcacatttggaaatgttccttctgtagcagtcttgagtttccaaaattactttccttgctgattgatggctttttacatggcaatatttcaggttgtggtggaatatttcattctgataatggtacaatcagatcccctcactggcctcagaattttcccgaaaacagcagatgttcctggacggccattactcacaaaagtaaacacttggagatcagctttgacaacaacttcctaatccccagcggtgatggacaatgtcagaatagcttcgtgaaggttagtacacttgttcatttaattggagccaagttggttttgtgaacattagtgtttaagctagaaatgattcattgtcgctcaaagtaagaaaattttgctgcctggattccttggatgaaaagtgagaaagtgagaaacctcaactgttaggagctagaatttcttttctttcttacttttctaatagatcctaaagggaaaaatgccctttataatatagggcactaccacaggcaaaatttaaagcatgccacaaaaattacggaacgttgaaggagcagctaatgccagccttcaccttgggcattaagaccccacagtctgaaaaaaccgtgagaaagccatgtaaaaatgatgggaatggggcatcaggagagcaaakytctttcaaaatctaaagttataaatgctgctcgtgtggcagtggcttgtcactttccactgacttgtgactatgatgactgtcttagaaattcatttcatctgtactgttttgcatcttccaagttatatctctaaaagtctgtgacttttagagaaagagtgccttatttccactgtgcctttccagtggaaataacactggtcacgttagcccctccattcatgtctgtcatacctaccacctgcatgttcttctctgagctacttaaacaattggcctttaagttattcaactgtagaatgaagagcatgattccttcttcagtggggctgttttaagcattggagataatacgatgtaataacataggtagtgctaagtacttggaatttaaagtcacttgatgagtcaaagtggcttttattgtcagtgttattacttcctatcaactctcaaatgatgttttatatctcattgacccatgcttactgtttaaatgaaaatctcatatgtgtataacatatatatatatatatatacatataataaaatacatttaatatacacttttcttaatggctttttccatgaactaaatgaactctcttctcatgaaatgaatcaatatmaagtattcagacttaagtaaaactttcaagtgctccagttgtaaaactggaatgtggaaaatggcctaggctcattccttstctggattgaatgggggtccctctgataacatcgggcaagcccaacgctgctgccgagtgggatgtattaggaaccctgccaaaaataagtggccgtgggaagcactcgtcttctcctaatgggcccgagatgcttgtttctgccaagaaatgctgtgtgggtggacggaaccagtaaagggacccagcttcggcaagcagcccccgcaggaagccacttaacacctgtaaagctgagattctctttacccacccagagacaccagggtaggtgggactggaaaaatgggtcccagtcacagaaaggggccagtctgggaagcctctttgtccccacaggccagacmtgctcctcttccacccagagacattgaggtacccgggggtattggtaggggaaaattastataccctttgcyttcaactgagaaacacacagagtccctcaggtagcaccagcaagaaccagtgagagccccggtagcaccaatgtaaaccaagcagaccagaattccaccacacagattctgaatattgaagagcaactggaactgtaacccacaaaatgtgcaaggcacgtggtaaacataaacagggtgacagcctgctaaaataaaagatttgaataggacccaaagttcccyaacataataaatgacatgtcctgggtacaatcagaaagaacacgttgtatcaggaatcaagaacatcacaacttgaaagagaaaagaatcaagtgatgtcaacagtgagataaatcagatgttgaaatatatgacaaggatgttgaagtagtttccattaacatgcttcaacaatcactgacgagctctcttgaaacaaatagaaaatatcagcaaaaaaacaatggttacaataaagaactaaatagaaattatagaactgaaaaatacactaacataaataaagaacatgctgaataggctcaatrgtagcatggagatgacagagaatagaatcagtgaacttgaagatagaacaatagaattcacccagtctgcacaataaagagaaaatagactgaaaaaacaaacaaactagatcaacacagacttagggactcatggacagtaacaaaagattcaacattctctcaaagggagaggagagagtgcagctgaaagaacaatcaaagaactagtggctgtaaactttcccaaatttggcaaaagagacacacctataggttcaagaagctgagtgaacctaaaccaagataaacacaaagaaatgtaagttcagacatatcttaattaaacttctgaacactgaaggcaaacaaaaagtcttgaaagcagtcagagagaattgggacattacctagagaggaagaccrgttagaataaaagcagatttctcatctgaaaccatggaggccctaatgaattgacaatatattcttcaagtgctgaaacaaaggaattgtcaaccatacattttatatctggaaaactatctttcaggagtaaagaggaaataaaaacttctcatatgaaggwaaactaaacaaaattatcactaggaaacctaccattaaagatggtcaaacagaagttcttcaaacaaaaatgaaattattaaagaaccgtggagcatgagaaaagaaaaaggaaagtggaaaaagcaaaaatatgtrtacatacaatagaatatccttttccccataaagcttgtgaatcatatttaataaaacaagaaattataatgccctctgttattcagtataatgatatggaaaagttgaaaggggacctaaatggaaatcacatttccacaagtggtcagatgtggatggtggtagactactataatcacataggcacattgtcacacacagaacaaccactaccaaaactgtgtgaagaaatgtacagaaaaacgctaatatcaatcaaaatggaatccccaagatatcaagaaaagagaaatagaggaccaaaaagcagataaagtaaacagaaattatataataaaatgtagacacagaactgatatatatcagtataattgtaaatagtttagttagaccaatcacaatacaggttatcaagccaaaacatgatctaagtgataataaactgatttccaattcaaccacgtaggtacatgaaaagtaaaaggatggaaaaggatgtcatgcaaaggttaaccaaaaaagcaggagtggatatatttatatctgatgaagtagactttagagtacagaaaattacaacagaaaaagaggaatcttacataatgataaaaggatcaatccaccaggaagacataatgatcctcctaaatgtgtatgcaccaaacaacagaggcayaaaatacataaagcaataactgatagagctaagaagagaagtagacaaatcttcggttatagctgaggacttcaacactctcctctcagtaattgatagaacaactagacagataattgacaaggatatagaagaactctacaaaaccatcagttaataggatctgattgacatatatatgtgtgtgtgtgtgtgtatatatatgtgtgtgtgtgtgtgtgtgtataaatatatatatgtaaaatacaccacacagcaacatcagaatacacaattttttaggaactcttgtaacattccaaggtagatcatatcctgagacatggaaaaacctcaaccaagtcaaggaattgaaatacagagtgtgttctttgagtatattaaaactgaactaaaaaacagtaacagaatatcttattaagcactgagctgagctggagagaactgagctgccaattgttggagcagctaattaaaacaacaggccaaaatgtaagtaacagtcctgtctttcatcattttctgctgtggtgtaagaggccaaacaggagaaagctctgtctccctcaatcgtccattctttcccatgggaagtgcctggtaaggatcagatggatcagtgtagatatagaaatggtctcattgccaagtaagccccaaacaaatatgtgcaggatctgagtgctaaaaataatgaaatgctggcataracctaaatgaaagagacaattatatttatgaattggaagactcaacatagtaaagatgtcccttctccccaaaatgatggataggtttaatgcaattcctatcaaattttctccaaagtcttttgtaggcatagacaactttttccacaacttatatgaaggcagagacccttcaatggctaaaagaatcttggaaaagaagaataaaatgggaggaagaattctaccttactatttacctaggcttacttatctaagttacagtaatcaagacaatgtggtattggttgaaaacccagatgaaaacagagaacctagaaatacactcacacaaacatcctcaattgatttttgacaaaggtgcaaaaactttccaatgtaggaagaatggttttttcaacaaatggtactagagcaattgaacatccacaggcaaaaaatatgaatctcaacctaaacctcattattttgtagaaaacctcactcaaaatagatgatagactgaaaagtaaaatataaaacttctagagaaaaaaaaatagcagatgtcttcaggacctggagataggcaaagaggtcttagattaaacaacaaaagaatgattcataagagaaaaaataaaatgataaattttaccccatttaaattaaaaatcttatgccatgtgaaatattttcatccagtctgtagccagtctgttcattttcttcacataggcaatgtactactatgtaaaatatataaagaagtctcaaactcargagtaaaatacaaacagttctattagaatatggacaaaagacatgggcagatagtccaccaaagagactctacagatgataaataccagaaaagatgttcaacgtcattaacttctggagaagtatgaattaaaaccacagtgagctatcactacacacctattcgaagacaaatatttaccaattgcataatatttaccaattgcactctgggcatttatccgagagaaatgaaaactatgtttacacaaaaacttgtttacgaatctatataaatagcacctttatttgtaatagctgaaaccagcactaaggcctttcaacaggtgaatggttaaacaaattgtggtacttgcttaccgtggaatgtaactcctgaataaaaacaaactatttatagattaacaatctggacaaatcactgagggattatgccaagtgaaaaaaggcagcctccaaagattacatactctgctgttccatttatataatattttgaaatgatagtgttttagaaatggaaagcagagagccagaggttagagagaaggcaatgtaggagtaaattgtgtgtggttataaayaacaaaagcaacttagggattcctgtggtattggaatttcagtatcttgaatgcaattgtgtacaacttgtatataacttaatacacacacacacacacacacgagttcaagtaaaactaggaaactgagtaaaattggtgttatgtcaatgccagtaacctggttgtgatagtatactacagttttgcaagatgtcagtattggaggaactcagaaatgtgtacaaggaatttctccatattatatcttacaaatgtatgtgaatctgcaattatgtctgtaaacatttgtttaaaaaatagttgaatgataaaatataacctacaacctgactgaattatatagaacactaagaaaaatcagaaagtttttgacctgatgacagttaagtaacattttgtaggttcaatatagttttgatgagtcctctgtcatatagccaatgaaatgagttcttgataggcaaggcagaaatgaatattgaataactctttaccattgtcatcaccattatcatcattattattaaacttatgttcccaggccaaaaggtagagwtgtcgaatctataattaatgacttcagaaaagtataagcacttaagcattcttggattccttcattaaagaacttgaggctctttattaagttttagcccttcttactttgcctgtttagtaatgtttgtaaaaatatagtatatggcccaggcatggtggcttatgcctgtaatcccagcacttttggaggccaagacaggcagatcagttgagtccaggagtttgagaccaggctgggcaacacgggaaaaccccatctctgcaaaaaaatacaaaaaactagccaggcatggttgcacgcacctgtagtcccagctacttgggaggctgaggtgggaagatcacctgagtccagaaggtcgaggctgcggtgagctgtgattgtgccactgcgctccagcctgagtgagagtgagactgtctcaaaaaaatacatatatatataaaatatatatacagattatctattgataaattgtgtttataattttatgaaatgtggataaaaaactgccatatactgtttccttggatatattattagggggaaatctaattagagatcattaagtaaaattgagtaggtgcattttttttcctgacatttttattgatcttaggcatttggcagaatatctgcacttttgttctcagtaggtccagcgccaggcasctcccttatctaataaatggctaatataatttgtcttcagtaggatgactaacagctggatacccagtgcttaaaaatcaattgaaacaatacrgctttaaagagctgagaattattaaaccaatgctatgaatcagtgctatttcacatctcttgctatggactgatttcccaatagaaatgtttttaatgacttgatgttttattgctgtgggtgaggaatatccttsagaagagatgtgtttggaatgagtaatttggtatcattccatgtgaagaaaatgttgaatagtcaagtaagattaatacacatccaactacatccttgtttgagatagttgtctgttgakagaaagggcatattgggtattgcasattgcktagcaatagtcctggcccctacccactagatactacccatcacaccgagtgtgacaatagaaaaatgactacaaaccttgccagaggtcccaaaattgctcctagttgagacctctgaactaggacgagcttctctggttaatatgtttaatgtttttggggtttttttcccccaagttttgtatattcattacctaatatgcatactttccttgagtgactcagcattgtagataaccatgatctctcacctgaactagggcaaaacctacctgactgttttccggcatcctttctgactcctattttccgaattgtaatgttttccaaaaaccaatcttcytggtggctccttgctgtattcaggacagtggcccgagtctctaacgtgtcctgcagccccctctgcaggcttcctcaccmcttcctccttggttttctctctcttctctgaactagccacggcctttcctgccatcggggttcgctcggggcaggctcacttcccccagttaggtaaagccaccaattatatattctcaacagccccatcataatgccttgtttatagctggaattttgcatgtaaatttatgattctgtgattcatgtctctgtttttccctggactgataagaattggtttgatttggaattttggtgctcaccgtttatttcctagcaactgttttttgcatgagtatataaattcagtcattcgaggtggccagaccaattaagtgacagcccaggtctacttgggagttgccaaccaaatttttggtgaatagcacacactgactggatgtcagcttttcatcaaaatggaccctacaattccacacagccaagaagtgttctgatttattccatttcatgctgattatacgtatacttggaattcatgcccactttcttcatgcaccacgatgtgcctcttgcttgctggtgttgtccagctgtgaccacaatctgctatcttcccaggagcagggctgagttccacctggctgctccgtctccctcagcacccgggaagctcggctaggtcagggcaactagaagttatgaggaaaccgaacagtgatccaggaaggtggatttttaaaaaatcaccacccagctatgcaaaaaggaacaccatctccttagagaagtcaagaatgggacatgctattttaaaaacagctttaaaaaaattattctcaaaagaaaatactacagatttgtccatgttttgtttactcttatgcttagttctgtatacgtgtgagtgccattattttgaaacctaagtgcattaaaatattgatgggaaacccttgagcattaaagttctgtgtatgtccgtgctaggtgtgggcaggaactgaggaggtggacaaagccctgmtagccactggctgtgggaacgtggctccgggtcccgttatcacaccaagtaacacattcactgccgtcttccagtctcaggaggcaccagctcagggcttctccgcgtcctttgttagccgtaagtagccctaagaaccaaacccagaggtctttgcgggagtgtggttgtcacaggcaggcagggttggctaaacctgggggtctaggggaggagtatgggggtctacggggaggatgagtcacctaatcccaagaagacacctttcttccaaatagcagtgagaacagaactgaattgagaagtgatataaaagccatgaggggcactaaccaacgtctagaaataagcctggcatccagagtgggctgatattgggcagaagcgcagatggctagttcgttagcaacaaccagtgtggctggcctgtggcaccttgaccacaaaatcccgtggggggcttgaaacacatgcagattcctgagcctcactccaggcccawctgaattcagaatttccatgacgaagtctttcmtgytttttttttttttttttgasacggcgtctcactctgtcgccaggctggagtgcagtggtgcaatctcggctcactgcaccctccacgtcctgggttcacgccattctcctgcaacctccacctcctgggttcaagctattctcctgccttagcctgccgagtagctgggactacaggtgtgtgccaccatgcccagctaatttttttttttttgtatttttagtagagacggggtttcaccatgttggccaggatgatcttgatctcttgacctcgtgaaccgcccgcctcggcctcccaaagtgctggcataagccaccgtgcccggccggtcttgcatgttttaactgtcatccagagggttctcatgctaagtcaactttgggagccagtttctttgggaatgttctttcctaattttgattaggaaggatggatctccttttctagctattgtacactattagattcgtgggaaatgtagcakttttcaagtcagagaagcaatggtgtgtgcctgttggctgagttaaatcaagtgtagccactcatggcaaaccactgtttagggaaaagtttgaggaaaggaattagaggaagtaatacartagacaggtttttcagactgaatcagagagtgctggaaaggaartactgaaagacaaccctagaccaaatcttaggtctgcaggtggtycactgtgtaagtgtgcacgtgtgtacttgtgtgtgttttaatgtcaatttaaaaggatagagatattttcgtgcttgatagatcagagagtgaagtggattaactagtcaatggttatatgaaaacaaatcattttagtggtgaaaagatatttctttctgtttcgaaaaccagggatgcatgtaagaatttgataagagttgggattaataaatccagctagttttaaaaagcaaccattgttktggctagattacaatggtaatgaaaatagcagttttctaataataagacattttaaaaacattaattgtgtaaagtactaatcagatacaaatcattttttatctgttttatttctttatctgcatgaaccatattctatcattgctcgtttatcctttcttaatatcttaatattaagggatttgcagtagatttgtsgtaatattacgaggactcagtccataaaactctgcagcattttctaaaaatgtataatattcttattaagcacatatgtatgtttttaaatcagagctttattctcttcattcttgcttcttccatttggaatatctcagggaactatgtctatagataatttaggaaaatgcctctttccttcatggacaaaatagatacacgagaaataaatgatctgatgatgactttttgttcccacataggatgtggaagtaatttcactggcccttcaggttacatcatttctccaaattacccaaaacaatatgacaacaacatgaattgcacctatgtcatagaggctaatcctctgtcagtggtcctcttgacttttgtgtccttccacttagaaggtaagtttattcttttaaaaaaattacgtttaattgacaaacaaaaattgtatatttatggtgtacaacatgttttgacatatgtacatgttgtagagtggctaaatccagttaattaacatgtctgctcactcacwtacttagcactttttgtggggagagcatttaaaacctctcttagcaatttttaagtattcggcaagtaatcaagtatttcaggtattcaaccttgttattcgctattggcaccatgttgtacagtagatctcctgaacttattcctcctagctgaaattttgtatcctgtgaccaatatatcctaaatctccactcccacataccctaccagcctctggtaaccaccattctactctctgcttctatgagttcgacatttttagattccacatccaagtgagatcatgcaatgtttgcctttctgtgtgtagcttatttcacttagcataatgtcctccaggttcatccatgttgtcacaaatgacaagattttattcttttttaaggccaaagagtattccattgtgtatatctaccacattttctttatccattcattcactggtggacactcaggtccattccatgtcttggccattatgaatcatgctgcaatgaacacgacagtatagataatctcttggacacgctgatttgatttcctttggatctatgcccagaaatgaacttggtggatcatatggtagttctatttttaatgttttgggaaactgccatgcatttttccataatggctgcactaatttacattcccatcaaaagtgtacgaggaagagttcccttttctccacatccttgccaaaacttatctcttgtcttttgataatagccttggaagataagttcattcttaagtaaactctaattggttcttcagaaatgaatgaggagtaagtagaggcagaagtctaaaactcaccatttaaagaaaatattgaaaatatgttacagagtagatttaatgtaaacgtgattaaaatttcatccaatttttaaagaatacaagtattattctatgtattccatctagaagtaaaaaaatagtgacagaactttaacaacacaagtattgcataaattgcttaaagaaaataagtctgaaatgtttcatgttaacatagcttttaatttattcacttgcatttaaagtttatagacatacgtgtgcacacacacacccacattcatgcacacactattaaccaaaccagtgagagaaactgtcttattgagtcaacataggtgttcgacaaatattgaataagtaagtaaattaataaaattaatataggctgggcacggtggctcacgcctataatcccagcactttgggaggccaaggtgggcagatcacctgaggtcgggagttcgagaccagcctgaccaacatggagaaaccctgtccctgttaaaaatacaaaattagccaggtgtggtggcacatgcctgtaatcccagctactcgggaggctgaggcaggagaatcgcttgaacccaggaggcggaagttgcggtgagcctagatcatgccattgcactccagcctggscgacaagagcgaaactctgtctcaaaaagaaaaaattaatatatgtgccctgcttttagtaaatactaccattgggcgttctttcttctgctccatctcggtcatcttcatcttctcagtcctgactcttcagtgcctgagttcctggccacaagtgccctctgtgttcattctcccactctagggaatgggccgttggcagagggaacagtagagatgccgatttgggctgggctttgactgacaatagacaccacttggtgtttaatggaggctttcacacagtggaaaggaaattccttcaaatagatgggtattttcaaccactcataaccatattaattttcttgttacatatcagctttctatttctaaaccacaatttatctgcaratttgtcaagctacctcggtatattcgaaatttcttactcttgggttagtctctcatggcagtgaaaagttacactttgcaaaatgttctatagcattcaacatctgggaaatgtatggtttataaaaatgacatgtcagaactcataaatggataaatttaacaaagcttgtctcacttaatcctttttcctatgacctcactgccttttcatacatctctgcagttgtaattttcagcacatgtgtttgcttaaaaaaatgccaagtgtaaatcaatgtatgtcactgtaaaaatggaatataaagtaaagtgtcatcttttcagcatttgctagcccaaaatcccagtaccataaaaagatgcccatgatatatgaaggcttgagggagggtaaaatagtttgtataagatgatccaattttctttctaaaataatgtgtgtgaataaaatctataaggctattaaccagtacattaagagttgtcaccactgtgtgatagatttattcgagatgcttattttcttctttatagcttttatgttatttttataattaggacaattattttaatagcaggggaacaacatgtggcttggattttgtgtttgtggtcattaagttaaataaacagtgcatctcacaagaccgtatcactcagactaagaaaggagactctagtaattgtactataaagccacagaaagcaatgctgataccagtggtatatgtattattataagagactctatcatgacctgagacagctccctgagctcagttgatcaggtgagaaaaaggggagcagccctggaatatctcagtatagtacagggaaagtgagcacagcatttaggatggatcttaatgccaggtcagccacttactgctattcaagtgactttgtgcaaattacttcacctttatttctgatacttatatatatatagcactttgctatatatgtgtgtatgtgtgtgtctaatatatatttattatatatgtataatagtagttctgaaagtcagataatgttagattgatttctgcttccgctaatggatttgccaatcctcactcagttgaagactgattcttttctaagatggtatccttacaacaatgccttgtgacatttccagtgtttaagtgttcagcattttcaaactgctgcctgagtaatttctggctatagattcatctaattatgatgattccccaaaagggtgactttaatcaaatttattttataattagcttcttatccttaaccatatcaatgctgacatttattgaataccatcaccgagctacagattcgctagctacagtaaaagtaacctttccccagcccttctaaagtgagcctgagggattcatgtgcaatatattgggatgaaaccgagrattgctctgaaggaaggtcatagctttattgagggagccttggcctttctagctgctataggcacttggaactgtttctgagagactctgttcaaatggctaagyatttctgagcccaggatcccagcagagccagtgttgacttaggtggtgatgaaggttctagatctgtcatcttggtggaccattagcacaaaaggtgggattggcaaggaaaagatgtggtatcccaggctacaaaatactgtgaggaaacacacttgtccctatatggcgtctactaaacattgacamctgcttagggagggttttaccatgaagggaaaaatacagattgttgaaccacactcaactcttaggttacaaaggctcagtgacctactttccgcttaccacaaagtaagttgctccaagtttaatgttggtctaaatttctctaactttctcattacttttacatttccagtactagacattccatgaactacagaccattgatgtttgtcctcattttggaatctggtattattaaataactgcttattttattttcccaaatattaaacagtccaaaattttgtgttctcattattcatgtggccaactagawgccctcaatctgctaaaaaaaaaaaaaattatagatccagttttcttayttcatagataaagcacttcttgaggcaaaatgaagcaagccagtgccttctaaaccttgattattctttcattaaaattagatagtaggccgggcatggtggctcacgcctgtaattcccccactttgggaggccgaggtgggcggatcatgaggtcagggggtcgagaacatcctggctaacacggtgaawccttgtctctactaaacaaaatgcaaaaaattagccgggcgtggtggcgggcscctgtagtcccagctactcgggaagctgaagcaggagaatggcgtgaacccgggaggcggagcttgcagtgagccaagattgcgctactgccctccagcctggacaacagagcaagactctgtctcaaaataaataaatacataaataaaatttaaaaaatgaaaaaaattgggtagtaacattaattcaccttggtgataatgaggaatttagaaattctcaatttaaaaattctacacgcmgtaaactgtaaactcagtgtttctcagatccagtaattcttgacaagcattggagggtgcagcagcgcttagctcgtgaggtggaaacaccaaagggacaaatgcctttgcttgttgtcctctagagatggcttcaaagccccaacaggagtgggcccagattcacacctaatatttgcctaaattctcttggattaactgaagtcccagtttatgggttatatctaatagaaagcttaaagaaaaaaagtaaaaaaaaattagttttagatttttctttttgacatttttytccccatcaagaagcacaataaatgagctttgtcagttttctttatttcctcctatttaaattttttaaaaactggtattgctcaactgctgtttcttctctttgctttctcagttgtttctaaagaactcagaatgtggtcgcattccacattactttagaaaaaagtgggcagtggtccttttgaaatgtttcctattgatattttattcaactggcagagcactggagcagatggtgtagtttctgtgaaatccctygtttgcctgtgttacactccaatttgctttaatttgtttggccttcgtgcgcaatggaacttagctgtatactagtacatgcttccccctcctctgaatcatgcctccgtagaggagaccagtctcccagctactcagggtaaagttaacaagacagatgataggtctcagtcactgctgcctggtaattcatgtgcctctgcctagaacccatttctttcttccttccttcctttctttttctttctttcttcctttcctttcctttccttccttccttctttttccttccttcctttcttttcttttcttttcttcacagagtcttgctctgttgcccaggctggactacagtggtgsgatctcagctcactgcaacctccgcttcccaggttcaagcaattctcrtggctcagcctcccgagtagctgggattacaggcaccagacaccatgcccagctaatwattgtatttttagtagagrtggggtttcaccttgttggcsgggctggtctcaaactcctgacctcaagtgatctgcctgcctcggcctcccaaagtgttgggattacaggtgtgagccactgtgcctggcccctagaacccatttctatttcctgaaaatacttgatcttatctacaacatggaaatatcccaaacaaagggttttccctcatctctagtcctctttggtgtctcggcccacgccctccccccactttggagaaaaactgtggtccaactctaaatcccacaagtttattctatttgtggaattactcatccttagttttccttcagttctctcatagttcttagaactatgatgaagtttggaattagacattgcccagtaataaatcccggaaaaatagaacaaaaaattaaattttactgcatggtatagagccttgcccattgcaaacgatgaatatgttttaaagtttttaggaaggatggaaaatagtcataaaaacaaatgatagggaatcgttttgcagctcagagatttcagtagtaaatgtctatcaaatcacttgttgaagacagagttaagaattactgagttcccggtcccatgacgtggactctagtccacggagaaagtattgttcaatttcagggtgcttctcttcctcacaagttcgcatatgtctgatcgaatgctgcctcttggtcataaactcaactgtgatatccatcttgcttcttgaagaagtttttccaaacctcaactaagtttccttctctccctagaagacagtcaccccaattatgagagtgttgtgtatattttgattatacatacaattggctcttccaataatgatgagaaagtgtttaatataattattttctgatgcctttagtctgtcaccaacaccttctcactgaagaatcaggctgatatttttgatctaatgcagtgatgggatatatagaactttagaatatgatatatgtgtgtaaagtacttaatgtctagtgacacacatatccattttcttgcatattactttgttgatgttaattttttatattttcttagactttagctaattttaccagcttctaatattatgtacatgtttgatttcttttggagagaatttgaaagggcataacatcctaccttaaacaaacgactactagaaaggatacaagaatgttttaatccatgaaataagttgccagatattataatttctacattttactgaattaggctttgagaagcagactgtcttacataatttgtttagttagttgatattctattgccatctacaaaaaatctaaaatcccttgtcaacttcctctgcatttccccaacaaacttccttattgttcaatacagacatttaataaattgttgatgagttttgattatgtctcgtaccactgccatttcatgaatgaactttctgtatttcarctagttcctttaatcaactatttgtcaacataatcaagtataagtgacactataccttatgtttcacagccttttcactgttttctaagacaactgccactgtgatcatttatatcattagcccacaacttaacaactaactctttaatacctaacacatgcatagcagcctatttgatcaaatgtgggaccaagatttcaatccagcatcagcaatttttccctacattctgtgattttggttttataacttgatatattgttgctaaataatttctataactaatgcacmatttttttattctcaaactcatctactttgaattttttaaaattccagtggagcttttgatgtcttaaagacaaatactgaggttataactaaggtacataatttggcaatattcaaaccatgaatctgagtttaacttatttcttttttgtcctctttttccacatcatattgcttctaattacatgaaaaggccattgaagttcagtctttcactctttcaacttatagatttatgcccaattagaaatatttctattccagcattttcaaaataagggaattctttgaggttaatttaaaaatgtatatcttgaattgatacctcaagatttctgcaggctgaatagaaacttagcgaaggagctgaatgtattcttaaaatgatttaagaatgtgtggtaactctttaatgcacagagatgctttttaaaagtatttgtcaagattctttgaatggcaagttatcttcaaaagttagcttagatacaaagtagggtttataagaaggatactgggtgatttcatctcatcaaaggaagggcttctagaacaaaggaaaccagggacaagaatctgtcagcatgctctctcttccccgctctttttgctgattgctgcacaacttctttttcccttacggcagcctggcttccttaatgtgtcaggaaacatggctgcagacattttttaagtttagtatctttggctcctaccattgactcttactcagttgcagtttggacacatctgattggcctggattgggtctgatgccatgccttgccattgattgactggaattatcaatcagtcaatcaatcaaccatggtcaggatggtggggttgtataaacaatagcaacagtgactctaatcatgaaaatatctaccatatccattaggaggttttatggcacaattaacaggaaacttgattcaacctggtttaaacacaaaggagcaattcattggtttttaattctggaaggtttcaaagttgggtgtgcctcaaatctctcaattcagcattttaattatgtcatcaaatattcaactgtttctgtttttactttgtgctactccagtgtgagcctcatcctaaggctggctcctctcattgctgtaggggtgctgctctcacagtgggtactcctcacccacatcagaaagagagatggcttctatcctgtggtaagctagagttgggttgcaccatcttgcaagagtcaattttgctcatctattcctattctgcatttaatgacttgttgttaatagcttgaaattggctatcgtgggagtatttatacgatggaaattggcaaatgccacaaatctctcggagagttggttgttatatttaccagcatactactacctctattccaacttccaaatatcaaacaagggtgttgaaattcacctttattggactggattgggtcacacacccacctttgaaccaaggtctatggccaggggacttggaattataaagtaagtgtgcataacgattttgtcagcgtgctcttgtaggaagagtattctaacagcaaacagcaaacaggatgtctgatttcagagtccaccgtgccatagcatgtgcttatataaaataatgtagtttgggtcattcccaatggggcatttgtaagtaagtaaattttgtgtgttggggtgatgtggatcattagatatatgttcaagttagcatcgccatgaaatraaagcattttgttcttgtggcttgtaaatgaaaatgggaaaatatttcacattgttaatcatcagagcaattaaaattaaatatcacaatgaagtttcgtttcgcatgcaccagaatggctaaaattaaaaagactgacaatgtcaaatgttggcrtccctgcagagcactggaagtcccacacatccctggtgagaatgtatactgatgtaactactatgagatatagtttggcagtttcttgtaaaattaaatacatacctaatttgggggctaataatttcactcccatttatatacccaaaggaactgaaagcatgtgcccacacaaaatctcatgcatgaatgttcatagcagcattatccataatagccaaaaggtggaaacaaaccaaatgtctgtcaactgatgaatagataaacaacatgtgctatcactataaaaaggaaaatattcagccataaagaggaatgacatactgacacatgctactacatggatggactcaaaaacattatattaagtgaaagaagccagccacaaaaggtcacatattgcatgattttattcatgtgaaatgtccggagtagacaaatccatagaggcggaaagtagtttagtaattatgtagggcaggagaccatatacaggaaggatgagactggagtgattgttaatgggcataacattttcctatgggcaatgaaaatgtagaattgggaagaatgtcagatgccaaaaatgttgtgggagagtaagtcggcaacaccaatctagggatcatttggtaacctgaaaaatagtcttaccttagtgccagtatctaacttctgaaaacttattctgatgaaatgatgaaaaacttcctcaaatatttatgtacaggaatgtttgtttcaacaatatttttatttacagaaatgtggagaatatagaatttcaagcaataggggattgatggaatgtggatggcacatctatatgttggaatttgatataggcattaatatattatgttggtgcaaaagttaggctggtttttttcctttcctttcataataatataatgttttattttatttgagatggagtcttgtgctatcacccaggctggagtgaagtggcgcgatctcagctcactgtaacttctgccttccaggttcaagcgattctcttgcctcagcctcctgagtagctgggactacaggcgcgcaccaccacacctgactaatttttgtatttttagtagagacagggttttgccgtgttgcccaggctggcctcgaattcctgaactcaggtgatccgcccgcctaggcctcccaaagtgctgggattataggcgtgagccaccatgtctggccctaatataatgttttagaagaatatttaatcacatacaaatgcatgatggatgtaatttcatattgatacaaattaggttaccatatgggtgtcatttcctattaatacaaattaggtatgatccaagttaatattttaacagtatgtgttcacctacaaaaatcactggatatgttgtagtggacacayatctttttaatttcttgtttattttgttttatatttttctttgggggatggtaggctggagcatatattcacattataattggcaaacaaaacaataatatatattttatagtccttaaacactaatagtgtttgtgtgaacatctaaaatggttgttcaataaacattaaggagtttctaatgatatctccatgataggagtcccttatctggacataagcttggagcaagttttctcagtagcagcgctattgacatgttgggctaggtagttttttgtgggtcccagagggtccggggtgtaggtgctgccctgtgtatagcagcatcttcaggagcawccctggtctctactccactctacagtgtgacagcaaaaatgccttcagatagtgcyaggtgttcttggggaggcaacayggtccccagtttacagtcactgagttaaaggaaccgttatctaaagaaaggaaattctgaattgtttcaaggtggaaagtgtctactgtgaagtcctacctgttttatcatacctgtgcttgttttgtagttagagtaaacattgtttcaacaggaaactaagttaaatayctcgtttctcattttaatttttatagcaattgcatgagtcatcatcacatttttgtttttatttttatggccttaattgtttgtgtaggttctgatcataatgcggttgttccatgccttttccagctcgttccgctgtgacgggaagctgtgtcaacgatggcgtgcacrttatcagaggttacagcgtcatgtccaccccatttgctactgtgtgtggggatgrgatgccagctcccctcaccatcgcygggccggttctgcttaacttctactccaacgagcaaatcacagacttcggattcaagttttcctataggataatctgtgagtagccataatgacagagtttggaattttcttcttttctgagtaatgtatacaaagagttttcactgcgattcatacagcactaacttgaagattcagagaatttaagggaaaaagattgtcagtgaggttcatggttaaaaaatacatatacacattttttcttaaaaagaagaggacctttttcakgaactttggctagaactactctgaaaatcaaatgaagaattgacatttgttttgtaatttaatttaaataaatactactgctatttttttgtttttcttaccttacacaaagttgcctgttggtccaaattatccagatgcctgttttgtttccccaagtcattttgctaatacaaaaattaatattttatatatttagaagaaatataagagaatgtctttacagtctgataggaaagacttttttaaaacactatgcccaaaacaaaagccctaatggaaaagattgatatattcaactatgctataatttacaacttctctgcatcaaaggcaaagagaaaagaggagcaatagactggacagaggcatttgttgctacccagaaaattctaagattgcatttcctgatcttgaatagtcttttcccctcctgcctggttagtttgctgacaatatttatgcactatctaatagacatctcagctgcagtcaaactggcacacaaatcttgtaacatctttcttgagtctatttcatctttgctccaccaaacccattgctaaaggtagaaagttaaatagtttcccttggaataaattattgttcccatctccagagaagactaaaaacatgtatttacttctgaaaaggccctccataatttgttcacattagctgctatcggcatcctgactcccacagtttgtaaagtatgactacatatggctgtgtagctctgttggctctagcagaatagaaccacgcaattaacgtttcctctcccgtcgtcttgttgaataaagagaaggatggatttgttttattcttttggcacaactgctgctttggagaggtaaactcctgctttatattcttcttctctttaatctctcattttcctacaaggaagtagtcaagattcaatatattctagtataagagtcccacttaaagagtgtcgttgatgtgaagacttcaaatgctgatattgtgcaaagatgggagttatttaggccttgataaacttccagagaccacataattgtgtataaagtgaaaaggagtgattgctacccttatctgacatgtaattcacttttacagatggacctgggggtctgaacacacaagtacttacaggcacatagagaagagtgctccctgcaaggtgggctcagttgaggcaaaaacagtaaagaaataaagagcctgacatggcagccycaatttgttcctcatttctgaggatgtaaagtggaacgtgtccactgatagtgtataaaccatggaaatacttcaaaatgcgttaaccccattataattttagaatcataaatatacatagataggtctttccactgcagggagagtgatcatcaggaggtacaatctgatcctcatatgtaaacccaagcaaaaataatcactttatattgtggataagaaggctttattacatttttatgtctgtcgttttattgactaatggatctagctcaaggctctgagctgttaattgctggaatcctggagaggaacgggcctggcctcctcctgcttgttgaggattgaggatcagtgatattaatacaaactggggcaagtttagtccttaccagtctcacaactgactgcaaatccaccagactggagagctatacatttgagcccacagaaggaactaaactggaaagctccaaaaatgatttccagtagtttaccatataatattctatccctgacaggagagacagggatctctattatttcagatttccagatcacaaccttcctagatctgtacgcccagaacatcattctggccgccttttccgtacttcgttactgttgtcatccctctctcaacctgtcaatgaaatacagctaagtgatggtgaaatgttcctgctcgtcattttcactctggccattaatttgactcagactgattcctttccaagatgagcctttaaatattcttccctgtttctaccctcttgctgtctttcatcttccttcctagtggaaaaatcagaattatgtgtaaacacaatgaagggagatataagtcactttaagaaaaataattattacctcttttagggaaaaatgtacaatagtatagaatctcttaaaatcatttttccatgctgggactaatcgttgttctcttcatattcccttgtcttctgttgcagcctgtggtggtgtgttcaatttctcttctggaatcatcacaagtcctgcctattcatacgcagactacccaaatgatatgcactgtctgtataccatcaccgttagtgacgacaaggtgatcgagctcaagtacgtaagacaaattggctttcttaagaaaatcctttcagcattatttatagaagagccattcgtttattgatggagggcactgattctcatcggcagtctggagggaaatctacacagaggagtgatgttcctagatgacagttcaacctgggaaatgacgctccccctctccacacaagccggtagtaactaagggcaaaaaacaagcactcaccagttaaaacagtcgttatagtttcccaacaattgtgaaggagcatcataacatggattgtcaaggtataataagcccatcttgaaatcaaaggagagaggaagggcaagagaaagcagttgccatgtgttgggtatttattatacacaaagaactttgattcacacgtgccgtaattgtctcattgtattcttaaaacagtcatatgaggtatatatagattctagattgggaattgtatagattattcccatttcactgatgaggaaactgaggctcagaaggatcaaattgctttccaaaagtaacacacacataaagagtcaaaatgtgtattcatgccaggcttcctccaaacaccacatcctcaatgtttcccaatactgtctctcaaagkatacattttcttttttcttttcttttttttttttttttgagagaaggtctcactttgtcacccaggctggagtgtagtggcacaatctcggctcactgcaacctctgcctcccaggttcaagagattctcctacctcagcctcctgagtagctgggattacaggcaggcgccaccatgccctgctcagttttgtatttctggtagcgacggggtttcaccatgttggtcatgctggtctcgaactcctgacctcaagtgatcctcccgcctcggcctcccatggtgctgggattacaggcatgagccaccgcacccagcctcaaaggatacattttctaactacttaagaaatctatttttatacctgtgtcagaacacctctaaactgatgctatgagagatagcttgagtcactggtcaattttcttcccagtcttacctattcccaacaagactgatgagggcaatgcaacctcccactctccagaatgataaagttcaagactgttttcacctgacagcctatttcagtgatatacgtatggcatgtggtgggaaactctgacagtaatattgttcatggtcatgtaggactttccatacagaagcctgatgggctaagaccacacctacctacctacctacctacctacctcccctctatttgtctgtgatcattttctaccctaaagattctgtactccctgcagtttacttccagaggcctcatgtatcagttggctctccaagtgaacaagagatgtcttgatgaaagacatctctcatcaagcctgatttggttcctgtatcaggcgttctataggctggacctcgaagaaaactgcagctcttacctggactatttgtaggaaaacagagtgtcttttaggtcttggggacaaaagaacagaaactgtcagatggccaggagcaggagttctgtgaagtatgcctgcacaggcgtgaaagtgtaagggggagccatttgctactgtgactcactatttgtttctcatatgtgtaggattgattattgccttgttctgttcaggttgctttaacaaaatatcataaactgggtggcttataaacaacaaaaggctgcaaaagtccaaggtcraggcagattcgttgtctggtgagctcctgttttctggcttatagaaggtaccttcttgctgtgtcttcatgagctggaagggcctcttataaaacactaatcccatttgtgaggggtcctcccccatgacctaatcacctcccataggccccacttcctataccattagcttagggaacatatgaatttaggggaacacaaacattccaaccatggtatacataccaactcatagaggtatgttatatattctctctctctttatctgtctatctatmtatatatmtatrtatgtatacaatctaaatgtattttttcagttttcagcctggatcctggagctcaccataatgaaatttacatctgcrtgtttattttattttacttatttatttatttgagactagctctcactctgtcgcccaggctggagtgcagtggcgtgatctcagctcactgcaacctccacctgctgggttcaagcgattctcccaccttagcctcctgagtagctgggactacaggtgtgtgccaccagcctgggtaattttttcttttgtatatatatatatatttagtagagatggagttttgccatgttggccaggctggtcttgaatccctgacctcaagtggtccacctgcctcggcctcccaaagtgctgggattgcaggtgtgagccaccacacccagcctacatctgcaggtttagaaaattatttattgcgcactaagagcctacattctaggaaacagataagattctaggtgtggtagaagatgcagacattaataaaaggctctcaaaagattgtggttacacaagcttttctgtcaatgggcttttcagatctcttctgtgctctcctgggaaaatgatgtaaaataaaaagccaaagcagatttaagtcctcttagaaactcagattttatctctctttgtggattctttttgtgaaaaataaatgtgttgtctgtagagaattaaaatgaatacagtgttgttggaaattatctagctattgttcttccctgatcttttacaataacattaaatgttaaatgtggtaaaagaaaatcaatacggttttcatcttgttcctcatcagtctgaaaaccttcaaccaaccaaaaccttttagaaaaaaaaccaacaattttttttctcaaggctgttgaaaggaagcatttattatatattttatatataaatatatattatttagtctatattttcaaaattattccatattatgrattgtttattagagctactgccaaaataaattgaaaatgcaggctgggcatggtgtcccatgcctgtaatcccagcacagggaggctgaggcaggcaggtcacctgaggtcagaagttcaagaccagcctggccaacatggcagaaacctcatctctactaaaaaatatacatgtaattaaaaaaaatagccaggcatggtggtggacacctgtaatcccagctactcgggagggtgaggcaagagaatcacttgaaccagggaggcagaggttgcagtgagctgagattgtgccactgcactccagcctgtgcaacagagtgagactctgtctcaaaaaaaaaaagaaaaagcagaagaacctataaaaatgaggacaggatatcaaatattatttttttaaacaagttttaaaaataagctataataaacccaccacaaaactctaaagtaaatccatgtaagaagccttgcttgttcaggaactctagaaatcgttatttgaaatgacaaagaayaagacctgaattaaacactgtataagacagagaaaagttagggatgcatctgtcaggataggttatgcacatagtaacaaacaactccacctcacagcagcttaactcaacaagttgatttctcattgtaatgagcatgttcagtgtggcctggcatggaagctctgctcatcgtggtcatccaacaacccaggctgatggaagcttcgtttttacatttgcttccatgatcatcactgcagtgggaaggcagtgtggcaaagcaagtagtcatttgtaaagcttcttccgtaaagtaatatgtatcccttctgcttacatttctgtggtcaaagcaactcctagcagccatgtcaagcctcaaagtgtgcccctagggcaatcctaccagtgctggggaggcagagagctgggaccatgtgcagaagtgtcagtgaccaccacagaggtcttaaatgtaaatttcctgttcttcacctgaccttaacataaacttcattttaaaagaggaaaatgagactgtgaggagaatggagctgtgattctaaaagcagcatttcttctattatattaacatgcttcccataagttctacttcatctcataaaataacaagggaagagtaaatatggtatttttaatgagacctaaaaaactaaagtattgctgggatagtaaatatcagttcaacttgtcaaaagttgttctcagatggaytttaatatgcyctagactgtgaattccttgaaaagtaagactgtatcttactcactttgacatccccagctgctgtcacagtttttgttgtattgtaattactaaaaacaaatttggctaaacttttgaactgatcagtaaagtactgtttgatttctaatatttcatatcaagtgagttttgaatgctctactggtagttttttccttgtcattttttttgcaagagctaaagctacaatttaatagaagtccaaatggaaacatcagtattaacaaggtacatttcacaggttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagcaaaaggctggaagatgtctttccggcagacattgggtaagaattctggacttgtaaatctatttktcaggactgttacctttctgctttatttaatttccccrccccccccccacccccacctgattatgattgcttttccttgaagcttagaagaatatgccatgtaagggcttggttttaaaacttacgtatgacatattttaatgttgtaaaaaaatcactcaacaaatgtacccagcactttgggaggttgaggcgggtggatcacctgaggtcaggagttcaagaccagcctggccaacatggtgaaaccccatctctacaaaaatacaaaaattagctgggcatggtggtgtgtgcctgtaatcccagctacgcaggaggctgaggtgggagaattgcttgaacccaggagatggaggttgcagtgggccaaaatcataccattgcactctagcctgggtgacagaatgagactctgtctcaaaaaaaaaaaaaaaaaaaatcactttggtagcacagtggaggaaggctagaagaacctacaacatggraaggaagaagcttatgatagaaatctagatgggaagtgtcaaagccttgaacggacccagaggggaaagagataaagggaagggcagaaatctgagagacggaaggcagaatacattggaagcacagtgtttggactctgatgatattttaatgaggacatgaattgaggatgactttctataggtaatttgttggatgatggtggcttaggagactaagatttaagggagaaatgttttatttaatttggagtattttaagttggaagacctgtttaaatggagctgtctagttggaagctgatgcttgagaaggaatttggactggagagggtgatgtagcgggggtaggtaaagttaggtgagaggataaactgaaaatatgccccagattactcccactgcatgtgagaaataaattatccacatcaaacaccactggtgagaaatacccatatcaaattaactcagaattttgaataatttaaaataaaaggtagttaatcaattacctgtttggctattctaacagcatcagtgacacagtctaagatcattaatattcgactctggaaagtgttttgatccttttccttttgaatatagatgtgattaatgttctaaaaatgcacaactctccaaacaaatctcatactctgtgaagactcagaaaaatccaggcagttttctgtaataataaccctgattcacttttcaaactttctgtttcttccatagtgtggataaacttcgtttctctgatgcaaaacggagtttaccttcaacttcttgatattgggcatgtgaatttttccatgcagtacttgaggaaagcaattagacattgtgttttgaaggcttcccggtaaaccacacacctcaagacaaattgtatcagaaaatccctttgccacctcccctacttagctgtctcaacagtaacttgaaagcaagtctcacgggcagtgagagagtgttgccttaacagaattgtgtaggtgaagtagcatacaaaagccagaaggctattttgaaagaaaaattaattttcctttggagatttttttttgcacaaaaaagggatatattcttgcctttagcacagactttagaccaaatgtcctatgtctgcatttgctttgctacctttcaagttgtttttctttttcctaatatagtctcacaagaaaatggtaattgttgtgttaacaatctcctcactgctatcatctgcatgaagcttctcaagtgagccagggttccctagcctcattaaattaccatgtctttccaagccacaaagaagacatttttagacctattgtgatttaacagaaggaaaagtcttacactgtcagaagcattctctatgcacgagtcattgaacaattacagtcacttactgttttcctctggccacagttagggaaaaggtttaagtggagaatgtagaaacggaactccttgccagcattgtgttacccctgtatttcatgaagatgatttttacctctttttcatctgcataaatgccatcagccacttggaaatacttcaagtcattgtaactactctttgatggtaatgtttaagtgaaaacctaagtattatgattttgcattgcagtggtcttacaaagctttcaagaccacacactgacaagtttattgatcattctgcataactttcaaattttgtttcattttggtttttattgtttgtagtgaggagagggggaaggaacaataagaatagctttgactgtaaggtttatagggtcgtttagttatagctttggatgaagacaaacttggctaataggatgccccttttgcctccaactcatttatgtaaaacaactctgtctttcccctgaagagagggaaatcaactttgtggaccagatagtggattttcatttacaaagctgtttgctcagcctggaaaacaatatcttcacttagtaaataattgatgtgaagaggagaccattttagtctatgacatttccgtttcgatcttaactaaaacactaagtagggttttgcagatttgctatttagattatacacttggcaatgttttatgtacatctgcttcaatttttcaggatgaagagattggcttatataattatgtgactattaggttcaattcgccttgtgcatttgttatatttgtattgctagcgagtcacagcaaatttgggggaactatccctagttgctaattactaaatatgtagtgaaattgggtctcctttttcctcggaacttctgctgctggaggcccatatgcatggatgcaaggtaaggagaaagcacatttggcaagcatgagctgatctctaactgcaatggaaatgtgcctgcttgtctcccccctgtgctccaatgctatatgaataattgatcctgaatggctgacaaccagcaaaatgatcacactgggctgcagcaatctgtgaaactctgaaataatctgcaaatcggagcatttttcctaaccgagttcatagtttgcatcagattgtcaatggcttctatgctcctataaagtttaaaaagctgttggttctgtggatttggctaagtgggcatggcctataggcagaacggatgcttttaagtaccttctgtcctgttaacttctgctagtttagttgctgccccttcctttaccagcagggtcgtctcctgccttgactctgtttatgtgtgtcctgtacaaatcacttcacacttgcaaacgtatttttaaccatcagagcctccagttcttcctgagggggtctcataccagagagttgcttggcctattcacaatatgcatgtcacactacacatcaaacttctacacatagggttagatcaggggctttcagtaaacttatttatttactgtgcagtagcatcattgtttcattttttttttctaaaatgatgtattctataacacttcagcaaaacttcagtgtagaaaatggaacttggctctattagatgggaggtctgcaggcatttcaattagtgagttgccaaggagagactgaggggtgtcccctgcaagacagcagggggacagacagcacaggaagacagatggggaagacgcaccctcagggacaagtggtggcagtgcctgtgtttctggagttggttccttctggtgggtttgtggtctcactgacttcaagaatgaagccatggaccttcgtggtgagtgttacagctcttaaaattggcatggacccaaagagtgagcggtagcagggtttattgtaaagagcaaaaaaacaaaacttccgcagcgtggaagggtacccgagcaggttgcggctgctggctggggtggccagcttttattcccttattgccccctcccatgttccatttttgtcctatcagagtgcccttttttcaatcctccctgtgattgggtacttttaggatcctgctgattggtgcattttacagagcgttgattggtgcattttacaatcctcttgctagctacagagcgctgattggtgcattttacaatcctcttgtaagacagaaaagttctccaagtccccacttgacccaggaagtccaactggcttcacctctcacctggactcaaagctcccagccagcccctgttgcccagagcacacatgctgatgacgagggccactgtctgccttcctccacctggggtatttgtcacatggagactgagtcaggttgcattaaggtcagttcagagacctttgctaagagaccaaggcaaaaatacccaagcacatatataacaaggacagaatgaattacagtccaacaaatgtataaatatgttcaggtaggctgggcacggtggctcacgcctgtaatactggcactttaggaggctgaggcaggcagatcacttgaggtcaggagtccaagaccagcctggcctacatggtgaaaccccgtctctactaaaaatacaaaaaattagccaggcatggtggtgcatgcttacaaacccagctacttgggaggctgaggcaggagaatcacttgaacccaggaggcagaggttgcagtgacccagtgacccaagatagcaccattgcactccagcctgggcaacaagagcaaaactccgtcccaaaaaaaaaaaaaaaaaaaaaaaaaaaaagctgggcatggtggctcacgcctgtaatctcagcactttgggaggccgaggtgtgtgaatcacctgaggtcgggagttcgaggccagcttgaccaacatggagaaaccctgtctctactaaaaatacaaaattagtcaggcatggtggcacatgcctgtaatcccagctactcgggaggctgaggcaggagaatcgcttgaacctgggaggtgaaggttgtggtgagccaagattgtgcccagcctgaggaacaagagcaaaaaaatccatctaaaaaaaaaaaaaaaaaagaaagaaaaaaagacatatggccagatggaaagagctgattgatgcatgatatcattgcttggtgatacggctttagaaaagccctataacgttttgaatctcaatytttatctactaaaaaactgatcaatttgaaatattacaactrtttaagaatgtgatggggataaagcagataatttctggaaagcaccttagctgtcagagtgaaagactctatgtattagaaagtaatattgaagtcccaaattttcaagccccccgcccaaccctatttccaaggttggagggtggctgagggtggggtgggcagsgatcaacattctcaacaggaccacatcatgctacagtgatttttcgttctttcctacccactttgcagtgacacctaaccgtcaaatcctaaagtacattttataacctaaatctgaaatcaaaagctacattctgattaaatccccaggccttgcacaattgttactccatcgatattgtccatatgagtgatttacagaataaatggataaattgtgcctacttcaaaatcatattttataatgagatataataatataccatatagaacacattagattttatctagattcagctcattctcaaaattcaatcctggtttatataattgttgggtaagctctacacagggaggtaaattgaatcactttcatcttcagagaattaggaataccggatcacactcaatatttaggtcatctgtgtttctctcctgtgagtttttgcctgttaccttaacatctggaaaatgtctctcaaacacgttaaatgaagacagtgggagtggcagaaggaagttgaaggggataaaaaagaaggaaacaggaaagaaagaaagaaggagacagagaaagctgaagagagtctagggccacaaagatggaaaacatggtcacaacaaatggaaaaaaaaatctaacatgtccaattcagacttctgcttctagttatttttaagtttcccagttttggtgttaaatttaaactttgtgaggcattctaaaatagctaaacaatacaagaataaacttaaaaattcaatggcataaaaaatatatgtatatgtctctaggtacctcttggtggcctgattgaagttgtcagctcacgttactgttagaagtacaaatgtaataaggaagttgaattataacttgaataattggataaatcactgatcaaacaactctcagtttagcaataatgagggtattgctccaaagcaaccrtggaatgtcatttttctggtttcctaatgtcatttgctccctgtgatgaagtctgagaatgagatgagctgaaactgtaaacccatttaaagaaaaacccaactaagcttatttccgctctttttaagccctgtaccttttactggtgattagacttcccttgggggatgatcctaaagacaaggttatcttcacgttattctttgtgggttttatggggaaaggttttttgctgagctgagaatgtgggaacgggataaagaaaccaacaaatgcttagttcaccaaaactttacaaaagcaagtagacaggagttaaataccaaatcagcaagaagaaaggaaaggttcttaataaacatatttcaacactggagtctgtgcccccaccaatgactagattgccactcctggtcttgaaggatggggctgtccttgtgaaaataaaaccacatggtattgtggagaccaaactaagtgataaaattgagttaatggtaaattataggataacattttgaaaaacactgaagggaacaggtgctgggaagaagcacttattatgtgtaatctaaaacacaagacgcgacctagttttgtcgcaggtaactggttattttgggttaaattatttgtacccataaattccctataataatcaacatccttactcagatcagcctggctttgttatagcattcccaggaacataaaaacaaaatatatgcagtgagcaataaaaattttaaaacattcttttgttataaataaactgttaggaaatataatagtgggaccgtgttcttctcttcattctaatatgtgaaaagtctgttaacattacatggtagctgtacattttgctcactcacaagtaaagacttgtcaggaaatcccagggcatcgtgaaaatcactgcttgtccctgaacctgtgccctaccagatgtagcatgagctgcttgatgtatattactttatctaatcctcagagctaccagatgagacaggaattaccccattttacaaaggaagaaagaaaaatttaagagattaagtaatttgtctgtggtccaaagrgtttgtaagaggtaaagccaggctttgaacatgagtttgactgtcccccaaactcctgattttcttagtaagccttcattgcctctgtggcaattgataaaaatacccagggatgtgakgtgtgtgtgtgtgtgtgtgtgtgtgtgtgtgtgtgagagagagagagagagacggagtctcactctgttgccaggctggagtgcaatggcgtgatctccgctcactgcaacctccttctcccaggttcaagcaattctcctgcctcagccccttgagtagctgggattacccgcgcatgcaaccacgcctggctaagttttgtatttttagtggagacgggctttcaccatgttggtcaggctggtctcgaactcctgacctcatgatccaccctcctcaggctcccaaagtgctgggattacaggtgtgagccactgcgcccagcccccagggattctttttaacagaaatgtatgcaaaagggcactggaagcaagaaagaagggatctatggtacttggatgttccgtggaagaaaggacacaggactgttagaggatgcacctcagagaatgtgagtcctgaattatggtgcagtgggtaagagggtaaacgtggagcatcacatcccagattcaaactcagtttgtacatctcattgaggtcgatcttggacaatttacttatccactctgagtcttgatttttttttttatctgtaaaaacagtacactaataataatgaccttatagggttcagtgattaaattagaaaatacttgtcactcatttcacatgcgagaatttttagctataaatagtattattttggaaggataagaaggcattcattggccaggcatgctggctcacgcctgtaatcccagcgcttgggaggctgaggcgggctgatcacctgaggtcaggagtttgagaccagcctggccaacatggtgaaaccccatctctaccaaagaatacaaaaattagctaggcttggtggcacacacctgtagtcccagctactcgggcagctgaagcaggagaatcccttgaacctgggaggcagaggttgcagtgagtggagatcacagcactgcactccagcctgggtgacagagtgaaactctatctcaaaaaaaaaaaaaaggcattcaytgggaaaatggacaatctatggagaaataaaacacatgcacaaagttacaggtgcatcccatttcaatggatgccrgctaacctgaacattggtaatgctttggggcataaggcagagaacaataggtgctgagagaggagagatatgcaaaggccaggcatggagggctctgtatcatgtgcaaagaggagccagtcattgttttgagctggagcgtgctatcatctggtcagatttattttagaaagcacatcccagcacctgtggggatgatgttttgaagcagcattccagggaaaaagttagaaaagtattgcaatagtttaggcatgggatgataagagcagtggtaccatgaaaataaagaaagagactgaaaggagaaatcctcaagatatagaatcaataacacagtgttccatttgagagaagcagcttgggaagaagaaataataatgctcctaaggtttctggacaatgtcttgtgacaccactattcaaatagaaaattactaggagaggacagtgctttgcagaataaaataataaaaatgttgggttttgtctggagaatttgatgcctttaggatatccagctagtgatcagtaggtagtcagataagagagttagaagctcagtagaaacatcttggctggagttttgctcttttttattttgaagccatataatgtggcacatgtacatttataattattatatctttctagtggattgactgataccattatgtaacaacgtttttaaatgctttttgccttaatttctacttgttctgatttagtataacttccatagctttcttttgattcatatttgcgtgatatgtttttaaacccttttattttcaacttgtctctatcctgaagaatatatttggcttttgtttggctatgcctttctattgaagaatttaatgtgtttatatctgataaaattactaacaatattagttttagatagacctttgtactatttgtgttttgtttgtcccacttctttttgttttcctttaactatcttttytttttaaaattaatcacttttttattactccccttttaaaattattatttatacatcctgtgactcttgtttcagtagttaccttagagattacagtattcaaccttaatatgttagaatctaatttaaarktgatacttttatcatgttataatcaataatcaatccaaggaccttggaacattttaaacccacttacccacttcctgtcttttgtgctatctatgccaagtattttaattctacgtacataataggtacacaaaacatttttattgttttatacaattactaataatgtaaaattacccttgctgttatttttcttttcttcctgaaattctatgcttccatatgggattaatgtatttcttttggaagacctctcttttatgtttctttcattggagatcttctggtaaaaagtgttctttgtttttgtttttcgaaaatgacttgattttcttaaattctgtgggattcttgctctgagtatagagttctaatttggcatttattttcattcaggactttacgatgctattccatcatgctctggcttgtattattttgattaggaagccattgctttctataactggggacccccatccctcccctggtcatctcattgtagagtactgttattgttgctgttgttgttatttaattttattttagccattctggtaggtgtgtattaatatctcatgtgattttaatttaatggtgaacaattttcacgtgcttttcgtcatctatatatctattctctggtgaaatatctatttatatcttttacccattttctaattgaattgtttatttttctattgttgggttttgagagctttttatctattctcaatcaatgatcctttgtcagtatgtggtttgcaaatgttatttcccagtctatatcttgccttttaattttcttgccttatattggcctttcactgaacaaaagtttttaatgttgaagttcaatttatcgactttttcttttatagatcatgtttttgataccaagtctaagaattctttgcctaccccaaggtcccagagattattctggtgttttcttttaaaagttttatgattttacatttttcatttgtgtctatgatccattttgagctcattttggtttagatatgagatttaggtggaagtcagttttttgcctctggatgtccaattgctctagcaccattggttgaaaaggctgtccttccttcattgaattgcattggcacatttgaaaaaaatcagttggacatatttgtataggtctatttctgggttctgtattctattccattgattatgtgtctaactcctcaccaatatcacactgtcttgattactatagctacatggtaagccttaatatcaggtggagtgattcatcccacttcatttttctttgtgaagttgttttagctatttgaaggcctgtgcctttccatataaattttaaaataaaggctgggggcagtgtctcatgcctgtaatcccggagctttgggagaccaaggtgggaggatcccttgaggccaggagttcaagaccagcctggccaataatagcaagaccctgtcttcaccaaaaataacaaaattagccaggcatggtggcatttgcctgtggtcctagctaactgggaggctgaggtaggaggatcccttgagcccaggagttcaaagttgcagtgagctgtgatcacaccactgcactccagtctgggtgacagagcaagcctctatcctaaaaaaacgtaaataaataaaaataaaaataagttaagctttttgatgtttgcagaaaaaccttgctgagatttttataggaattgcattaaatctatccatcaatttggggaaaactgatgtctttactatgttgagttttccaatccatgaacatatatgtatctagacttatttaggccttcttttatttatttcattattttgtaattttcatcacataagcctgtatctgcttcattaagtatatacctaaatatttcatttttttgtaatgattataaatggtattgttttttaattttggtctccacatgttaatggttagtatattaaaatttgattgatttttgtgtattgttcctttatcctgagttcttgctgaactcatatgttagttctaagaatgtttttccatattacttgggattttctgcagctaatagttacttgcaaaagtggaaattttatttcttcctttccagtctctctatatattttttcttgctttattctggcaagaattctaatactacgctgagttagaggggtgtgaaatcaatatcgttgccttgttcctgatcttagggagaaagcgtttagtatttcaccattaattatgctgttagctgtaggtttttgcagatggtttttatcaagtcaagaaatttctcctctattcctagtttgccaagagtttttatcatgaatgtgtgttggattttgtcaaatcctttttcagcatcaactgacatgatcatgtcattttgcttagtaaattatttttttaatttccaagttggaaagaatgattctcataaaatgccctggggctaatgatgtatgcatagagcattttcagtgatatctaaataatgcaagataaattaaaagataacgataaaattttccttctcctaagttctttatacaagtattgctctttttctattaactacagctactgattagcttgctgaaattacctttcttttagtaaattaccattcttttagttttatgattcctaaatattaccagactaaatacacattttaatttagattaagctgggtttcaaattaggataactaaagtgagtsaaattaagtgaagcaactaaaaacaaacaaaacaataaaaaacctcattacaaaaactactaacttttttcttgtaaaacataaatattatacctgaagtattgtacacattggagattagggagtaaaataataaacactgtttacttttagagaaaaagacaaaacaggttcgtctgaaacctagtagaatgtttttacatgaatacactgctttggagcaattgtgtatctgcagctttataaattacagtaaggctgattccaaaaaaggataatgcatttctagccctgcatccctgggtggtagaaaggaagctgtctaggtgtgctcgaatttccctaaggcaccagctttaaatgtctttgtattctgcttcctgtagtttccagtaaagcttccttcagctgcagcctaaagccacagatggcttgctggaaacaggagagsgcctgaagtcaagccagtctgtatctgctsgtacagcacactgtgcaccttctcagtagtggtcaaccagagacaggcagagatactatccagacaacctcaggaaaatgtcagccgtatagaatgtgagccacaaaaatgtcarttctccaaataatgatttaaaaatgtatctaactccactgaagccttcgagatgttttatccaagagaatgtaactattttttcccttatcagattgatcttggcttaagcttcactctgaggtttagtcattggaaggtaataattcaggattcggttaccgatttttaattaagtagatttagacctggatctcactccttattatggggttatatttccaatatttctttagccaaaacatgtattttctctgaagaaatggctcttttgtgtgagagagatatttccaattcagggaagaaagagtgacgtttgttcttggacgcagggtgtgtcatcagagagtgactracacacctgattgatgaggcaggtgctgatggatgagagctgtctaggtggccccaaaatgtgtagtaatgaggaaatgatggattggtgatgctaaacatatcaaggttaagatggcttatacattaaaaaatgcaatttcaaaatatcagtatggtaaatatatatgactttctgatgcgtgggactctattgcatagtcacagaggtcgcccttgtttatattcccccaccattgaaacacagaaagagcaatgtggcaatagctccttttgggaaagaacccttcttttgttaatattgatcattacgttttctcaaagacatatacacttacatttcattttgcatggagcagttttgctatatttaagcactaaagagggggaattagagcaattgctattccctgcactacacaaataactgttcactcatgtaatatgatattcacttcaaatatttgattattttggccaggattatctcatgatatttttctccatgttctttattctgtgtgtatattttgtgaattgaacaatgagctctattatagtttgatagctcaaacaagctattaatattagttgtgtgtattagtctgctattaccatgacagtgctacttaacaaaccatccaaaattcagtgtcttataatgaaagcatttgtttttatcacttatgggtccacggactagcttgcctgcctccgttccaagctgcgggttggctgtagttggctgtaaagttgagtctgggttcaagtctgctccacatgaatccactttttctttgaaccagcagttactcagcacatgatatcttagtggatcacaggagcacaaagtcctagacaacaataaaaacaagaacaaaacgtaagcacgtttaaggcctctggctgcttcatgaccactaacactcattctaaagcaagtcgtagggctaagcctaacatcaagtgcacagaaaaatatactctccattttagtgcagtgcaaagagagatactgaagaattaaaaatcagccagttaagctgggcatggtggcatgcacctgtaatcccagctattcaagaggctgaggtggaaggatttgcttgaccccaagaatacgagaccagcctgggcatcatagcaagtcctcatctagaagaaaggaaggaaggaaggaaggaagggaaggagggagggaggggaggggaggggaggagagaggaggggaggggaggggaagagagatagagagaaagagagagagagaaagagagagagagaaaaaaggaaaggaaaggaagaaaaaagaaggagtgagggaggaagagaggaagggagggagggagggaggaaggaaggaaggaaggaaggaaaggagggaggatggatcagccaatttaccactcaatccatggcaaacacatcagtgatttaaggatgcttgttctggggttccctggaatgtgggtgtgctgctttatggcattagtcatagcagtagtactacataataagtgtgtgtaatggcattcactgggcccaagtacaattgccatcttgcccttatgaacttattagtaacagttaataaacaagtagtgataaatatagcttgaatgtttaaaaataacatttagtttttgaagctgatgattaatagaataatgcccagcaacagcattttcctgtctacctacctccaactcttcagtgctcctacctgcagccctcaccacagcaatgtcctttcacctggtctcatctycttcagtctcgttcccttgcatgtaaaatgctggttctggatcaatttttagatcagacttrattagcaagtgcatcctgattctaccacttatttgattaaaaatctttcaactgaatcccattagccaaagaacacagtctgacagccaaactctgtataatccagcattgaaggccctctgtagaagaccccatcctgttttcccaatcctaattctcattattctccttcatgtgccctattcttttctcagagttatgcttgcccatgcatataatgtaaattcttgcccatttagccttggatcaagagattctttcaggctggaattgccaatgccaattccatttctacatggttttattctatttatgcttcaagacccagatccaaatcacctcctccttggaacagttgagatcctcatagcccaaagtaatcttcatctttttgcaaaactgtaagacgtttctgcctcttttactgaacctatcattttctaaattgcgtcatcattatttatctatgtcttactactaatggactatcacttatctttttctacttaaatactaaatatactttcttgaatattgaaacaatatgtaataaataaatttatcaatccattcataccctcagtcatcgttcttctgtgctacgcatgccaataagcttaagtggtttccttaagtaacagtcagttcacactggaatcaaagctgctcaaactccacaaactccaaccctctcttgagtttgcaggcccatttcagattagcagaatcattagcaacatgtggtgaagcactgcgtattgcttacgtttcagaataattttgtcctatatgacctctgtgaatatatcagggactgggcctttggaagcatttcaactttgggaaatgtctgactatgcaaatactctatagtttcgcctgacttagaagctatggacaggccaagcctgacctactaagtaatgtgcctgtaacaaaaatcaccctgcacgtttgctatctatccattggatttacagacagggttcaggagagccaccattgttcatgtttactgccaaggtccaagtacaaaatcttagcaccccctaatgttgaaagcagtcttttcaccgtgagcagaaaatggaatgagaaaaatagactgaaggccaatcccagcgaagtttaactttggaactagccatgacctatatttgtgtagaatacaagctttatagacattaatttcagcaccagtttaatccctgttcctactagggctattttgagcttatttcaccatttctttcaaaattgtcaataaattgttcatccctttatgctcttcttaaatcatttctgagctgtctgcttaggccatggagtagacaaaactaaatcttatgttctgaggattgtttttttgtattcttttatggtagaccgtttaatcatcttgagattattctttatctctcctttgtatttttattctgaattataaaatttttatctgaaagaaggcctttttcttctataaagattttttcctttagcttctcatgttttggaaaagaaaaagttaaatatagagtgtggctgaatataaactggactgcagtgttaaatgcctctcagcctctttctatcacactgtgtaaataaaagatttgttggcagcaattttcttggtttgttgggtaaattcttcataaattcagttttcagtctgacagtgttcatgaaagcggaacataaaagtaaaacatatgcacattttccaccagctttattatgcaaagtacttgattttgtataaaactggatttttcaaggccaggaaaatcttcaataaatcacatcagcaatcccaaaaacgtctgtagaaccctatgtgttttcccacttctttcagcaactccgtgaataagaaggagacacctgaaggctctgctatggaagcaaagagcgagggaggcaaagatagagtgaggaagggaaagatagactgagggaggcaaagatagagtgagggagggaaagatagagggagggagggagggaaagatagagggagggatggaaagatagagtgagggagggaaagatggagggagggaaagatagagtgagggaggcaaagatagagggagggagggaaagatagagggagggagggaaagatggagggagggatggaaagatggagggagggaaagatagagtgaggaakggaaagatggagggagggagggaaagatagagggagggatggaaagatggagggagggaaagatagagtgaggaagggaaagatagagggagggagggagggaaagatagagggagggagggaaagatagagtgagggagggaaagatggagggagggaaagatggagggagggagggaaagatagagggagggagggaaagatgatggagggagggaaagatggagggagggaaagatagagggagggagggaaagatagagtgagggaggcaaagatagagggagggagggaaagatagagkgagggagggaaagatkgagggagggaaagatggagggagggaaagatagagkgagggagggaaagatagagtsagggagggaaagatggagggagggaaagatagagggagagagggaaagagagtgagggagggaaagacagagtgagggagggaaatatagagggagggagggaaagatggagggagagagggaaagagagtgagggagggaaagacagagtgagggagggaaagatagagggagggagggaaagatggagggaaggaaagatagagggagggagggaaagatagagtgagggagggaaagatagagggagggaaggagggagagatggggcgggtggggggaaggaagaaagaaaagaaaagagggagggaggaaaggagggagcccaggagggaatgatctgatcatgttctcagagtgtgacagaaaatggaaactatgttctttttaaaaaccctccatgtacaatgtaaggtcggttctgtttggtctgcatagtgatgtctttgttttaatgcagggcctcagcaaggatgtggtggttatctgacaggctcgaataatacctttgcctctcctgattctgattcgaatggaatgtatgacaagaatttaaactgtgtatggatcataattgcacctgtaaacaaagtaattcacctcaccttcaatacatttgctctggaggcagcaagtactaggcaaagatgcctttatgattatgtaaaggtaaggctgttttatttttttaacagagtctattcatcccagactctaatatagtgtattccagtttatatcgttacaggaagtcctgctaattttgagtacaggtgctactgctttttaaaatgaccttttcttcagtgatgctacatttaatattatagatgctctatcttcatatcaaattaatctttaatatgggtgactcaaatattttgtgtgactggcttccaacattagcatttaaatctcctattcatcaatgtcttgcaaaagacgatctataggaaggtcggttttctggagagagatactcaaaggacctttggcaaatcctaaaataaacaatgtcagtgacacaaataatcacctcttaatttgtctatttcttaggcttatagatttgcttatcacattatgtttagatattaaaatggttctgaaatcccattaaaagtaaataaaggctgggcactgtggctcatgcctgtaattccagcaatttgggacaccgaggcaggaggatcacttgaggccaggagtttgagaccagcctggccaacatggtgaaaccctgtttctactaaagacacaaaaaattagccgggtgtggcggcgggcgcctgtagtcccagctgctccagaggctgagrcaggagaatcgcttgaacccgggaggtggaggttgcagtgagctgagatctcgccactgcactctagcctgggtagcagagcaagactccgtctcaaaaataaataaataaataaaataaaaaagtaaatcaagaaacttctgttcaatttttaatgactttaatattaaattattatacctatcaggttatataggttcagattacaagtgttaagtagcatcaatcagtatttactactgcactctcaggggaaaaataaaaagtatggcaagatttgtatttatgaggagcttaagtctgattagaaaattatgggatgacacatgcaaattaagaatgcatagttcaggatagtcagcatttaagcgctaatgaatgcattcgatgcaggcttgaagcaatgtgcaagcttagaaggaaagaaagttcatgaaactcgtgtgatcaagaatgacttgatagagcgagggaaaacttactcaggtcaggagagaattcaggcaaggtgaacattttcaaaaaggcataggaattgatacgtgcatgttctcgaaagcgtaaagaggctggctgtgttgaagcagaatagtgctaaagagtagcaagaaataagatggcctacatagagaaataccgagattacaaaggatcctgaaagtcaaactaatgactttagactctgtgcgggtgaaaataaggagtggttgaaggttttccaatgagtgaggtgacaacagcagtagctagggaagactaacctgaaatcagcagctgtgggaactggaaggagaggaggctgggagggctccagagagaggtccctcctaggtgagaaggtcagtcttagacctggatcaggggtgcagccatggcggtgatggcaagaggggtgcaagagaaacttaagttctaggattgcaataaactttagagaaaataattttaaaagaaaaggaaggaaaatttgtggagggaatacccatttgagcacttagttacatgcttttgtttttactatgaaaggggctaaggttgggaggccagaaaaataacagtgtggtttggtgagagcaagacagacaagtgagactgcagtgggcagagaatggaacrgggctccggtgagaagacagctccacgaatagagaggacacagcaaagagccttccttccatcaggagaaaggatgctttcttagagggagtcagcatagattttcagagagtcaggctctcagctccaggaaaagtacccagggaggcaactggagaaggcaaaaggcacaggaaaagaacagacgcgtcatgaaaagataaatgtgaagaccaggaatagtgtagtatccctgaagtcaaggggcagggggattcttttacaaagcatgggtggtcaatactattgaattgtaaagtagaggccaagaaagggaaagatgaagaacagcctcattgcactggatgacaaccatttaaataaagtattggcacagaagctggatcagaggagttcatgaaagactaaagatagcaaggaatgtcaattccagtttaattctcctttcctaaaatgagacctggccggccgagtgcggtgactcacgtctgtaatcccagcacactgggaggcagaggtaggcagattgcttgagctcagaagtttgagacaagccctggcaacatagtgagaacccgtctctacaaaaaatacaaaacaattatctgggtgtggtgctgtgcacctacggtaccagcttctcgggagactgaggtggaaggatcccctgaacccagaaggtataagctgcagtcagtcgtgattgcatcactgcacaccagcctgggcaacagagtgagatactttcgcmaaaaaaaaaaaaaaaaaaaaaaaaaaaaaaggctgggagagaccaaaatgactagagcagtcctaaagctgaattcaaaactgtttgagagctctcctggctttacagaaaggtaataaggtttagagacggasagtatggggactctaacccaattttgctgtcagacaaatttcctaatctccccgattcctcatcatttcgtcaatttttctttaaatcacataatagtacctactgtgaaaggcagttttgaggattgaaattatgtgtactagagcgtttagcactgtgcctgacataaattgtaaacaaatttacctccctttttttccccgttggagtaattccaaataggcatgggcactatggaatttctttttcttaaaaactaaaaataatggatttgcatataaaattacaattttaaattcttatagaatgatttgagtatggccctgctaggagagttgactggatttactctcaagatccatttttatggagtgtgatttgataatgtcatcaaaacagcctgtcattgtctgaatttccgcaattcattcaggccagaaactgcaatatcaaaaacaaggagttattttcttgcttcaaaataaaatatcgtttttttcaaataaattctgttcagaactattcttgttttcccccttggaaaagcaatttccttccattggcaacgtttccaactaccactaaactggcagatcaaagaatagcccttggaatgtggagcttggagctttctttattaaagagatttttctgtgataaatgggacggttgattccttttagatttttttttagagattataatcaaatcactttttagaaaagctaatttaactgaactctgtggtagatacacaagtaaaatcataccaattccattattcattcataattctatcatgatcgtttgtgaaagggttgacttggagagtaattacggtaactgaatcacgtagtgaattgtgcatgtcactgagcagtctcttttgaaatccacatcgcatccattgcaggagttagttggcaagggtatgtgccaggccctgtaccagcatcactggagatgtagagagttaaagacatctcttgaagagttcaagcttcttgaggagctgctagtaaagtgtaggagactgacatgtaaacaaaaaacatacatttaaataattacatttaaagtacaaataaaatacatttttttttttagttggagtcttgctgttttgcccaggctggactgcagtggtgctgtcttgcccaggctggactgcagtggtgctatctcggctcactgcaggctctgtctcccgggttcacgccattctcctgcctcagcctcctgagtagctgggactacaggcgcccgccaccacacccagctaattttttgtatttttagtagagatgaagtttcactgtgttagccaagatggtctcgatgtcctgaccttgggatccgcccgcctcggcctcccaaagtgctgggattacaggcatgagccaccacgcccggccaaacacatttaaataacggacatttttttcacattgtataacgtgttgcataacatgacaaaaatcataaatagaaacaacatagaagggcagagcagaagaggctctgattggctttgttttggctaggaaaggctttctagagggtgatggctgagctggaatttacaaaatgaacagaaactcactcccttttgttatcctttacgaaactgagaggagcatgaacctagctgactttttctgccaggaagtatggaaccagcagagagaggtcctcatcctaacattgcccagtttttcctcaaccccatccgtgccccttttctttttctttttctttttcttttcttttttttttttttgagacagagtttctatcttgtcacccaggctcgagtgcaatggtgtgatattggcttactgcaacctctgcctcccgaattcaagtgattctcctgcctcggcctcccaagttgctgggattacagacatgcaccaccatgcccagctaatttttgtatttttagtagagacggggtttcaccatgttggccaggcttgtctcgaactcctgaccttaggtgatccacctaccttggcctcccaaagtgctgggattacaggtgtcactgccccttttcatagccaatattttgtaatccttcctttcccacctgaagtgaatgtcatctatgctataacctacccataatgtaatttcagaaaatcactgtactatcccaaaggcaatgaaaaggagaaataaaaggaaagtatataaaatagtgtgtcttcgtatatgtaaatactctaacactgctacacaaagtcacataataaaatagattccttttatatgtagaatggtggtgaataaaaagtataaatgtaaacaaatacgggtgggttrtatttgcaacccgcatgccaatagcagcatcaccatctgcaagataagtttccagaatggtggaaaaactcaaaacaaacatttctaaaccaaacaaagtacagtcttccctcagcttacacaataattgcatttctggaaatttggtgcatatcaaaactgtgcaaaaatatttttgtgtttatatataaaatggacttaggttctgggatcaaataattataaacaagtttttttttacacaaatgtctgacaggacattcaaaagttatgtgggacaaaaatcttcactttgcaaaactgtcctgtgaattactaaatgccagttataggcccaaattatagtgatgacccaaaaaccaccacacttgtgcaaaacactccctatggggtggtattgacctcattgagaaggtctgacttaatgcaccgggcttaaccattcagtctgtgtcagacactggagctgaggaggggctgtccatctttggggagaggatcagcagtctatggaaggcatcacgttcctatccacatgaggtcgtacctactattcattcattctttcattcagttcagtgttaattagcatacctactatattctagacattgctgcaagaactagagaagaacattgagattttagaaaacaatactaggaaaactcctgctcttgtagagctgattctaatcattgcttctttgtggctttttcccagacatctgggactagtataacttttttctccagaagattctgaaatgggtcagagtttagccccaaactggaaaagtcactctctattcttcttcccatactaaattatgccctggcatgttgcccagcagacctcatcagaggttctgcaataagatcaaagaattcatgaagatactctaagattctgctcccagtaagaatatcaaaatcctcttgtgatcaaattcccaggaaaatattaaaagataaagtcctaaggatattaatgtatgaaattattacctttgaaaagaattgtagtccaatatcaaagtctattgcccttgtgcattaaaagttcatagaaattaaaatccaaaaattttctttcccagtttttctaactgctcaagtcaatagctgggtgaaatgtgggattttgccgtggttgtagcagagcctgcctgccactaagttatttgtacaatgccttcaggatctttagcagattctaaaatgatcagatttctaaaagttgagaaaatataacattcttctcagcacttacccacatccacaagacttagaacgtaattcaagctccaggtccatcgcagttgtgccaggaaatgtttgctcccagaatgtggcccgtagctgcgtataatggtgtagatcctaaaggcaccatttatatcccagtttatatatgattccccctcctcatcattggatagggcgtcccctgcaacgcaytgtagggcaacctggcaaaagtctgtagtgaaggtttagtgttatcagagaacaagagagcagatagagatcttgggtttgaggcagaggagtttagagcctcctatgtcagttatcccgaggccacaagctatttcaactcacttaggagaaatcttactgtggcaatgaatgaactaacacaagaccagcttggggccaggtatgtatgtcatttccttccatccagccctggcttctgcctcctaccttccttcacatttaccagttatccatttaaaacccaaatctgatcttacatcacgtaggatcagatccagactccttggatgaaatgtatggaacttcacagctttgtttgttggacttcgtcatttctcctgttctctcaccctggcctccagggccaatgaagggggtcagaagttgttgacacgtgccatgcatttcacacttccatggcctggcatttattactgtctggctgggatacccttcctgttttgtaggtctggaaggtctttttttttttttttttgggacagagtttcgctcttgtcgcccaggctggaatgcagtggtgcgatcttggctcactgcaacctctgcctcccgggttcaagcaattctcctgcctcagcctcccaagtagctgggattacaggcctgcgccaccacatctggctaatttcgtatttttaatagagatggggtttctccattttggtcaggctggtctcgaactcctgacctcaggcgatccgcctgcctcggcctcccaaagtgctgggattacaggaatgagccaccacgccccgcaggtctggaaggtctctacttacatttaagggccaacccaaatgtctgtctccatcacgtgggttctcatgatacactcccattattttattgtagcacttatttttctctattttgtatataatttatatacacatatatttatgtgtatgcatagtgtatgtgcatattacacaaatatatgtatttgtatatttaatttgtagacctttactctcctttgttcatgaaggggtcttatgtcttgaagatctggaaagggctttacatgtccttgtatgcctgggatctagcacagaggcctggcatacaggtcccagaataaaaatscttgctaatataaatgtgatcataaagacagcaatgattatcatgaaattttaacttgtttaccagaaaaagtgcatgacctaaaacttggcaaatgtgctcttccatgaaacaaaggggtgaagattagaaaactcgastttcatctgattctgaattaactaaaatcatgtttaagttggaaagacagtgccatctagtggtgcatttctttttcttttacaatgactggttttagtcattcctgtcttacataatcctagcactttagaataatgtcagtggtcatggtcatggctgttctgaggccttgaacacatagctctgttatgaattgaatatttggagttagatacacacagacactcattttagaagtacaatggagattactcagaagaaaacattttctagttatgtgtttcagggaaatccaagcacccactatttcgatggatgtttctagaagggagccatggttgggaattgttctgggtgctggcgacaccacagtgaagaagtcagacagagtctctgtctccccacacgtgggacttacatccttgttgggaaagagaccggacaaagtaaataaacaataaataagatcagttttgattataataggaaaataaaacaggatgatgctatgggagggcaacattcaatagcattggcttctctgaggaggtgacatgtcaggtgagggcccatgacagggagtccttagctgtgtgggttcagcttcacctgaggaaggaagagcagcaggaacagggctgtggacaggagtcctcctgggatgaaggaagtgcagctagcagtgaggtgtgggcagcctgggaaggaggcacaggccagagcagctggggcttgcagactgtgggagggagctggaattttactttaggtgcaatggggatctgccgaagcattttagacagagcaggagcatcacctcattggagtttgcagacatgcaggcagttcagtggagaacactatggctgctccggaattaggcctattaagaagatgtttcagtgggaacaggtgaaggacgatggagatcacctggagatggagccctctgggatatattttgaaggtagattggagtagttgtggagtgaagagagagagagaggaatcagagatgactaaagttgtaggcttgaaacattgaggtaaagatggctctgggagaacagttttgggagggctagtgggacagaggaatcaaagcacttgtttatttatttattagatatttattgagagcctstcacgtgcagacacttttctaaaaactgggaacatggcagtgagcagaaaagaaatctgtacattcatggaacttgtattgtcttcagagagaaagccaatgaaataagcaagtttagcctggacaacataggaagaccccatctctaaaaattttttttaattagctaggcatggtggcatgcacctgtagtcccaggtacttgggaggctgaggtgggaggatcacttgagcccagaagttcaaggttgcagtgagctatgattgcagcactgcactccagcctgggcaacagcgtgagaccttatttcaaaaaaaaaaaaaagctaaatatgtagtatatagaagaaggtaacagttgctgtggagaaaaatcaagcaggaaaggagatgggaatgttgggagagtttacatctggaaggccttattgagttggggatatctttttttttttttttttttttttgagacagtcttgcactgtcacccaggctggagtgtagtggcaccatctcagctcactgtaacctccacctcctarattcaagttattctcctgcctcagcctcccaagtatatgggattacaggggtgtaccaccacgcccggccgagttggggatatgtgagtaaagacctgaagaaatgcacgaggacaaactatgtggatatacagggaagagcattccaggcaaagtgaacagcaaatgccatacccaagaagcagcaacacacctggtttggctcaagaagcggaatcgaacaaagtgaagacaataagaaattarattaraaaggtcaggggtgggagaggagagaaagccattgtgatgcctttggctgtttgattgagtggatgggaagcagttaggaggatttcagcagagcagkgacatggtgtgacttacattttaacagtatcctctcgatgacattttgaggatacactaaagaggaacacgagcagaatcaggggcttcatgggaggctgcagtgatcatctaggcaagagatcagagcagttggggccatagtgtgagtcggtgcagaggttaaagtagcagtgggtgagcggactctcataacaccttcttttaaaaatcatatatttcccaaagaggaaaaaaatgttaggcgtcataacaggtttttcctgaaagtcataatataatcaatccaattataattctgttcctaaattaagactacctctaagaaaatcaatgtaaaaatgtttaccgtgacctattgcaacttcgcgtccaatttagtgtgaaatatgcaattttttgtaagtaatggagaagtaatgaattgtttttcttctcagttatatgatggggatagtgaaaatgcgaacttggctggaacgttttgtggttccacagtacctgctccttttatctcttctggtaacttccttacggttcaattcatcagtgacttaacattagagagggaaggatttaatgctacatacaccatcatggacagtgagtaaatagaagcatttttatatgttatgaaatacacatgtatttatgcactgaaaagaatgccctgcttattatatcgaaatttcaatgttaattactaaactcaatgtcaattactatctaaactcaatgtcaattgctaaacaccatgttaattactgtatgtttaatctgtggtacaaatttgatacaatctttagtcaaggatataaaccctgaattcttaatagagtaatgaaaatatagctcctccggggtgggaggcagggaagacagaattgcaaagattgcctgagatgagacatgaataaaatgtctcctgtgttgctttttcctccctctccagtgccttgtggtggaacrtacaatgcaacttggaccccacaaaatatttcatcacccaattcatcagacccagatgtcccattttccatctgtacttgggtcattgattcccctccgcatcagcaggtcaagataactgtgtgggcattacagctgacctcgcaagactgcacgcagaattacttacagcttcaggactcaccgcaggtaacaattataagatgaatggcagtcacatctagtgaccttttcaccagtatttgcaaaacacttgaagtaatgaagccatgatgaaataattttcttttttttaattatactttaagttttagggtacatgcgcacaatgtgcaagtttgttacatatgtatacatgtgccatgttggtgtgctgcacccattaactcgtcatttaacattaggtatatctcctaatgctatccctcccccctcccctcttcccccaccccacaacaggccccggtgtgtgatgttccccttcctgtgtccatgtgttccgattgttcaattcccacctatgagtgagaatatgcggtgtttggttttttgtccttgcgatagtttgctgagaatgatggtttctagcttcatccatgtccctacaaaggacatgacctcatcattttttatggctgcatagtattccatggtgtgtatgtgccacattttcttaatccggtctatcattgttggacatttgggatggttccaagtctttgctattgtgaatagtgccgcaataaacatacgtgtgcatgtgtctttatagcagcatgatttataatcctttgggtatatacccagtaatgggatggctggatcaaatggtatttctagttctagatccctraggaatcrccacactgwcttccacaatggttgaactagtttacagttccaccaacagtgtcaaagcgttcctatttctccacatcctctccagcacctgttgtttcctgactttttaacaatcaccattctaactggtgtgagatggtatctcattgtggttttgatttgcatttctctgatggctagtgatgatgagcattttttcatgtgtcttttggctgcataaatgtcttcttttgagaagtgtctgttcatatccttcgcccactttttgatggagtggtttgtttcatgatgaaataattttctaagttacttccagcttaatgtgtttttcatccatacacaaagccctccaatcaggtgtgtcgagaaacttgaacttggtcctgcaggtccagagctctcaaagcttcatgtgcctaagaatgcattaagatgcatcttaaaagtgcatcctccctggcccaccctcagagaccgaatcccccatataacacccatttatctgaatttttgacaaacacctctggtgttttggtgccagtaccagaactccatggaccatgcttggagaaatacctctagttagtgggatttatgtataggttgaattgaaagggtcagtacagaacacaagagaatcagtgaagaggctgtttggcactagtctgataggtttatattcatggtaatataagagagataaaaagaaaagggctgggtgtggtggctcatgcttataatcccagcactttgggaggccaaggctggtggattacctgaggtcaggagttcaagatcagcctggccagtgtggtgaaaccctgcctctactgaaaatacaaaaaattagctgggtgcagtggtgtgcgcttgtaatcccagctactcaggaggctgaggtaggagaatcgcttgaacctgggaagcagaggttgcagtgagccaagatcgcgccactgcactccagcctgggtgacagagtgagacttcgtctcaacaacaacaacaacaaaatccattttgagctttaaaaaaggctgagtctgaatttcctctggaataagatgttgaggagacagttggacacaaagtgggttgttgaccaaaggcccaaagatttttgtgcatcatcattatcatgataggtaattgaaaaatgagaagaatgagattatctggggaaaatatgcaaagggattggccacgaactgaggatggataccaggagaacatctgagaatacctggattgtctttctgcagtttggggagcaactaaccctccccagttcattccagtaaaatgtcatggtcaaagccccatatgctggactagtagagtatctgttgtcttctgagttttcagggtccccttcattataaatctggggtcccctgcttctcatgtggtcttgctggggaaagaaaagtccaggttgtgtgactccagagtggagaggcgtgagatgtgctggcagctgaatagaccctggacttgctgagtttggtgcaaagcatatatgctgagatgagctcccaaggtggacaagatgctagattatcgtcattccattggtaatggttttcaggacaaaatctctattacccattggtaccctagaggacttacagccaagtggaacaggccctttgggtgaaagctctctcaattttccctggcttcacgaagctaagacaatggggatcagggtggaccactcagcggggcacagaatggcactttcagggcacgagacaccgtctgaaacataacagcagctggagcagcctcgagtaagacccagtgtttgtcatgactgaataatgttttccactgaatgaatacaggaaacaatcaagggtttcggactgggtaggtagggaggaaagacaaacattgacggatgagctgggagaaactgggattctcggggtatccaagagtagacagagcagccctaattggcagatcatgaaggaatgatgtgtagggtggttacggaggatgttcagtggttagctggcactggagatgaacagagatgcagagatagaaggccctaaggttaagaaatatgaagttgagggtgtttaatggcttgtctataaaaacacagaaacctctaaagggttcagaaaggaaatcaggggcaggagatgactatgagctgagacacctcaagtctttcataaatgaagggaagtaactgggagaaaagtaaatgagagtgacgataatggtaagaatatctttggccagatgtagagaccgtcgaaggagaaccagctttgagacgaggatggaagctgcagtgaggaatgtggagcctccctcccttcccccgaggctggccccccacccttcccactcaatgaactgtggagcatgggtaaagaacagcctctaccaggaggctgctggagaaccaggttttgctaaggccacaaagtggaaaggtgggggatgtataccgagaatgactgacagtgcagttaaagttcacaggatacagcaaagttagacaaggaccaagagcaggagacagtggggaagaggggtggaagccccgagcagttacaggagttttgcaagcagagacgggtggggtgtttcagtaggttcctaagaactgcagatattagagacattcctgtgacagggaggctgcaaataccctgactttggtacaacttgtttttacccaagaactgatgggcattcgactgcatttactccaggcttttgagaggtgatgagggctgccctagtgttacaaaggggaaccggtacctcatgacaggccccggctggcttgggggatgtacagtggaaccaaaggctctgattagatttgctaaggggtagcaagggctggatcagggtgatggtggttgttagtcccatggagctcaggacaatggcaaaagccccaggaggagagatccagtgagctctcaaacagcctagatcctcagagcaatggcacaggcctcagctaggaagttgcataaaaggcgagggatcttattttcagcagggaaatgtctgtggtttcagcagaagctttgcctcccttcctcctgcccctctgggaaggtgcaacttgcatcaattccaaggccaacgtgagtcttcttgcagagcacttccaacagcagagctggtttccatggctaaatatttacaccatgcttttatatgcagtctaatttctgttatggcctgttctcttctaagactaaatctaacatgatttggctcccatttcatttcagggtcacggaaattcaagatttcagttctgtggcagaaatgcttcggctgtgccagtgttttattcttctatgagtactgcaatggtcattttcaaatctggagttgtaaacagaaactctagaatgagtttcacctatcagattgcaggtgaggccaggaacttcatcttttattcaraaaagctgccatcattaccattattcgtagaataattacaattatttctagaattgactcctgtgagtaaattaggatttgttaacaaaaaccacatccctctcttaactagaacccagcccaatttagcaaattactacagttggtttctaaagagataaagagaatataatactatccaggatggttagaatgctagcattttcttcaaagtatatgtagttgattttaaaaatatgccaattatcttattaattatacacttaaccacattgaatatacatttttatttacaagaaatatatatgtttatttacaaaagctttatcaaaatataattctcatatcatacaatttacccatttaaagtttatatttcagaggtttttagtattttcacaaaattgaaaatcttagaaaattattttgtaaaaatcaaaaagccttgaaagagttacctgattattataagaagtttattttcacagaacactttatttagtacttattttgaattgactcaaatgaaagcttcctttggttaaaacaaacgaaagtacttttggtatttttttaccaaaaaaaaaaaaaaaggtaaataacgatttgccacaaataactcaacaatggatttaaaatccttgtgcaaaactctgtcttggaggtagcatccttgtcgaaaagagagtctgaatgctacttccacctcaacgtgatcagaaaagttcaaaggatgctcgagtattcgtctttaaaggagaagcctcctgtgtcatgcttcctgtaggcgtgtttgtgtgaacgagctgttgcrttgcacctgtgtgtgctgcttgagcaattcacttcactgctcagggtctcaattatctcaaaggtaaacgaagaagctggattacttttttctaaagtttatcaaatgcaatgatctttttgaatgattcctgtgaagttgaaagagcactaaatattggaatgcgtacattaattatgcctatttttcctctaagattgcaacagagactatcacaaggcatttggcaacctgagaagccctggatggccagataactacgacaatgacaaggattgcaycgttactctcacagccccccagaaccacaccatttccctcttttttcattcacttggcatcgagaactcagttgaatgcagaaacgatttcttggaggtgatatgcatttgaatatcgtttgaatgaattatttaaaagatggtggatcacttaagattttacaccttttatctagtgctgctaataytatatgattcttatttgtttcattaatttattcattaccctttcattccctaaacatctacagagcaccagtccaaacaccggaaattgggaaccttagggcccgcaggagactcctagtctggcaggaaggacagatggggtatagccaattacagcacaatgtggaaaggactaactgagtccagcatgggttggggttcctaactcagtctgggaactagaaggctcaagagggcaatatgtaagttgagacctaaaaggatcagagggaagtctaaggacaacatgctggttctgtaaaatgaarctcaatgatactaaatagctcacctaattttcctgacagctacagtaagtttggggcatcgtcaacatcctctaaagacaagtgtttccttgaataaatgctccctggtctcaggggggtgtggtctgtcctttcttcaccacaactccagagcttgaattkgggcacagaaatgacttcactgtttgcccatcgtccacacacccacccyccactcccaccccaggacacactgagaragaagcccccttgtgcctggagcaggcagaaccatgcgcctcgtgggcctgaaactttggggtcctccagtgcccccgatgagctccctctgtgctctttctgccccatcgctgcattgggcatatgagatggaacatgaacatcatcgctcataggcaggagatagtctgaataagcctcatgtgatgtggacccagtgtgtggaactcagcccctgtgttttgccagaaaaaccccagagctcacggggtttgagctttgcaagctctgtcgaaaatgcattcatccttaggaaatatacttaggtggaacctaaaaacmaagagcataaagatgctgagttcctctgtgagtggagtttaaatctaaacctcatcctgaccgtctctaaactggctttgtaccacacaagagtcttcagtaaagtttccaaaaagtgtgcttgttcctctacccctgatctggagttgtattttttattttattttttttctcactgcctctttaatcaggtcttcattcaaaataagctgcccaagaggatttgacctttgtagcataaagaaatgtaccggtgtaggcagcgggctcctttcattctgtgggacgattctttctagcgggcctctgctcagctgatagtttcttggtagcttcagcctttgttcccaacaaaacatcttctgcttcttagcaccaagggctttctttctttcttttctttcttcttctttcttttctsscctgcaayccccctcatccgatttggctcctagggctgctggcaccttctgcccagcctggccaggaagggtgttctggcatatggtctttgcatatgggtttagcttcaacatgattcctgatgcggagttttatcatcctggaaagctctcccctttggaattcatctaaatcctttattaatcaataaccttaacatatagtgccataaataacactcggaggaagctcatgccttttctaaaggaatactcgccacgacaggagaccgaaagatgtatatagcagggaggaaatgaagaggcaaatacagttattctttgtgccggtcaggttattcaacttggacctgtgtacctcccccaccatggagatccaaatatttatatgaagtgtaaagcagaaagaatgaggagagtgggatctggaggaaagawggaataatcccgttaggttggagtcacagygcaactaactcttaactcactccagcttgaatggaccattattgatcagagtcaacgtttgccrtttgcctgatagatgctgggaagcaaagccttgctttccagccgtggagagtgagaattcctcctcctagctgtccttcattactccacagaatggatctgaaacttcctgtcccataagcaaagaaaggaaaccaccgcttaggcctgtaaaatgtagctccatctggctctcagtgggaaggctgtgggcatagtttcttggcagctgtaccaggaagcctcagcattccgttcttgtgaactgcggtgggaacggaaatgtctgactgagaattctgactgtgttactaccaagcgagggccgagctctagaccatgcttggaatctgttttcatgccttcacctcccctttcaagatcctctgatgtcccagagatgcccactgctctaggtggccccattcttcctaggagaggaaagtgaataagacaagttgtcagcagtgtcagtggaaattagtatcctgctgctcctctcagagcaacggcattttgaaagaggaccctgagggaaaaacgcccaaactcaaragcgtggtgctggctatggcagccctcccatctactagtggatgactggctactctgtcatggcaaggttactttgtttaaacacttagcagaataatccccaaagcactagaaaggcattattctctcccatgggctactacatcgacctaaaaggaatctcacctgatcaacacagcccagcaagatgtcttaactttgtgacttaagataccagcaattaaccaaagtttaaaccatggaattatatagggaacagaggaacttccaatattttgaatacatagatcagtaaaatcagcatttccgcatgtcaggctggktccaacatacattgcccgcgtaacgtttccgtaagaagcgtcgagagccctcctggaagcagggctggttgtgaatgcagggtagcagccaggctgggggacagaaagtggttcagttcacagtgtagttctctctccccataaaacacaggctcatctcctgtttttatatgtgtctactcaaaaatgagttgaaacaaaaaagcaacaaggcctcggaatgtgtttgtaaaacacatttaacaacagacattgtatagatttataattctgtcctttgcccatacagaaattcctttcgttctgaactttattatactttgcattgtattttttcatagcctctttacagccaagtaattttcaatgggaaacacgtgcacacacacacatacacaaacacacacacaatgagaaaggtgtaatagttgactggaagcagagcaggcaacattgcccccgcccatctccaccttttaaaaattcactttacctacrttctccaraatgtttccccaaaagcaaaggctgcaggatcacagcacaaactacggtataaaaaagctgcctggtgttttaattgctgtaggttaacaggtatttctgaatccaaatgcaaatgttttttgatctacacgtggaacatttttcccctttgcaagtgaaggtgacttctgcatgtattttcagaaaaygcttcattcttaactgtataaaaagacaaagcttttccgaccaatgtcatcattcaaattgtctccattttaatgtatataccttagagaagaaagtgtaagtttaataatgaatgactccttcctaaaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggtaagacatttgcactttgtacaggaaagcactgtgagaaaaacatgaggtgtctaatagtaaaaggcaaagtaactttatatttttagctacctgtgtacctgattagtttatgttaagaatagagattttaacattgaaagtacagattacttttttttttttgaaatrgaatctcgctgtgtcatccagcctggagtgtagtggcgtgatcttagctcactgcaacctccacctcccaggttcaagtgattctcctacctcagcttcccaagtagctgagattacaggcatgcgccaccatgcccagccgatttttgtatttttagtagacagagcgtttccccatattggccaggctggtcycaaactcctgaactcaggtgatccaacctcccaaagtgctgggattacaggcatgagccaccgcgcccggccagattactttaaattytacatttattcattatttctgtttataaaagaatatatattcatatatgaaacatatataaggtaaggtaggaagattcaaaaattccttggtaaattaaattttgttagactttttgacttttggcttgaccatcaaggaagttctttgagaatttaaagaaaaatttttaccaaaaatccaacttatgaacacattctggcatatatatgagtagttgtgcttctcgcaggccctgacatttcttggcggttctggagagaaattgctttttttagggtagtaagtatcttctcacatttttggctggctgtttatcaaacaactaaagaaaatttaagtcatgtcaatacatttaattcaagagaggaggaatacctttataaaatatcccaaaataccaaaataccttcaaaataagaaagataaacagaactcactttaaatatcttaagaaaagcgttctataaagataatcgtgggtaatggaatcttggcacccaaaggaagcttaaaggtgacctccaatgctcaaattttatcaacgagcaaataaaacaccaagattaagctaggtgctgtggctcacacctataatccctgggagaccaaggtgggtggatcacctgaggtcaggagttccagaccagtgtggcccacagggtgaaaccccatctccactaaaaatacaaaaattaactgggtgtagtggcacatgcctgtaatcccagctactcgggaggctgagactggagaatcacttgaacttgggagatggaggctgtagtgagccgagatcacgccactgcactccagcctgggtgacggagcaagactccgtctcaaaaaaaaaaacaaaacaaaaaaaacccaccatgaacccgggaggtggagcttgcagtgagccaagatcgtgccactgcactccagcctgggcgacagagcaagactccatctcaaaaaaaaaaccaaccaaacaaaaaaacccaccaagattaatgagttgcccaaaatgctccactagactgaggtgaaggtgagattagacctcagtggtcagaggcccagccacgtgctctgtaactatgccagccagcttcttcctgtcccagagatgacctggatctccacagatatatagtctaaatcatgacagccttcatatacagattaacaaattgaacaaattaacaccaaaacttgaagtatttgaccttaagtatgtcagttattagcctggtaaagtcacttttataatgaagtcattcctgccgtcacctacaataacgcactccctcttggtttagtgctgaattttacttctaattttacttcactcayatcactggcgtcaactctgggcatgcaaagatctctacaccatcgaaagcacacagacaacaacttgattttctcccacagttactttatcaagtttkttttttttttttttttycattctgctctcaacccccmattttmaaagtacagtcctggaggaagttatccctgggttgtgatatgcaggcaaaggcacgtgtgtggaggatggaagaggtggaggtggcagtgggaagagaggggaagagaggagaaagggtgtagcccaaagaagaggaaaaggaaaagggatttctgcctccattattcttgcagagtctcagcaccttaagaaaataaagtcttattgcctaacaagccagactggacggcttatatgctgttgaatcaaacttcctgtcctgttttccttgcaggatgtggtggaactctttatggagacagaggctcattcaccagccccggctatccaggcacatacccaaacaacacgtactgcgagtgggtccttgttgctcctgctggaaggcttgtcaccatcaasttctacttcatcagcattgacgatccaggagactgtgtccagaactatctcacactctatgatgggcccaacgccagctctccatcctctggaccatactgcggaggcgtgagtaaaacaaacattttatattcccatttgttatttttagacaataatgagtcacttagtgtagactttttttttttttaagatggaatctcgctcttgtcacccaggctggagtgcagtggtgcgcgcaatctcaactcactgcaacctccgcctcctgggttcaagcaattctyctgcctcagcctcctgagtagctgggattacaggtgcctgccaccacactcagctaatttttgtacttttagtagaaacagggttttgccatgttgaccaggctggtctcgaactcctgacctcaggtgatccacccgcttgggcctccgaaagtgttgggattacacgcgtgagccactgggcccggcctagtgtagactttcaaaggcagacacactgcagaggaagaagcacagcctttaacaaattgagcagttttccaacttgcctttctattatgggagcatgagtgccatctggtgggcattgcattaaattactattaagagttmcaaaaatcagccctgcgtcagaatcacctgtggagttacttacattagacttccagttcccaccgaaacccactgaatcgggatttcccagggaggagtcacagcacgctgtttttttwaaaaaaagctccctctgtgacgtcagtgcactgcctagggttgaatacccatgtttatttctgcataaatagaactgtagaaaatttggacacgtggctctattttatctacttcttgctgaaaattgcagaaattatttgaagaaatggtgaccgatagtttgtttttgtaaagctctgatatcttccctaaaaaaatcagaatctgacgttgattcaatattgcaggcatctgtgcttacgatcctctcatttgatgtgcaagtagatacttaaagagagtaagggctcacacctgcaatcccaacactttgggaggcccaggcaggtggatcacttgagctcagaagtttgagactagactggccaacatggggaaaccccgtctctactaaaaatacaaaaattagctggtatagtggcacacgcctgtaatcccaagtactccggaggctgagggaaaataattgcttgagccagggaggcggaggttgcagtgagccgagatggcgccactccactccagcctgggcgacagagccagactccatctcaaaataacaagagagtaagtaagggaaaattggctgttggcaagcgggtatctgtttctgatttttctgccctttaatcacttagactttgtaatcaaactagacagagaactgtatcagctggaaatctagatggtttttaaaatataacttactatttataaaattgataaatgctgttttcagaagtatcagaaaataggctaatttttctaaaaccctgggcattctcatatattcttaacacctttctttgaatatatttgcatatattttacatgcatattttttactgtttgatggtgtgttttttctacttaccaatatatcattagtaacatatcaataaaaacactgttgcatcatatttaagttttggagagtattccgttgcacgagtgtggcctaatttatttaatgaagcccctctaagtggacatttaggtctcttgaactttttgcaactrcagacaacacttaataaactttttggtagtgatatctttatacatatagttacattacttggtgagaaatggtaatcacaggaccagcagacactgtatcacggggatgcacagaaggcccacagagagagagaccccagtaaatgtgccacacatcagatttagaagctaatcagctcttagacattgaattgaaatttacaaacatttcaaaagggaggaaaagaggcaattttaacaataccatgactttatattggtaggggtttttttgtgggcatggttttcagtggcttgcaaacatacaaccccatttgatccccacagtgacactcccataaggtggaaagaacaagtatatcctggacttgtataaaccgagttcaggtttatactgaacaagtataaaccgagtcactgagagaagtgacggccatttaatccaatgccacgttaagttgaagtatatagcgagataacatcaatttttttaactgttggtgtttacggtattttcccagttttacatttttttataaatgtggatataatttcatgtgtaattgttttttttcttaaaggtaccactgatttctttaacactttatcaatgttaaacataaatgaaaaaatgtaaaacataagtataaaacatgaagtacagaggtagctcttgttttgctaatatttacatacaactttttgtaagttgtaatattttactaatatttacatacatactttcacatgttacatacatacatatttacatgcatatttacatacatatgaaagttgtatacttttgtatgtatactccttaagtatacaattcaactttttatgtatgtaaatatgcatgtaaatatgtttgttaaacttgtaatatttatatacatacagtatttaaatacatacagtgtacatacagaggtagctccttattttgctaatataaacacaaaccctgatttggagatattttatattacggtaaataccattgttcacagggaaatcctatatcccttgcagctgcagaaaatgaagatctagcaaatgagagaataacgggacaaacaaggagaatcaaaggagattctaaaacttctgttgaccgtctgttgacatactagtttgtcaaaataaaagaagttattgaaatttggaagcagattaaaatgggagtaaaaagtagatgtgtataggaataaaaatattgtatattccttgatgtatctcttacagaaaaaaaaatctacactcacttgagtaagtgagtatcttggaaataagcctgtgttttgatgacttggggtagggctgaggcaggagaagccagtcatgtaagcatcatgagagcagggctttttgcctgttttgctcattttttaatgtcttaatacctgcagcgtggcagtgccttgatcaatatttgccaaatgaatgaatagaaagtgagagacaacggggacccatgtatccccccaacacmcacacacacacacacacacacacacacacacacacacactgttccacagaagtatatgaaaataaatctcaagaggaaaaactataaacactgaggatgaaaatactatattttacttaataggatcattttaattatatatgtttgtttcagaaaaattaaatttgcagtaagaacttgaataagaagttcaagttttttgataacagttttattgagatacaatttcaataccatccaattcatctccttaaagtatacaattcagtggtttttcgtaggttcacagagctgtgcggccattatcagcacagccaattttgggacactttcattaccccccaaagaaacccagtacccatttgcagtccttccccattttccctcaactccccacgcccagaaatattcctttgtaaagcatttgcattcattctttgcaaggttacttcaagaaatatatgcaggttcaccataaattctataaagtttctttatgtggtactttgttactaggctaacattcctagaaaaacgttcaaatatgtgaaatatataattggatactttttttttcaattttaggacaccagcatagctcccttcgtggcttcctcaaatcaggtcttcataaaatttcatgctgattatgcacggcgtccatccgcattccgattaacttgggacagctaagtgggtaacaactcgtgttcactcagcactttccctctgcagcacgctggacagcactctgccatcctgatacatgacccctgctgatgccacagagaataagctgaacttgtatggtttttcaccaaaccatrgatagaatcaatatttgtaggccaggcgtggtggctcacccccctgtattctcagcactttgggaggccgaggcaggttgatcacctgaggtcaggagtttgagactagcctggccagcatggtgaaacctcatctctctaacaatataataattagccaggcgtggtggtgggtgcctgtaattccagccactcgagaggctgaggcaggagaattgcttgaacccaggaggcagaggttgcagtgagctaagatcacaccactacactccagcctgggcgagacggcaagactccatctcaaaaaaaaaagaaacaaaaaaaaccagaatcaatatttgtacattttctcgaacatagaatatagcttctttagtcttgagtgtgcatttcattctaatattttgagctgaaatttaaaaaaactttgaaagagttggaaatgattatggcatatgtgacatacrtttttaaaagttaataataatagccaggggcagtggctcatacccataatcccagcacgctgggaggccatgatgggaggattgcttgaacctaggagtttgagaccagcctgggcaacaaagtgagacctgatttttacaaaaaatcaaaaaattagccaggcatggtggcatgcacccgtggttccagctacacaggaggttgaagcaggaggatcacttgagcccagtaggttaaggctgcagtgaaaccctgtgaattaaccactgtactccagcctgggtgacagactgagaccctatctcaaaaatgacaacaagaacaacaaaagttaatgataatatagaagcataaatttcctgtgaatgttcaattacacataataaacattattgaattgtacacaattatgctgcattaattttttgacttattaaaactctgtctttcactatgggacatatataaattttcaagtttaatttttacattttggcaaagaattcaatatatatatgaatcttccagagcttcatttctggagccaagctgcctgagtttcaattttaactgtactagttaagtgcttacacaatctctctgtgctcagtttcttcatttgtataaggggattattttacctgtctcacagggttgcaataattaagtatatatgtgtaaagactcagaacaatacctggtgcatattaagtaattggtaaatgctagcttctatgtcaattagtagtagtatgactctcctccttaccatacagatgtacctgcttttcccatactcctccaaagccaggcccaagtctcacctgtgtttaccttttgccatgcccctaggtcaatctgagcttctccaaagaccttgccttaactacagagaagtttgccgtaacctctgaattctctatttccctcccatttgactcaaacttctgtttctcctggccacgccgaaccttttcttcatttatccccaggaccctgtactctcctggttatttaatttctctgagtattctccactctcctgtagaatggtggccctcttcacacagctccactaggcagtgccccagtaggaactcagtgtggggcctccgacccacatttccctgctacactgccctagtagaggtcctctgtgaggattctgcccctgcagaaggctgcttcctgaaaacccaggcttttccataccacctccaaaatctggggagaagctgccaagaatctaccactcttgtactctgtgtgcctgcaggtttaacaccccgtggaggctgccaaggcttatggctttcattctccaaagtggcagcccaagctgtacctgggcccctttgagccgtagctggagctggagtgaccagggcgtggggagccctgtcttgagcctatgcagggaagcagggccctgggcctggtccatgaaatcattctttcctcccaggcctctgggcctgtgatgggaggggtttcagcaaaggtttctgaaatgcctttggggacttttctccattatcttggatattagcagttggcttttrgttatgcaaatatctctagcaagtggatgcctcacagcctgcttgaattcctctcctgaaaaagctttttctttctctgccatatggccaggctgtaaattttccaaatttttacactctgctttcctttttaatataagttccaattcgaagtcatttctttgctcccacatctgagcacatgctattagaagcagccagcccaaatcttgaacactttgctgcttagaaattttttccaccagataccccaggttgccactctttagttcaaacttccacagatccctagggcatggacagaatgcagccaagttctttgctaaggcataatatgtgtcacctttgctccagttcccactaagttcctcattaccatcgaagaccttggcagcctggacttcattatccatatcactatcagaattttagttgcaacttttaaacagtctctaagaagttccaaattttccctcatctttctgtcttctgagccttccaaactcttccaacctctacccattatcttgttccaaagtcagttccacattttcaggtatctttataacaaaaccccactcctggtaccaattttctgtaatagatcattcttgcattgctataaagaaatacccgagactgggtaacttataaagaaaagaggtttaatctgctcacagctctgcaggctttataggaaacatggtgctgacatctgcttggcttctggggcagcctcaggaagcttataatcatggaggaaggcgaaggggaaacaggcatgtcacacggtgaaagcaggagcaagacagcgagagtatgggacaggtgccacacacttttaagtggccagctctcatgtgaactcagagcaagagctcacttatcaccaagggtatggcccaagccattcatgagggatctacccccacgatctaaacacctcccaccaggccgatctccaacactggcttttataactcaacatgagatttgagcagggacaaatatccaaactctattatgtatttacgctcaggagtacaaagtttccataagcaccaccattgcctattccttaacacaatatgttaagttataaataaacaatatggtttgccacttaacaagaagtagaaagttcagtagcacatccttatctccaatgctgccagacatgtaactaagtgaggtagttattagcttccttttcataagaaaattcaatgcttttataaagtttttcagtgcctctagaaaagcggaagcctttacaaaggagatttgctttatgttaattatgcaaaatcaagggttattaacaaaagaccatgtgaatgagagaagctgaggaatgtaacttcatcttactctaatactcaaatggcagataattatttctggacagagtatggagccacagaaataaaatactctaaccttgaaaattcagctactcaggaggctgaggctggacaatcacttgaacctaggaggcggaggtttcagtgagccaacatcgcgccacttcactccagtgtgggttacagaatgagactccatctcaaaaaaacaaacaacaacaacaacaattcctgctccctttttgtattatggatagacatatcaactttatgggtgacaattacattggaaaggacagtgaatgcgataagtaacaccatcaaatccaaaaggtcttgataagctacaacaatgggccaattgtaacagacgaaatgtgacagatataagatcttcctcttttatcaaaaaatgaattgcaaaagtacagaatacagggaaagtttaacaataacatgaaatgacatagtacttttctgaaagaaagattaacatgatgtcactgtcaaaaaaatgatgcttagagcatggactgcatcattagagtaacggtatcatttccactcagaagggcatgcttttctaggaggcatattggaatatctgggaagtgtgtacctgaaattgaggaaagcatagtcaatattattatgtaattttaaaattaaaaatacagaaaaaaagagacaaaatgaagctttacaaaatcttccaggctgggcatctaggaaataagcagtgattttttagtgggttagggatggtcaggcttgggagcatgacattttcgtgtatagccaagggaagtagttattgagtaattcagtttttgagtaattcagctggaagaaggagaaaagagtcaactgtactctcattcgtaagacccaccgtatatcctctggttctgctttacatttaattcacttgtttccaaatgtttattgagcatcagctatgtgatacgtactcagcgcactgaggataaagcagagaacaagacagccatacaagactatcagctgatgtctcccagcttcacaaagcacacttcccagctccatcttgcttgatttcctgagccagtcctgaggcaaaaaccttaatattcttatctggtgaaacatacattgagccaacttcccagatctagtggccaagggataagtttcctgattccaaattgtgtcaccatgaagtttcactgctagcaatcaggaccctggacaggctaaccatcatcctagcaaattaatcaaacctgagaagggggtgtgggaaccctgatttatagctggtcagtcagaagtgtaggtgacagtcaacctaaagtcttgtggaaatgaacccttaacttgtgggatttgactataagttgaggtagacagtgtcagaattaagttaaactgtaagacaccgagctggtgtctgctggagaactgtttcatgtgtgggggattctctggtgtcagaagtgttgagccagtggagagtagcaaaaacagtttggtttttcctatctcaaacaggagtgaaaacaaattcctatgaaacagaagtgaatggaggcatgcagctcaaaataacttcaagagagacatgcaggagggctgggactctctgttccaggtgtaacctggatgtggggctggctggtgcagtgtgaggggctaaaaccaaagtcagggagttgccctaactggcactcacaatccaccatttccctccacctgcaaaggtagccgggtgatgacctgcaggcataatactgggttcttgcctctgaagaaattcgactatcagtctagggatctaggaggaaaacaatacaaacaaacaagagaccactccagctatctagaaaaaccagttcagatcttcacacttgaactcaaaagaacaaccaagaatcaatcaccagagaggggaagaatctttcttttctagggaaaagactagataaatacacgtaagaatggacccttgaagaaacataattgagtgaacagaagagaggtttaaaaactattatcctcggtgatacctgagaagagagtacattcatgaaacaaatgcagggtgttattataggccggcagtccaataggactggtgtccttagaagaagagacaccaagggtgtgactgcatagagaaaatgccctggagggacaccaagagaagacagtcgtccacgaggcaggggagaggccacaggataaatcaaatctgctggcaccttgatctagaacttccaggattgtgagaaatttctgttgtttaagccatccaggctgtggtatattgttacgacagccctagccgactaacacaggtactgtatgtcttcagcctacctaggcaagattcactattagaaattgatagaataagaaaaattctgattgcttcaaaacaggacttttgctttaaaagagttaatgattcaagaaataaatgtattaggagattacctactaatacgtattgatgaaattatgaagttagaaaatcatcagtggatgctaaaacttgtgggtaaaaattagatgaggaatggggtgtaatcaagtagcacctccccccagcattatttttaatcataaagaaaaaaatagtaactttatggtgaagaaacctggcagacactaccttatttaagtgaacatcacctatactgggagaaaccgatgccatctgtaccttgatatcatgcactggaaaagacacatcgctttagtggtgtttctccaaaaattcataacctgaaagggaacatcaaacttactttgaaggatattccacacaatacctggtctgtattcttaaataatgtctagttcaataaacataaaagccaaggacggttccagatcaaagaagactaatggaggaataactctttcatctggaatgttttttaagcaagaaatacctgctttcgaatttaagagtgcagatcctttttttatccaattggttcggagatataattacattattttaccacatctccttaaggctttgatccctgctacaatctacaatatataaatgcatatgtgtggcatccgtcttatcatcaatttaggtgaccagtagaagaaaagtgcctggtgccaatttttattccatagtataaaatagtctctcaggacagggtttttggtgagagaagcacaggatgtygctgggtgactgagaccgggtcaggaaatagggaggcagagggcaacagtttctctagaatttaaaatttggttgcttttggaagagaaagcaagagattcctggaagccagaacgtcatgtttcacaaatgtaaaagtcctagttgggaaagacacatcgctttagtggtgttttcaaatgacttttaaaatagtagggttttacttgtaggttctagctacaagtaaaaaggctaaaagccagccttagaaacctgtcaaaaaagatttccagcagggcgctgg

SEQ ID NO: 17608 - DNA, 12586 bp, Homo sapiens
ttttcatagtgatgacacatgtccacattcagcagttgaatctgtaataactctaagttcattaatttaacagagtccccccgggacccacaccttgcagagatgtaatcacatttattccactcttacaatgtcacctgcctactcaagaatccctgatagcttcctctggcctgctatatttttttggtttgtatgatccgaaatgtcttgctcctccaaaaatttgcatgttgagccccacacttccagtacttcagaatgcaactgtatttgaaatagggtcttagaattgactacgttaaaatgagcccatttaggatgtgccgtaatccaacctcaccagtgtcttcacgaagaggaaactttggacacccaaggaaacaccagggatgcaaacacagagaggaaacaccatgtaaggacacagtgaggtgaccctctgcaagctaaggagaggcctcagaaggaaccaatcatgccgacaccttgatcttggactttcagcctttagaactgtgagaaaataaatttctattgtttaagcctcccagtctgtagtattttgtgatggcagtcccagaaaactaatgcatatcaagtccaaactcccctttcgggaattaaaaatcttccctcaggcaacttttttgatccaactttccattactcatcaactgagcactcagatcccaccctcatgccctctgcatgctgtgtaattttctctttagcattcaccttcaatgctttctccagggatgctctctcccctcttttgttatccataaagcccaatgcagggccaccatgaagtctactctagtccagcccagactcctctctcccaattcctaacatttacctggtgctactagattgaaaattgaattgttcctaagatcccaaaaagctcatttctaatgagaagtcttaaggcaatatcatcagtgcctaaactagagctgagcatagagaagcactacaaaaacattggttgaatcaatgaactatttataaaggactttattattttcttattttttacatgataatctttatattccttacgcttttagtcaagaagtagttaataagcttctgatgtgttccttgttatgtactaggcagaatacagggataaatggtataaatgccatcctcagggagcttatggtctggtacagactgcagataagtcaacattaattggggctaaatactgtcttctcttatttcctgcataatttcttttcataacttcgattacagggtgaagtgcctaggcaatctataaacccttgctaaatgtttgaggaggaaaagagctaatatgaactggagctacattctccagccagactgtagctcttcttcagccaagcccctgggaagctcaccacagctcttttctgctcctggaaatctctataccatgttacatgagggaggatctgaggaactgaccttcaagtcttgatagttcttttgaaagaacagtcaagcttcttctgtctataaaaagagataaaccggacagagatagggtgactatacttcctaggtagcccatgtaagttccagtctaagccaaacgtctcaatgtaactatgaatagtgcccctttcactactgtttagtgagtgttctgtttaagtaacacaagcattctatttaagtaacaaattatgtggttgacctaggcagcgacaacttatcttgaggaaggctatgagaccaagaatggctttttaaacattttcaagtagtcaggatcattttatctgttctacttgtactgacttgagagaatatggcagatcttcttgggctctttcattttattttattttttttaatttttgaaatggagtttcactcttgtttcccaggctggagtacaatggcatgatctcggctcactgcaacctccgcctaccgggttcaagagattctcctgcctcagcctcctgagtagttgggattacaggcacacacccctatgcctggctaattttttatatttttagtagagatggggtttcaccattttggccaggctggtcttgaactcctgacctcaggtgatccaccagccttggcgtcccaaagtgctaggattacaggcgtgagctactgcacccaaccctcttggactcttttagaggccacactgccatggtctctctttggccattgccaggcctagttccagagccttcttccatatcagttcttccagccccttggcggactcgcaggtgtctcgccacttcccttcttattctacttccccctgacccacgtccagcccctgggcttatacctaccctccaagtctgactgtcattctgagcctattgggcccacctgcattcttggacgccatccattttcctcagtgaggtccaggcatcccctaaaggcatacattcattgattcattcagcaaatagacagtaagcttgtgtactgcatatgaggccctgtcctcaggcacacaagtaaggataaccggggtgtcagctctcatgacatgagcaccctgacagtccaggccatacaacgaacaggactattaaattcaactctctcagcaagcctacgagtaggcattgagcttcactgttgcacagatgaagaaattcaaagtcaaagaggtttcctcacctgcccaggagctctcagagaggaagtgaccgagctcagtgcatgcataggtctgtgcagatcagccccattaccctgaatctctctcctccgattctgctctgagggaagtacaagtgttctggcagcctggaggagcggttttccagtggagccactttggcactagggcctgggtgacatggggtagcagttttgactcagaaatcaattaagggcagtgcagaagttaagaaagggcctcaaagggccttattttctttaagactagctgtaggcctccaaaatgaaagcagagtaaggttgccagataaaataccagatgtacagttatatttgtttcaaataagcaatgaataattttagaaatttcatatatgtgtgtatataaatatattttatgtacttttttttcctcaatctggcaaccttaatttcagtgcacttctggatgtctatttagctacacccctcaggtcatgaagtagaagggacccatgcatcaccccacctggaataaagtatgcatttgctgcagtgttgttcctctgttatttccaaggaacctggggtttggggacaggagaggaagctgacaggctatagagggaccagagggcactaactcagctgactttccagcctgaaatgtgcttccctcccctatttaatcccatatttaaaaagcaaatttccaaggtaaactcaaatgcattaatacctgcttattaattaatttctgcttagacagatttaacacacaaatcccaatgtgggccaaaaccagataatcccacaaagcacattaagtatgaccttgtttccaatgtagcaactccttaaaaaataaaacccacagtatttagcttgatattcaaggctgacctcaaactacctttctagacacaagtcccctcacaattgccctgaagttgtgtcaaacacaayacactctacagaatagtcaaactggtgatagccccaagtctttgcccgtgtggtccctttctccaacagagatcctacatattatttttgcctgtcaatatccaaagtcagagaagcaataatagtagcaatacctctccacccttgccttctagcccatcatgccactgacatacctgctgcatacactgaaattatgaacactctagagcctgtgtcaatggttaagttctcaaggaagtagacactaagatgaagtgaagaatgcaaaagtttattgacaagtaatatcagtgaaaggaaaaagaagaacaggtttgggcatggagagttatcagatcagtacaccaatctaataatgctttggccaacccaacagggagttccagaacagaatttttccattagagcactcccataatgggctgaaagagctaggcccttgtatcactgccttgatcagcctttggccagaatccatcctaagaatagcatgaacacagccagagcagaagtggacactgacgaagctagtagctagaagctctcagctaatcacattccccatggccaggcaaggagacccttcttttaaaggagacactgagcaagacatcttttgccgtagccagaaaaagactcctaggcagggctggttcttgaaatgacttcagagacacttcagactgaagcatcccctgaaactttgacatgacacctgaattccaacattcaaaagtcatcacttttagagtattgaagtttttggaatttctgagattctcaatatagttcygaaaatacgtatacactcctaggctaaatctattagcacaagtaaacagaaaagtttaatgatgattgaagcagcattggatgttagctaacaccatggactttgggtttgacagttgcgggtgtaagtcttcgctaaaggagtaaatagataattgaaagcacgacctcacaggaactaggcaatggatggcgtgtgtgtttgagttcatgagtgcaaaagcaaaaagtcagatacaggactcattcctagcatgcttctgacgtgtaccagggacattaggattccttgatagactgcccagtgtcccagaccagttgatcccattaagaaatcctgctggtgaggaagccctttcaatctggagaatgagaatccattccaatggggcaggacttaattgaaggacctgagctactcacatgaataggcatctataattttctggcctctactggggcagtctttctcatggaggcttttgcagcccccaaggaccttctacactggctgagagcctgctgccaagcaagttgtagacttcctagaggctatagaggagtctcattcattttgttactcattaagtatttacttaatgagtgtgcactaggcaccatgctatgcactgaaagaatacagatacagatgagacagagaccccatgctaatgaatttcccattcagcaatcaagaagcaagtcttcaatttcaattgagaataaagattactactaaagatgtaagaatagggtactgtgggatctttcaggatggggcataaaatcctgcctcagagtttggaggaatctgccttggaaagggaaattcagaggtggagtctataattttgtaaaatttggccaaaaagtagtgggaaaggtttataggcagaagtatatgcaaaggccaagaggaagaaacatgtttggaaacagccacgagtttagtatgcctggagaaaagggactgagaattaaaggaaaggaaattgagaagcatggagaaatgaggctggagtgttgagtagaaccagttcatgaaggggcttgctgttaggtcaagggatttgcatttcatcccacagctaatggggagtcactgaatggttattaggatgcctaccacacagtaagcactcaattagtattagtgattattcaatcattcattcgacaaatggtcattgaacatttaaaggattatgtattaggcactttcttatgttgggattattttttaaagtgaataaaatcaggaattaaattatctttcttgtagatgtcagctctctaataggagagtcaaacatcagtaaagactgacagaagaatgtgaactagtacaaccactttggaaattaatgtggagattccttaaagaactaaaagtagaactaccactttatccaccaatcccactactgggtatctacccagagaaaaataagtcattatacaaaaaagatacttgcttatgcatgtttatagcagcacaatttgcaatcacacaaatgtgaaacaaacccaaatgcccatcagttgatgagtggataaagaaactgtggtccagatcactgcagagaacatggattccttgaggcaggcaatgcsagagataaaggacttcaccatcacctgtgggaagacggacgtggaggatccccaggagcacatccacrtccagtgggtggatgacgacaagaactttagcaaatgtgtcataagtcctataaatgagaagtccatggagactataacaaatgtgaagctattccatggaycagaatgtaaagcaaatggaaaagttatcagatggacagaggtgtttttcctagaaaacacctaaatgatcctacaaaatgatcattttagcaaatgatcctgcaaatcaaattagattgactaagcatgttgccaaggctttttgccttgctctctgtcctcacctgaagcttctgaaggaagatggaatgaccaaactgggactaagtatgacacttgactcagatcaggttygctatcaagcagggagcaatggccagccccttccctcacagtatatgaatgatctggacagcrccttggtgccagtgatccccggaggggcctgtcagctcagtgagggccctgtcgtcatggaactcatcttttatatcctggaaaacatcgcataaacagaggagacttcatttttttcttttcaggcctgttgcaatggcagtcatacccaaatcaattgcactttaaaactcaaaaattaagcttttgttaacactgttaatggaatggggaatagggtgggagtggcggtttgtgagactggtaggaaagggtggatggggagacagatgttccataattctaagtcttctatgcattgtccaccaagaagatctgggcagcttctgttcctgcacaacagttatgctatccttgcagctaatccccttctcttactgtttagacaagaattctgctcctctctcaagatttacttatggccatgtgctcagaaatgctcaaatgggtacaaccatcaccaagggtgggatgggaaggcagaggggaaataaaatatgaagcataaaagaaaatagaaagaaactgtggtatatatgtatgatggaatactactcagccataaaaaggaatgaataaatggcatttgcagcaacctggatgggattggagattattatctaagtaagacaactcaggaatggaaaaccaaacatcgtatattctcacttatagcaggagctaagctgtgaggatgcagaggcataagagtgacacaatggactttggggactcagaaggaaagggtgggaaggaggtgagagctaaaagactacaaattggcttcagtatatacttctctggagataggtgcactaaaatctcacaaatcaccactaaagaacttactcatgtaaccaaataccacctgttcccccaaaacctatggaaataatttaaaaaaaaaaatactgacaccaaaatgcaatattgaaactgtgtcagtgttgtggaagagacatgcatggtgcctgaggttcctttgaggaagcagctgtgcctggagacctgaaagaagagtagctataactcaaaaagcaggtagtagtatgaggagagtttcaggcaatgggaaaaacttgagcaaataacttgaggagggatggcatatggcttgactgagagcctgcaaggaagccaggtgtcttgagtctcaaaagctcgagggagtatggagagaggcaaccgtggagaaatagaaaggagccttcccaggcaaggccttacatacagtgtgcaggactttagtcttcgtggtgtaagtaacaggaagctagggagctttctaaatggggtgggrgctgggcaacacaaggatgacaatatgatttgccttctggaaagatctgtcttgttgcagtgtggagaatggagtgaaggagacatgaaagcctttggagataccagttttgaggctgaaaagaggtcatgttaactaggactttgatgacagcagtaaaggtaagagaaagaagaggatttgaaagccttgagtatcaaaatcacagaactttggttggtgagagagattctggtttatgtaactggctggatggtgatgttgtttaccttcattgggatcctgggccaggtttgaggggaacattatgattttaatgacctggtcaaacgcctgtattttattttgctttgtttcatgaaatacttcaaatatacagaaagttcagaaaataacataattaacttctgtgcacccactgtccaactctatcaaatcccaacaaaagcaggagagtaaagacaaattccacagacagattacctgggatcaaaccacagctctgccatttactctcatgtaggctgagtcctattatttcatctcttgtgcctggcacagtaagtagcaagtacatgttaccctttttttctccattattttgcaatacctgtttcagactgctttttaaaaataaaaacaaaacagatggtagtgaagcagcacgtgaacacccttgtaagcccatttccttcccaccatcctcaggaattaaccactattttgattttgttgtttatacacaatgatgttttatcttagtgctacctatccataaatgggataagcatagttttgtttatttccagatgcatataaatggtattatatataataatgatatatatatcattctataagttgctgtatttgatcaacattgcatttttcttaatgtgtctatattgtgtctctataactcatttgattaatttttaaatagacttttaaaaagagaaattacaggttcaaatcaaaattgagcagaagatacagaaattttttcatgtatatcccttctccaacacatgtgtagcctccccagttatcagtatcttccaccagagtggtacatttattagaactgatgaacctacattgataagtcattatcacccagagtccatagtttacattaatgttcactctgagtgttgtacattttatgagtttggagaaatttataataatagtatccatagtatcatagagagtagtttcactgctctaaaaatcctctgtgttctgcctagtcatccctcccttctctcaacccctagcaaccactgatttttttttaccgtctctatagttttgcattttccagaatgtcatacagctggaaatatatcatttatacatagccttttcatactggcttctttcacttagtaatacacatataagttttttacatgtctttcatggcttgatagctcatttcctgtcagtgttgaataatatttcattgtctgaatatatcacagtttatcaattcatctactgaaggacatcttgtttgcttccaagttttatcaattatgaataaagctgctataaacatccatgtatttttgtggacatgtttcctactccttagggtaaattcaagaagcatgaccactagatcatacggtaagattaggtttagttttgtaataatttcactgatttttaactatggcatattattccatttcatgaatatactataatgtatttatctgttatcctgtttgtagacacttaggtaatgaattttttcacacttattaaaaaatgctgccttgagtattttcatatacaaatctcattgggcatgtatgtgacagtttcccaatatatatgtcctaggtcaatgggtgaacgtattttccactttacttgaaattgccaattttttctccgaaatgattatgcagacttcaattccactaacagtgtactacagttcctgtactccacatatttaacattacagactatatcgacagccttttattaaaaaaaaaattttgctggtaagacaagtatgaaacgatatgtcacagttatcttatttacatttttcctaattattaatgaacttgagcattgtttatctgtttattttctttgagtttatttttacattaatttcctgttcaaattctttgctcaatttttcattggattggttatgatttttcatattaaattgtaggaattatttagaagtaccaaatagtcatcttcattggctatatcttttgcaaatgttacctctgtgcgtattacaattacattatttatgatactgttttgatgttttacatgttgcttttaattctgtgtggaatttttgtatttgtatgggagaaagttaggatatgattttatatactttcacaggaatatctaattttgttgagacaatattattttgcctagttgattcataatggmatttgtcataactacwttttctcaataagtggtctatttctaaatttcctattccatcagtttatttgtctatgcttttgccagtttctcagtctaaattagagctctacaacacttttcagtgatgatgaaaatctgcaatctgcatattgcatattccccaacatatgcttagcctcccagttatcaatatcttccaccagagtggtgtatttattagaactgatgaggctacattgacatgtcattatcacacagagcccacagtttacattaatgtttactctgagtgtaaactgcagagctgaatgtatagctctgcagttatacattctatgggtttggagaaatttataataacgtatatccacagtatcatagagagtaccttcactgccctaaaaatccacactgtgactgctaactacttatagctattgagaacctgaagtgtggtttctgtaactgaagaactgaattttaaattttgttaattatgaagtggaagctgctagtcccttatgtacaacctgaaaaaatgcagtgattctttaattgtttggtaagacttaaccctgaaagcacaaacataacattaaaggaatctacatgtaaagaccaattcaatgtatttaatgtctaatagttcattaatatttcatatgaaatatcattttagctaagctttcaactttattggcataaaatctatttttctcttgggaattatttaaatttctaatttgtagttaactttcctttttttctttaatattttatgtttgccattattttaactgattgacctaccaagcaaactgcctaccccattatctatcttcaaagcagtttttctatttattgatattatatattatttgtttactatttcattaatttctcttaatttaattttaatcttcctcatgtttcaggaagtggttttgtggttcttttttgttctctttgtggttctttttcctagatttttagatgaaaatttaactcatattttttatttttattaagcatattttgatagataaatttacttctaagtcctcaattagctgcatcccatttttatagtattttcaggatcatttaattcttttttttcattttgatatcctaattaaaccatgaattacttaggtgagcattttcaagtttccaaatgatatatacttgtttatttcttctttttcttttattttttaactattattttgttgctttgttttctacttcaattatatcatgatcatgaaatatgttttacatgatagtgacttttggaggctgtgtgacttcttttgagatttattacatcatcaatttttgtaaaatatttgtcatttttatacctgttagatgtagattacaaatttcattgttaattttctggaaccataatctatcgggagaaattcagccagatatcgggagaaattcacctctgatatttcacataggttcttttctattttccctaagtgtcggctgttctgagaaataaagggacagaatacaaaagagagaaattttaaagctgggtgtccaggggagacatcatatgttggcaggttctgtgatgccccacaagctgcaaaaccagcaagtttttattagtgattttcaaaaggggagggagtgtacgaatagggtgtgggtcacagggatcacatgcttcacaaggtaataagatatcacaaggtaaatggaggcagggcgagatcacaggaccacaggaccggggtaaaattaaaattgctaatgaagtttctgcatgcattgtcattgataacatcttatcaggagacagggtttgagagcaggcaaccggtctgaccaaaatttattaggcgggaatttcctcgtcctaataagcctgggagcactacgggagactggggcttatttcatccctacagctgcaaccgtaaaagacggccacccctgaagtggccatttcagagggctaccctcagggatgcattctctttctcagggatattctttcctgagaaaaagaattcagcgatatttctcccatttgcttttgaaagaagagaaataaggctctgtttcacccagctcaccagcggtcagagtttaaggttatctcccttgttccctgaacattgctattatcctgttcttttttcaaggtgcccagatttcatattgttcaaacacacacgctctacaaacaatttgtgcagttaacgcaatcatcacagggtcctgaggccacatacatcctcctcagtttaagaagatgacaggattaagagattaaagtaaagacaggcataggaaatcacaaggatattgattggggaa

SEQ ID NO: 17609 - DNA, 51696 bp, Homo sapiens
tccatccagaggccacgctttccattcaaaccaggacttgcttcaaaggcagaaagaaggcagcggcgttctaacagataccaaggcaagagacccggtcacatccttccttactggtgttgtttccctacattggccaaccacacccaccgaaaaggggagggcagggccccagagttcctgctcctttgagtccccccactccctgtgagaggaaggtagagagtgctgatgaaacgtgcacataccaagaagtgaaaggaaaacagatgagcttgttttctgcagtgtttctgcaagctgtgaaataggcacaattctggtggttttaaataagagctaaatgcactggtttttgtgcttataactggcattgagtgatatcaaggtgaatggtaaatgcatgctaataatttaacgttttaatttttctatactctcaaggtgaatggtaaatgcatgctaataatttaacgttttaatttttctatacttagaacaacattaaacagcaaattttaaaaacaccatgacaggccaggagcagtggctcactcctgcaatcccagcattttgggaggctgagggcagggagatcacttgaggtcaggagtttgagaccagcctggccaacagggtgaaacctcatctctaccaaaaatacaaaaattagctgggcatggtggcacacacttgtaattccagctactcgggaggctgaggcaagagatttgcttgaacccgggaggtggaggttacagtgagccaagatcacaccacaccactgccctccagcctgggggagcaacagagtgagacttggtctcaaaataacaaaacaacaacaacaacaaaaaagaacacttgtcatgacaagtcaaaagagagaccacagaagaaaggaaaaagccttatggcttaatacctttaccaacacttctttcctgctttttgaggaatgggcccatttttcactttgtacggagtcccacaaattctgtagttggcctgcctgtcatacgtttccgtgaatgctaaggaaaggatggtggctggaggcggagctgtgcaagaagaaacagcaatacaaaagggggaaattcggccgggcgcagtggctcacgcctgtaatcccagcacttcgggaggctgaggagggcggatcacgaggtcaggagatcgagaccatcccggctaccacggagaaaccccgtctctactaaaaatacaaaaaattagctgggcatggtggcgggcacctgtagtcccagctactcgggaggctgaggcaggagaatcgcttgaacccgggaggcggagcttgcagtgagccgagatcgtgtcaccgcactccagcctgggggacagagcgagactccgtctcaaaaaaaaataaaggggggggcggaattccgcttacaacaacagcatacataatatgatcctgttcatgtaaagtgggatatattgaagtacggacatatataacactatataatgaatatatgtaaacacacagaaacatggcatcaaattctttttttttttttttttttaatttgagacacagtttcattctgtcactcaggctgaagtgcagtggcgcaatctcggctcactgcaacatccgcctcctgggttcaagggattcttctgcctcagcctcccaagtagctgggattacaggctcctgccaccacacctggctaattttgtattttttagtagagacagggttttaccatgttggccaggctggtctcaaacccctgacctcaagtgatccacccgcctggacttccaaagtgctgggactacaggcgtgagccaccgcgcccagctggcatcaaattcttaatcatctccaagctgtacacttttcagttgattttcactttttatcatacacattaagttcaaataatagagaaacaatacatccatattatgtatatgatcagctgtttttttttgttttttttgttttttgagacagagtctcactctgttgcccaggcgagactgcagtggtgcaatttcggcttactgcaacctccacctcccaggttcaagtgattctcctgcctcagcctcctgagtaactggcattacagatgtgtgccaccatgcctggctcatttttgtattttttagtagagacggggttttgctatgttggccaggctgatctcgaactcctgacctcagatgatccgcctgcctcggcctcccaaagtgctgggattacaggcgcgagccactgcacccagccatgaccagcttttttaaaaagctgcattttcatttggggaaggggaagacatgccgatggagtcagacttggactcagctcttggctctgctgtttccactgtgcaggatttaggccaagttaagtaactcctctcagcctctgattctccatctgtaaaatggggatactgactggtaaccatctcatcaggctgttgtgaagggtcgtgtgcttacgtagggcctgctacagagatcacttggcagcgagtcgccatgcggggctagggctggggggctcatgcctgtgccagaggacagtgcccccacaggctgtgcaggaggcctctgggaagggaggccagaggcagagaaggcaggccagagatggcacgcatgggcacatgggctgggaggcgcattggggacgcagaggctctctagagttcttagctgtgagtgttagtgccaatcaggcaaaactacaggctctgcatgggttttgccatgaacccaaatcagcacttatcctctgaccctgctttccagtttccctgctggtctgtctgacctgtgtgtaactggtcagccttttgcagggcggctgctgattcacagaggaccagggagtgcctttctggtcagcactgtggcattctggacaaaagcacagcccgctcctggaggccgacgaatagaataatggccttcccgggaggacctgtgccttacacacagacatgtggagagaaagatctggaacattggggtggagggtggactttcataaacaaacatgtacacacatgtctacagcccgcttttatgctgttctgtttggcctggtctttccttcatcccagtaaggttggatctgggcacttttccctatagactgcttgtactccttgcagagggcacctcctatgtgccggctgataaatagcaataagtaagacggggtccttgcctcgtggtgttctcagaccaccaagaacagttccggggtgtgttagaaaacaggcatgcaagaggtgcggacaagaccaggggcttcaggaaaggcccccaggcagcctcccaagagaagagcaggcttgattcaagcgagggcgagaaagggcatttcaggcagagattgccacatcaaaggccccgggtcaagtgcaatcctgccccactcaggagtgcgaggggggtctgtggggctaaagtacagagggctggccgtggctggggaggctgcagtggccggggaggagacagcaggaggaacagcttcttatcgtgccatgtgaaagagccctgcttagtggggcagggttttgccaaaataactggatccctcctgtggtccttgctgaacgcagttgggctgactcgaacctggaggctttacagggctgagccaccccctgcagaccccagccaaggagactgagtggtgaggagtgtgatgaggctgccgctgcagggactttgcaggggcgttgagacaaaccttctcatagcaaaaatgcagtacaaaagtgtgccactccagacataaactgggtgctactgagtcctcaaggaacactttgaaatcctccgcctggctctgcccataggcaggggactggcctcagggtaaactcctccgaggcacggggatgtctgaggcatggggatgactgattcattcacttctgcttgacaatgcactgcctggctatgtgggtatctgataaatgagtgtgtgggtggatggatggagggagggagggagggaggcagtgagagagggagggatggactgatggatggacagacagacggatggatggatggacggatggacggacagatggatggatggatggatggttggatggatagacggatggacagacagacaggcgaataagtaaatgaatggttggataggtggataggcaggtgggcggatgtgtgggtagataccagtgtagatgaatggaagagtgtgtaattgttttataagattaaaatattcttttgatggcaggacacaacacagtgacactcagataaatgaaaggtagaacttttgtttcttacagctccaaatgagaggctgtcaggctgggccacacaggatgtgcaactggggacagggtccaagcaagctggagctataggcggcagctatgtgtggcacgtagggtggtgttaacgaggtttccttggctccctatggattggctaacttaaataagtttgtgagttccagatgatgggagctgtccattattgtttggtacctggctccaaggccatcagggcaggtggctagtggcccagagtgtgagaacctggtaagagaaagggccagaatgtgaacttaatcagctgctcatgaactggctggcctccagccaggacctcaaaactggtttaaagtagcctttttaaaaaactatatgacagagatggatggagatgtgtgcagatggacagatgtcttttagagatttctgtcaatgatatttacagaagcatcaacattggattcagatccttgaggattttcaactcatagatacagagctctacaatatctaagttggaagagacttcagagggtctctggacgctcatgcaggtctcaatatgttgtggatctcagagctcttcaatattttagtgaaagctatagatgaggctccataggggataaagcacagacacaccttttcagagggcttgtggactctgggcagcctgtccatagacctctgtccccaactggcaagtcaggaaactccagattaaggagccccaatgtggttgaacagccaggtgcacagatgagtcaaccacacagccaggccagggagggccttcactcaagagcctacagccagttcacagccaagccagggctagcgcccaggccacccataaactgatctgagactctgtttccctgtctccatgatgatgggatcaggcttgattgctggtttgtaggcttgttatgaatcaagtcacagggaagaggagctgatgggctggggggacgtcctctggccctcctgtctcttccccagatccactgggcccactcttatctgttctcttctgaaggaagggttttaaggcttcaaaaaaaaatgttttgaaagtccctgccctttccagctcctaccgtctcagccctgggagtgtaaagtgctgcagatagttagtaagtctttgagcaaaactgagaaagccagcctgagccttgacatgggagaaacctccgccatacatctccgaagaaacggccgcgtgtctcaggggagcgcaaacacccgcacccaggaaacaggacagcttctgccactgtcgcccttgggagccgtacgtggcatacaaagaaatcccaggactccgcctgcccacctggccaccctctgtttacaccttccgcgtaaacgcscactgtttacatccaaaactcagacacaaaataaccacctcaagaagataaataatgataagaaataaatgttacgcgaggcaaatttattcacatggggcttcccaggccactttgtggtcagccgggagggacgtttttgccgtcccacgactccaacgggcagccgggctacgcaaacatggaaatcttccaagagcctccctggcccccagggctcagagggtggcagagcggagagcgaaggtggccgcagccttcccggccccacagccagcctggctccagctgggcaggagtgcagagctcagctggaggcggagggggaagtgcycaggaggctgatgacatcaytacccagcccttgaaagatgagctgttcccgccgccactccagctctggcttctgggctccgaggaggggtggggacggtggkgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgggaaaagttcccttccttccggaggggaggtctgacaggcgatggggagaagggttcccagcaggaggaatcgccctgtttgtctgttgtaggtttctcttctctgaatcaaggtgacagacaggcttgtgtgtgtccagtgtgtgagggatttcgtgattggattttcacatactttgagtggacaccttggagtaaggcagcgaggtgtgtgtggtgcagcagggacgggtgctgggtggaggctccagaacctggcttttcacccacagctgtgccactccttggccctgtgtgaccctggacaagctactcaacctctctgagcctcagtttctctgtctgcaaagcagccagctcgctggctccctgggggtggcagggttaaatcagaagcaggcgggggtgggggggtttgtgaatgttggctgatgcgcctccaggaggcaggtggtagtgactacctcagatgggcttagagaccctcttcccacggtcctggctgaccagggcagggggataggatggtgcaggggttccaagcaccggctttgcatccggcccaggttgcagctccagccctgctctcaccctgtgggtgacgtttttgggcgagttattttgtcctgtctcctgagctataaagaagacctggaagttcctctttatgcaaagatagaggtaggctcttgcctgtgaagcaccacgtrtgtcataggcactaaataaatggcagccgtgattcgagttgctgagagtaggtcgtttccgcagcctgggtggaggtgaacagcaggtgttgctgttccaggcaggtcagaatgtgcctcactgagtcacaggccgcctgtggctccccagcctacaggaagtgggagccctggcctgggtgtggggtgatgggggcctccctggccaaccccrcccctaattccatttctgagttggagaagggcttaggtggtgggggaacaggtaagcaaccccagaggacattgcaaagaggccctgcccgaggttctctggagaaaaaactgtgctgcgtccttcgggccctggcagcagcaagagacattccacagttgtgagccccacaagcttggaggaagcatttgctgtttcccctgcttggggtgagagcaggggacagccaagagaaggcgtctttggatgaaaaagaggaagcatgcgtgctgtccccacaggcagcaccccaggcctcatcccagctctccctgcaaccctgcactccaagcctctcactgcactgatgaggaaactgagtctcagagggggaacatgacctcagccagcccttcgctcagtgtccagggaaatgcctcaatctctttgggattccctcccttgcaaacggggaggttcccatggttgggcctgcatgatggatctgaggactttgaaagtggtatttgcctgccggtgggacccaacctggaaatattaggttggtgcaaaagtcatctcggttcttgccattagaagtaatgccaaaaaccgcaatgacttttgcaccaaccgaatagctgtgccacgtggtttttgctaacacagtgactggctcagtaacaagtttggtggctccagaggtaacattagggcggcctcctcacctgtgctgcttgtggtcagggaggggcccacctgggcgcggcggggggagccctgcagatttgcccagtgtcatagcctgtttgagctgctataagaaatactttagactgggtaatttatcaaaaaacagacatttattgctctcggtgctggaggctgggaagcccgagatcaaggcactggcagattgggtgtctggtgaggacctaktcgtcatagatggcaccttctatgcatcctcatatggtggaagggtgaacacgctctcccaggcctcctttaaagaccaccaatcccattcacaaggagggggacctcatgatctaatctccccccagaagtctcaccttttaatrtcaccagcttggagattaagtctcaacaggtgaattttggagggacacaggcatttggatcatagcaccgggggactctggttttcagaatgaaagtaggggccttgtctatccgctcaagctgcctcctctgcactgaaaacgatgcctagcccaacatggatggatcagtgtttgctgaaatgctgaatggttaaatgaataaataaatattgctcatatagcaggcaataaaaaagcatacagaacctatcactaagtgaatgaagctactctgaaaaggcatatgctgtatgatttcaactatatgtgacattctggaaaaaggcaaaactatgaagacagtaaaaaataaaaaaatcagtggttgccaggaattaggggagggaggagagaatgggaggagcccagagacttttagggcagtgaaacttctgtatgacactgtaatggtagaggcatgtcattgtgcgtttgtgcaaacccacagaatgtccatcaccaagagtgaaccctgatgaaaactatggactttgggtgatgatgatgtgtcaacgcaggttcatcaattacaacaaattgactgctcttgtgggggatgtcagtaacgggggaggctacgtatgtgtaggcacaggggatatatggtaagtctccgtactttctgctcaattttgctgtgaatctaaaactgctctttaaaaaaaaaaaggcacacagagcagatctgcatgttgttttgaggattcagaaggcacttaggacaattacggtacctcagggtcatgagtcaaacaatcagacctgccaagacttgacaccccaaatgcatcacttctgacatccattgggtccaggaatcccctgcctcatgaatatccatcttagtgtgcatgcctccaagaatggggagctcactactttgcgaggcagcgcattccatcttaggagagttctactgtttaaaagctcttcctccaactgcccccactgagcaatgggtccactttcatttccttggggtttgtaccattctagtcctattgcttctctctgagctaaatatccacagctactaaatctgccccccttgaaaagtgttaaatcctcaattcctcctctgagctcctctggttttcctggggacctaaggctctgcttccccaaaacacccactccagggttgttttctagaacaaacgtaaggcatgaagtatttctttgactctttcatcacagtgggttctggaagattctggaggctggaaacatatgtgcctccccctccccacacacattccaaaaaagtcatcacagcagaaagcacggtggaacaaacagctctcggttcgaattcaccgtcacttactggccaggaaagttatctgagcctcagtttcttctcctgtacaatggggagcatcattcctatttttgaggaccactaggaggcttacctctgtttgtgctgatgtagtgaaaggggatgtcaggcacactgcaggagctcaggtaccagacggactgtctatggaggcaggagtgagggcctggggcggtcacagaggttgcatttgctttgcagtaaggccatggccgcttaagggtgtcyagaaaaaagccctgtccgacatgcacacactcctgtgtccaggcaatgagcctgtgggcactgacagcaagagtccttctcacgcttctcttcagggctcaaactttagatttactccggcctgtcccatcccattcactgccaacccctctgagcctctctgatctgtgccaccggtgaagggcagtcgtggggcacagagaagtggcccagctgagtgacatctggaaatgagcagtgcctgaggggacgcccgtggggtgttgtgacctgtacagtgccaggctccagcacagccccgtcgcttctgtggttcttatcatggtcatgaggtcgcttctcctcttccctgcgggtttcctaagtggtcacactccagtggcagggtggtctgccggagaaagaccaaaatttgtcatactttagaatcacctggagactggtcacccacgcaggtgcgggggtcctgctctggggactgtgatttgaagtctgggtactattcactgaaatgacagactgcggcaaatctcaatcaatcaaggttcatcgagttgataaacttcaattgacatttatcgagagtttgagggtgcacctgggaaaaacatgagccacagaaaatgtgtgtggcctatgctctccgaagagtcatgagacttagtgttgtaaatcaaagagaaactgactgaagcaggtctcaattatttttgaagtttattttgccaagattaaggatgcacccaggaaagagggacacgaaatcacaggaaacatctctggcccatgcttctttcaaagaagggtcttcactattcaaagggaaaaaagcaggcagtaggggaaagaaggaaaaatcgggggaaggtggccaaaagaggcaagcagttgcacccctttgagccttttcgttaacttcactgaatgcacatttttcatgtgaaagaagcaggtggaggaatcatcaattccgcattcacctggtgctcagtcaatctgcatttttatataagataaaataatcatagggctgggcacggtagctcacaactgtaatcccagcagcttgggaggccaagttgtgtggatcacctgaggtcaagagttcgagaccagcctgtccaacatggtgaaaccctgtctctactaaaaatacaaaaactagccaggcacggtggtgcatgcctgtagtcctagctacttgggaagctgaggcaggagaatcatttgaactcaggaggcagaggttgcagggagctgagatcacaccactgcactccaggctgggtgacagagcaagactctatctcaaaataataataataataataataatmatmatcatcatcatcatcatagcatataggaagctgtcagctatgcactcgtctcaggtgagcagagggatgactttgggttctatcctttgttccatacctgtgaagctaagctgttaatttatatcatgagggtgaaatacaacagagctgcttgaaggcaaagatcctggggcccacaaggaatttcactgtgagcaaaatgtgagggaagtaaatagttatccatttagacacaaaacgggaggcgggttgcatgacccagctcccagctagacttttccctttggcttagtgmgtttggggtctggggattttaattttatttttctttcacagtatttacacatgtccttgaagtggagaaagcatgtaggaagaggaggttaggcagaaggaggcctgatctcatcttgcctttgtcttgcttttrtgctgtacctggggagatcagcaccatcagcgtgactctaacagacttgagtgtgaggagctaggcttggattgcagacctcaagttacaattgatgtgtccttgttttgtggtaagatccacatcttgaaaggtttcacccagcaaagaacaatttgtgggggcagtcatggggagatatccgaggccttttcctttctgtgggggtctggctaatgtctaaggttgtggagtaacagctgtcattaggaataaggatgacaatgttggctgactcagtctccaggcttaactttccctttggcataaagagtttgggggtcccaagatttctgttttcctttacagtactcaaggacttgctaatatctcaggggatttcagccacactttgaaacaagctaccttagcaaatggtctgtcctggacccaaaagccactctcctcaggcccttcctcctagtcccaccagccaaaaaacttggggaccccaaacctgttcttcactctctggcacctgtgctcatgtgcctgctgcctcaggaaaggacagaaaccctccccgatccaagttattagcaaactgcccatctccacaaaaatttaaatggacagattgttaaatgcacacagctcacagccagctccyttcaaggtagatttgggcccaaacatttcgggaagcatcaggctgtgccccgccatccctaccaaacaggaatcctctcgagggaaaagactgggcctttccctcagcccctagcacccactcatgcttggcacctgctgtgctctaagagtgcaggggtcactccctgaccacagagggaggctctctggggttctcccggagcctcggagattgcaccttgtgcatgcgctgctgcacctggggtacatcacccccactctggagcccactggccrgttagcaaagtgagaggtgagagaaggacctcttggtcttctttgaacagaaagatccagaaagcaatggctagaacacaagaacaggtcaggggaggcaggagagggtctgcacacctgctacaggtgtgctcacacgtgggccagggcctgcagatgagggatctgtgctgatcatttgtgatagccaaaagtagwgaaaacctggggggactcctcaaatgaactgtagcacattggggagatggactctgtgaagatgattcctctctccacccacttcccttctccctcctcctcccgctcctcctttttcggaagccaggcacagggattgaatcccaccccattcctcccctgctgtgtgacctagggcaagggatgtggtctctgggatccttcggttccttcagctataaatagtagtagaattgcaaactacctacgaaaactgggaactccctgcgaaggccggtgcattacagggcagtcctactctgaaatactgtgaggctattgaaaagcaaggtgggtcgacagattgttaaatgcaaagaggtgaggacacagccggcggtgcatttagggtgcttctgcaggcgtccttatacrtggatatgtgcacatctgctcctgaaagctcagaagatgtctggaaagcaacaggagacaccagtgagcctggctgtctcttgaggcaacaggcagggacagaatctggagggagacctacccctcactgtattctttttcccactctgaaatgttaccatgaggatgcatatctctttgcaaaaatttaaatataaaaagcaaaacaaacttgaatagaaataaactacttgaaaattttagaaaacactgttacatcaaagagacagatcatcaaaactgaaattatagatatttgagaaacaactaactataagaacactgcttaccaaacttatgggatgcagccaaagccatagtcaggggatgagtcatgcctttaaatttttaaattattaaaccaaaaagattgcaaaaaaaactgttcaattcaataaactagataataatgatccaaaaaagtagaagaaagaaaagaattacaaaaacaaaatgacaagttagaaaggtaaaaagcattaatgtcagtaggccatctaaggatggctctttgaagagcagacaggagaagggcaatcccaggaagtgctatgtgctatgcagagaattagaataagttgatggcagagatcagtgggtggcggctcgcttgggtggtaaagagtagcctgcagccaaagttgggcacagcagtgcagtcttcactgggggaatgcctgggaarcaagatttgcctgggtaggagtttccatcagcacccccagaaaggtctcctttctaccctggcccccagttctttgatgggttttgctgatgctcctgtgtctctgaacagcaggcgcctcacctatagaaaggtaggatagcaggagttaatgccccctcccccattccatggcccctgcctgggattctaccatctctgcttcatatgctttataggagttcggtctgagcccacaacccaaacaggctcacagatgtgctagctatttcgccaccagtatttttttaatagtcaatatttagaaattggcaccaactggcccgattgttcaacagtcctgggttaggttactaggccaattacttgctgagtaacccaggacaggtcactgacctctccgaacctctcctttctcacctgtgtgataaagactactgctgtgccaacacaataggactgtgtatgaaagtacccagactgtgcctagactcaggaagctggtttattccttcctcccctaaccacttactgagagactgctcagggctcccctcagctcagagatctttccccacaaggagctgagagcctggtgggagagacaggcagagacccaagtggttctaacacagctctctgaatctgtaaccccaagtcccatccccagaggacactgggacagtcacactgatggtttgtccctaagcctccagcatcaggagccatgtggcaggatctccactcttcttcttcctgggcctctgtctggaccgacccaaacacacacacacacacacacacacacaygtgtacacacacaagttgcttctttgctgcctgcatgtcctcacaccagcttatgacacacctacaatgtttgatgtgtcattgtgggcaggtttcaagttggaggacctagacctaggtaaagtagagggtctccctaagtaagggagggtgcacagtggagagaaagggtaggggagactgcccagtgccattgacatatgcctgagccccagggcacccttggccccccaaaacaatcacaagtatcccccccgacaaacctgccaagtaggcattgtgtctccacttgacagttgaggaaatggtccctagaggggagacagagctagctagagactgggctggccctggagcctggcctgggtcttcccatcgcatcctgcctccstacataagcaaaggtcgagaggtgggaactcccaaagatgctcaggcagggccaggggagaccagtggggcagggaggggacaggaggggaaggaggagctggggctggagagatgggtaggagcatgagtcccttgcctgggcctccccatggtgggcggtgatccaaaagccccagtcagagccctctgccctgtgacgggggcaccctgcatgtcccctcactccctgccctccagtccccgccagtcctcatgttttccatgaggatgagtacagccgcagggactttccctgcaagtggtctgggccrtatcttccgggagtctgtttggactgtggtgtctgtggctgagggggtggaggtgagggcacccaggcccatcacttgacagaacaatctgtggatttgggggaaagaggaggcgactgtcattcctgagagaggacgggaaccaacaggaaggattcctgagtgccagggatgaccacactggatcctcacaacagccctcctgccggggacaatgctccttatcccacaagcggggacctgggctctgacaggaggccacacacttacagtccctcccttagtgaccggcagagctgggatttgaacacccctggtgagactccctygtccagaccccttcgttgtacagcaggtttgcctcacatgccagagtcggggtggcctcagggcacagccaggagatgtccccaaatccmgaaatgtggtttgagtcccagtccctcatctctccagcctccaagccctcacctatgcaatggtgccttgcccggctcacaggttatgaaaaggggtgagacgagacagtgtcccctaaatacatctgacagcacttttgaatggaaaagagaaaaagaaaatactataagcatccagattgactggaggttggggagttggtgggggcggggacaggcaatccataaagcaagaaaaatcaggctgggttcaggcttttctgcagcagcgaatgcatcagagctgccaggggggcagctgtagacctaagagagttcctttaagcacaaattggctgattatcttttttasgtaaataaacccataattcattccaaacacttggcttatttaaatatttttattgccaaaggaatatatgttcttcacagaaaacttggataccatgacaaacagtaaagaaaacccaaaagcaacctatgatcccatgctcaaagacaaccagcgccagtaataatttggtattttgccttctcaacttttgaactttgttgtatgtacaatttggttacccagctttttgttcccctaacrtgttatcagaaacattctctcatttttggtgaactcttagaagcatccttttttcatgtctgcttgacatttgttgaatggatataagatcatgtatttaaccaactgcctggtcctaaacatttaggttgtttcctgtgacccttcttctgcatgatgaggaacatctctgtgcataaagcttttcctgtccttttgattattttcaaaaatgccaaacaaaaaaaaaaagggagggggttgaaggttctgggttttcttcactgaattatccaaatattaaatgatctagagacaggtttgggagccactaaaccctctcctcctgtctgaccctattcagagaagacattggaagctgccatctgctttcctctcacagtctgtaagtggctcattaaatacttgcaaactagattatttttatgttgtcttggctacaggagtttctgcaggaatcagaaacaggaagaaaaggcaggtccttggagacagaggagctggcatctcatcagatgcaatttcttattaatagtcatccctaacattgattcggcatctactaataatcaatcccttcttacagataaggaaactgagtagcaataatctatcccatcttacagataaggaaactgasactcagagaggttaagggcactgcagtaagcgcagacacagagctatgactcccgttctccctgtgtcagcccctgcgcagtgygagtgggaggtgagccactgttgcgtgccctctgccagacayaggcctgcaggtcagactcacaggrgccaagcagagcatctgggaggattttgtttctggctccaaaaatgaaataccaaggaaagtaggcaagctcatgcatgtcagaatcctcaatctcagctcaggaagtaggaattttccacctttgttagcagcagagatgacaaaccccagggccccacatatagcctgtrccttagtcactgcctcgggccaggttgcaagacccctcctaccaactgagctacaaatcacagttcctggagggtgggcctttatataacagggaacagaactcttctgtacctcscacytccccgcaagaagtaggccaggcatggtagctcatgcctgtaaatgaagcattttggtagaccaaggtaggagggtcacttgaggccaggagttcgagacaagcctgggcaagatcccatctttaaaaaaaaatttaaaaattagtgagctgtggtggcaggagctgtggtcccagctgcttgggaggatgaggtgggaggatcgcttgaacccggtgggtagaggctatggtgagttataattgtaccactgcactccagcctgggcaacagagcaagatcctgtttcaacaaaagaaaaagaagagagaagaggaagaaagaaggaggagaagaggaagaagaaggaggaggaggaggaaggaggaggaaggaggaggaagaggaaggaggaggaggaaggaggaggaggaggaaggaggaggaggaggaggaaggaggaggaggaggaggaggaggaagtaggagaagaagaaggaggaggaggaggaggagatcctacagcactgtttggaggattatgggaaaattaggcccacacatctgatatacaatcggcacatcctacaaatgtaaaatgtgtgtcttgaaccagaaagcccaaggagtgaggggctgtggcattgagtggggtagctatacatagccctagggcttaaatctatagaatttaagtaatcctggtccaaattcaccagaaacattgcctagactttacttgaatacctttagtgacagggaactaactactaccaaaggcaactaactcagctcagcaaacattcagtgatagctgcgcttccccaggaccagagattcagataagcaaacaccctgttctgtgctcaagggactgatggtgtgtgacaatcgagatagtgtgaagaaaaaggacagcatatgtgtgtctctgtgcatgcatgtgcaaacactgacactgcagtatgtattcagaggaagtcactacaatggtgaggcccacctggcaccagaatgaacagatttaagaaagctagtcaccgcagacggtcacagctggaaggattttacaaaataatctatcttatcatcctcctttgccctagagatggggaaactgaggcccaaagagtgaaagccacctgctcaaaggcatattgttgagtctaataataaaaataaccatagcaatagcaacactgagggcagctgtcccagatggacgctggctccatgccagcccctgggctaggcgtctggtggcactacctcatttcactgccataacaactgggtcccccatcttgcagatgaggaagcccargttcagagaggtgaagtggggggctgggggtctatcccagaccttgttgtcacctcctcactctcccagtagcgccagccagagcacctgtcttgggagccccgaggcagggacaggctatgcatccaggaagcycccaggctctaaggaggcggccctataactgctggatgaccaaaaatcaggcagcgatccctaagtcccttctgagccccaggctccagrctcctccaaccaggtctgccttacgcttttgaccacaatcaacccggctctttctcggttcttttcatctctctggtggttttgtatgcagagtcacccaggtccccacttacgagcctgtgagatgggataaatcacttccctttgctgagcctcagttccttcacctgtaaatgggcataacaagttcctccaggacaatcgtgaggctcagggaaaggactgtcgtgcaaacccaccatggcatgagctgtcgagtgcagtgcccgctgccactaaggaatgagtgccactctgggattgtggaaagtgcagasgggcagggttgagatgctcgtgcatgactttggacaggtcacctccctctcagaggtttagtttccttacttgttaagcttggactaaaaatatctaaatggtgagatttttccaacttctttggctctagcatgtctgtggtccttgatggtttacaaagcgcttttgcacttgagacccctaagtgctaattctaccacatccccatccacttcatagtgggatgaccttagccaaggctcttcacctaaacytccataagcccctcgctggaatttgagcctgttttgcttttttaaagtgagggcaatgctactggccccacccatcttacaggacaagggaagcccaaggacatgagagctttctgagctgcatcccaggccctgctctgccactgactcgctgaggctgggtttccccatctgcaaaataaggacatraaaacccatctagagctgggcatggtggctcatgcctgtaatcccagcactttgggagtccagggcaggcagatcacttgaggtcaagagttcgagaccagcctggccaacatggtgaaaccccatctctactaaaaatacaaaatattagccaggtgtggtagctcatgcctgtaatcccagctactaggaaggctgaggcaggataattgcttgaacccaggggacggaggttgcagtgagccaagatcacgccactgcactccagtctgggtgacagagcgagaccccatttcaaaaaaaacaaacaaacgaaccaaaacaaataaaaacccatctagagtgttgtggggattaaatgagttaatatctgtgaagtgctttgaacagagctggcacggccgggcacggtggctcacgcctataatcacagcgctttgggaggccaaggcagggatcacttgagcctaggagttcaagaccagcctgaccaacatggcaagaccctgtctctactaaaaatacaaaaattagcagggcgtggtagcatgctgctgtaatcccagctactcagaaggctgaggcaggagaatcgcttgaacccaggaggcggaagatgcagtgagccaagattgcgccattgcactccagcctaggtgacagagcgagactctgcctcaaaaaacaagaaccaaaaaccccttaagagaaatggggttttctcttatgagaaaaataaatatccccggtgtttcctctgacttgcccagggctgcacagctcacaggggaggggtggggaccgggacctggcacttggctcctgctgctctgccctatgcccttggggacttctggacaagggtgggcttctctgggctgacagaggagacagaggcaatggtgtgctggtaaatggttaacaactggctctctggaaaaaaatgccctaactgtagcaaaaaaaaaaaagagactagaactggcacattgcagatgatataggcatttgctgtcactatcagcatcagcatcattacttgtcctttcaacaaatatttcctgagcccctgtcgtaggccaggcccagtgctaagaggtggggacacagtggagggaagacagaaagttaagtgtgctgtttccataaagtgtgctgacagccatataggagcactggggctggggtgtctctacggtgcctgggagggtctcctagagaaggtgacatcaagcaggttctgaaggatgagtaggagttggaaggagttggaagagctcctgccctttgtggagcaggagagggaggtggtccagggacctttctggccgaccaascctagagccaattgcagtgagccattgtgacattggacttgaaactggtcactgcgagagtatttataccatagaaatttgcaaatgctacggttagggcatttttttccagaaagcccgttgttaaccatttaccagcaccccactacctctgtctcctctgtcagcccagggaagcgcacccttgtccagaagtccccaagggcatagggcagagcarcaggagcccaagtaccaggtcccagcccccacccctcccctgagagttgtgtggtcctgggcaagtcagaggaaatgccgggggtatttattttaaaaagtgtctatcaggactctacattatgccaggggtctcaaaggtgaaagaggcatgagtttgtccctcaagcagctcaggaggagctggaggaggtttcctaggcacgagcttatccacaccatgacacatagaccctgaagtgttttaaatcaattacaaaaagcaaaaatacaaggaagctgacagatctttactttgggagaagtggaggcttgggaacaaatgagatcatcaaggtctttttgtccgttttctaaggagttggggtcattggctgagatcctgcagatctggaggtaccaacatgagactccgagggccacctcctctgcccctccctccccaccccctttaaggccctctctggaatccatcccttttcctccatctccccagacctggctgaggcctccgttgtgcctctggtctggtgcctcagccccctcgcttcctgcttccagattttgccaactgccccccacctttgaccatgtccaggcatcctggctcaaaagccaagatgagatctatacttgagagcgtatatgagagggatgcaactgaggctacctggagtgcgtggacacagccatggcctcaggtcatcatctcccccacgaagcctcccacacctcctgtccccawcttgggcacacttcccaccacctgggagacccctgagggcaggcaccatctgtccttcaccactatatccccctataaagagagataatgcagtgaggtgccggggttcaaatcccaactccacccatcaccagctgtgtgactctggacaagccacctctgtgtgactctggacaagtcacctcactgctctattcctccaatttttataaaattgggatagtaccagtgcctgcatctaaaataggtgtggattacatgaattatttcatggaaagtgcttagaacattgcttggcattcatagtaagcctccaaaaactgaagctattattattccctggttgctggcccagactaagcactcataaatttgttgaatgaatgcaatgtaaacagggaaatgctctgtaaatgctggtgcaagctcatcagcttcgttgtcgtcatcagcattgtcctgatgctattcatggtgggtgtcctgtctggagccctgctggctgtagaccaccaatgtgggcacagtcctagcccctcgctcaagtagggtatgcgaggactcaggagacgtcaacagacattcacagtatttacactgggaccttggaaccagtgtggttgagtagacacccggaggacagagttctgagtttatttgggaggggttgccggggagagtcagctgtctggaaaggcttcctggaggaggaagatttgctagaggtgcttgagtggttggtgcaagggggcttgtggggaaccagagcgtcctggtgtttagagcagcaaggaagaggctgggtaaggacaaaggacaytgggacagacagaaagcctgactctagaaagaaggggccaaggtcactggagaggagagagaggaaggattaaggacgattgagtgggtcataggggttgagggctctgtgtagggaaaacagtttcccactcaatcctttcgatgccactgtgattaaatgtgtgggtttatttcctcagaaattgtcttacaattccgttcagttctgacattatctgcccggaggcagcacaggataagagctcagtcccacaagactgccgccacttcagaacccatcgcaagtctcaagtggcctgcacttctgaccaaccagctgtaaggcagggttcccacaaccccctccacgggttcagtaatttgctaggatggctcacagcatcagggaaacatttacttacattactgacttataataaaagacaccactcagccacagccaggtggaagagaggcacagacccacacgtggggcaggggcctggagcttcggtgctgtctctgggggcaccaccagctcagcacctccctgcgttcaccaactcggaagctctcccaatcctgtcttttagggattttgatggagrcttcatcatataggcatgatggataataaattcaatctccagcccctcttcccttcctggaggatgtggggtgaaagttccaagctttgtatcatggtctggtcattctgatgacagcccccatcctgagcctatccagccaccaccaagagccacctcattagaacaaaagatgtgcctatcatctagaaatgtcaagggagttaggagctccgtgtcaggaactggtgtcaaagaccaaatatgtatttcctaatatatcacgatatcacaggttgtgagaagaatgcmatcaatggtcaaactccagagctgcacactctccaatatggcagtgaccagccacatgcagtcaccaagcacttgaaaggtggctgcttcaaactggtatgctaagtgtaaatacacactagattttgaagagttagcaggaaaaaataataatataaaataactcaatgactttttgtattgattacatattaaaataatgttttggatatatttgattatatctcatatataaccaaaattgatttcacctgtgtctttttactttttttaatgtggctactagaaaatttgaagttacttctgtggctaactttatagttctattggacatcaccgaccgctctaggctatggaaaattctgtagaacaaacaactggaagttggaagaaaagacagtaagaaatagcaaggaagggtgtgctgttgggagttgcttggaggttggcggcacagggctgaaggctagcaaaccgagcgatcatgtcacacaaacaaattcactattcggacagatacgacgacgaggagtttgagtatcgacatgtcatgctgcccaaggacatagccaagctggtccctaaaacccatttgatgtctgaatctgaatggaggaatcttggcgttcagcagagtcagggatgggtccataatatgatccatgaatcagaacctcacatcttgctgttccggcgcccaccacccaagaagccaaagaaatgaagctggcgagctacttttcagactcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccakatgagtgctctgtggacccacagcctcagctgagtgtgaccctaggaggcacaatgtgctctgtatccagaacacacttggcagatggaggaagcatctgagtttgagaccatggctgttacagggatcatgtcaacttgctgtttttgttttttcctgcctggtgttgtatgtaaggtcacttgtggatttatgtttcagcgtactggaaactttccattttattcaagaaatctgttcatgttaaaagccttgattaacaaggaagtttttataatctaaaaaaaaaaaagaaatagcagggaaggctgtaggtgaaaagaaacttaagagacctatcaaacaacccaatgtgtaaagtcatttgcattctgattcaagaaaaccagctgtgaagaaagtagcgtgaaattcatatgattgaaagttgtaatacttcctggatagttgatgccatttaggaattattgtcagtttcttcgagatgtgataatggttgtctagttatgctttctgaaataagagtccttagcttttagagaagaatagtgaaatatttacagatgaaatgacagacatgcaggatttactgcaaatattacaggaggggtarggtaggtttgggcatagagaaaaagattggctgcgagttggtaattactgaagctgggtgaagtatgtggagtttcattatgctagtctatctacttgtgggtatattccaaattttccataataaaaagttaaaaagcaaaaaaaagaaccatcatctccacctgaggttctggcccagactgcttatgttcaaatctcaactctagtcttgctagctgtgcctctgtttgctcgtctgcaaaatggggatgataatattagtccctacattgcaggggtttctctgtaatgtgcttaaaaatatggaaacaatataaatgaaatgaagatatgttgcaggcactttgcacattgtcacggtgctcccagtgccttgttccagggaggttatccttatttaccaagaggttaagtcacctgccctaggtcttccagtcagtggaggcaaagccaagacatgtcccgagttcatctgacttctgagttcaggcatgacctgaatgttcttgcctcgggctcagggctcaacatttcctgtcttctctgcttctccagtcctgagagattctgggcccgtttccctgcagatcagctctaaggaacatgcttctctcctgctcctttctagaaaaggcgtaacattggcagaaccaggaactctggaattctgaaggttgactccctcaattccaaggggctccacctcctgagcggaattggatagaagacaaaggtcacatggctagggtgaggctttgagatgggcgagactgtgagcaggactgacaggtcagggccaggacccaggatcttcagaagccacagggagcaaggcagggagcagcctcctttgtgccacacccagtgaaggggaacttgctaagacagatttgttcctcccatctccagaagagccgttggatgccaatgggtgaggagctgaacctctgcagactcagtgtgctgatcccattgcctctgcttgcatgcctctcaggatggggagttcactgcatccccctctttaaagacattacggttgtacaaaggtctccagaatcatctattacatcccctcattctyccaatgaggaaattaaagctcagagatgccgaggcatttacccaagggcacacctggtcctgggcctacgacccttagacaatattccttccacctctttgctatagagtctcagactagggatcttggctggctgagaaatcagggaaggcttcttagaggaggtgagattggaggtggcccttgtagggtggcactaagatgtcgcttgatatcctaattttttttttggccctgcccaccatgtgtgtgcctgtgctgccatgtcacactaagcagagtaaaatgaaggaaggaacggatgaaaggggcaggaaagcgactcccaggagctgaaagggcaatagtataggtcccttcagcacctaggatatgttgtgggaagcccttagaccccagatactaccctgtgcagatagggataaaactccacctgtcccagctcagtgctctccccggctcctctggcctgcttgctgggcagggcccaaaccagttcaggattcctttttctctgtgacctaccagttagggttctctgtttactgtgtctcctcctccttgttttgtatacccagctgggtgggaagaaggtcacagcccaggtttgcacgtggtggaggagcagggccagtaactggttaggcagagaccccgcccaccaccctccactcccaccctagcagggcctgtgccatccccaggacaccggagaccaccagggggctggagaggctgcgggagaaacagccttcctggacacacccagctacggctcacttcccagcctgagctgttccttaggaattgcttttctgggaaacacaccctcttccagacctgcagccttcctttctatgtggtttttggttttgctctctggtgagggtttctattttttcctggtatacatgaatggcatgcaggaaagtggaatgaggacatcatgaccaccatgcaaaggccattgctcttaaggtttgatgtaagctccccactctccacccccactacccctctgcctcggcctgggktatgaggtcttggttttgacaatcagacaatgttagcacactgctgtgtcttccacctgcaatgragcactgtaggacgattttaaaaagcaaagtggcaggccaggtgcggtgactcaagcctgtaatcccagcactttgggaggctgaggcgggcggattacctgaggtcgggagttcgagaccagcctgaccaacatggagaaacccccgtctctactaaaaatacaaaattagctgggcgtagtggtgcatgcctgtaatcccagctacctgggaggctgaggcaggagaattgcttgaacctgggaggcagaggttgcagtgagccgagatcgtgccattgcactccagcctgggcaacaaaagtgagacttggtctcaaaaaaaaaaaaattacaaagtggctgaataccaagatcctaggaactaggttcagccaaactggctgtgtgtcctggtagaatgcccaccctctgtctctgggcctccatgcccatctctgtagcatgagggattctgatgaaataatttccaagagcccttcccacactaatactccaggattctgtaaggttaatttggcaagaattccaacggcrgaagaaagatggagggaggaatatgtccagtctaataaccctatgctcaagtcagaaagcccctcgggcagtgtccgagagggctacagccctggccccagaacctgagtccctctaacctgggtcaaacccctaaaagccactccagcaagagacaggcaaagcccgggctcttgctccaggctggcattgccttgccgtgtggctgtagacatcgtttcacctctcgaggcctcagttttcccttctgcaaaagacaggctgggggaggttgggcattttcttcttaactaccaggagtctttcctccaataaaattgtgatggaaaccggatgtcacacaaagggaaaggaaacactggcatttctggagtgtttgaagcatgtgaagtattgtttaagggctttgcaatcattaatgtactttgtgctcacattaaccccacaaagtaggtgctattattatccccatttgacacatgaagaaactgaggccctgaggagttaagccacttgtccaaggtaaagagtgggagctgggcttctgatagggagtgggcctcagtcatgaaaccacaagacttgtgtagttccaaccccctggggacatctccaggcacttgacccatgctcttccaacattcatgtatgcacgcacacgtgtacacacacgtgcacacacaaacacacacatgtgtgcacaaacacatgcatgcacacacaaacacatgcatgcacacacaaacacacacacatatatacacacaccaacacaaacacamatgtgcacaaacacacgtgtgcacacaaacacacacatgcacacacacacacaaatgcacacacatgcgtgcacactgtggctactcctctgtagcctgctggccacactcggctcaagccccaaatcaaaggtgactagcaagattgcgagacagatttctggagatgggaaactgcgtcatcaaattgtctcagggayggaacacccatcagagccctgggggagagaagagacacggggtggctgccaattttgctgacctatgctgctgactttccagcagcccccgactcctgtggccagctgagcccaggtccaagctgccccctgcacagggcttgttccctggagggctataagccacagcatcccctccaagacagccagtcctgtgaacctgctcaatccctcactattccttggggcctgccctgggagaagggagagttccctggaccccttcttgggacttgcggtgacaggggtgtggctcacttgctcaaatcccttgtgtgaggggaagcatgcaagcaagtgggtgctggggccggggcaagcgcttttgggctctggccctacagtaccgtctagggttgtgttacaattaatgctcttttagmagttgccattcactgatggctaagtgttaaccaactcagtggagagtgagggtgacagccttttacaccytgccctcttggtacctgggtccttgtctggcatccaggaagaatcaggtcacacggacttgaaggatggtgaatgcagaggttttattgagtgatggaggtggctcttagtcgggtggggagctggaaaggggatggagtgggaaggtactcttccagatggctgaactcttctccaactgtccagctgcctcttccacattcagacacttcttctcttctctccttctctgccatgctgctctgctcctctgccagtggagtttggggtttttatgggtatrggatggggggcatggtgggccagggtggttttggcaaaagcaacactcaggtgggaaaacaggaatgtgaagttctcatttagggccgtgggcccaggcttgtgggtggggcttttgccagagagctgtcctcctctacccagtatttccctgcctcctgtccatatcacctgcaccaagaacctcactgggtgggagccaatccagagccagagaaaggacttgacacttggcctcaggcagacccaggcttgaatcctggccctgcctctgatgagcagggtgacctgaactgtctcaggttgcctcgctgactctgctttcccatctggaacatgggaatagcaatgcatcagccactcagtgcagtgttgaggctggaacaggtggggcacactgtgagctccatttccttttgcctccacccagcaattatgtctgctggggagaagaggagaaataaggatcacaccctgccctctatcagtcagtcaacgaccatttattaaacacctactaggtgtcaggcacttgacagagaaatgaaataacaacacaagcaactcttatagctataccctataataaatgttatagaagcaggaggcaggtagaggtggaagagaaccttctgcttgcagggggatatcagtcagagaaacagaaccaataggagacacagattaagagatgtattgcaaggaactggcttatgtgattgtagggatgactaggcaagtcagaagtcgcttgggaatgccagaacactcagccttggaccgaagctcctgcccgcaagctgaatttcttcttcttccaggaaacctcagatctgctctaagtcctttcaactgattgactcaggcccatgcagggagttgaggacaagcttccttagtgaaagccagctggctgtgggctgtcaccacacagacaaactgcttcaccccaacaccaagattagcttgaaatggaataactggggcctgtcatccagccaggtggacccacagactcaccgcagcagagcacctagaggcggccacggagggttagtgacagagcagaatcaggcagggcacccgggcagggggcagacccagcaaaggctcctagggcagattgtagaagaggtccttggagatcagggagtacagcaacgtggctgtggcactattaaattaaattaaattaaattgaaaataaaattaaattaaaaaggattggtggctcacgcctgtaatcccagcactttgggaggccgaggcaggtggatcatgaggtcaggagatcaagaccatcctggctaacacggtgaaaccctgtctcttctaaaaatacaaaaaaaaaaaattagccaggtgtggtggcgggcgcctgtagtaccaactactcgggaggctgaggcaggagaatggcgtgaacccgggaggcagagcttgcagtgagccgagatcatgccactgcactccagcctgggctacagagcgagactccgtctcaacaaaaaaaaaaaattaaaaaggattggaataaaggaatggtttagtaaacaaaaataaacaaatgcaatgccttttttgaaggcgtcattactacagccatgatggagcaacacggataaattcccatgacaggaggtttcatgtaaaaccacggtgacagaacacagttggatgtggcatacataaacagctgtgcccagggatggaactctgggagattttcccattagttttaaatgctctttcatgtagttattcttttatttttatgtttttgagacggagtctcgctctgtcgcccaggctggagtgcaacggtgcgatctcggctcactgcaacctctgcctcctgggttcaagtgattctcccgcctcagccccccaagtagctgggattataggcgcccgccaccacacccagctaatttttatatttttagtagagacggggcttaatattagttttaaatgctctttgctgtagttttttttttttttgagatggagtctcgctccgtcacctaggttggagtgcaacggtgggatctcagctcactgcaacctctgcctcccggttcaagcgattctcctgcctcagccccccaagtagctgggattataggcacccaccatcatgcccagctaatttttgtatttttgtagaagtgaggtttcaccatgttggccaggcttgtcttgaacttctgacctcaggtgatccacctgccttggcctcccaaagtgctgggattacaggcgtgagccacagcacccagcctagttatttatttatttattttttttttaaagagagagatgttattttttttaaggggaatgagtggtattaggatgtcaaatgaaattgcttatttaataaaactgaaaagcccagtttggggaaagaaacaaaacacactgagcagaataatctaaccacagtgaacaggaaaaaaagccaagaataaaataagttccggggtatccaagggtgagcaaagccaggccggcaggcctcctcctcccttgcagaaagcaggatggatgaggggctctgcttctccaggctccctcatgtccccactgaaagtgtttccagaacattccaggcccataaagtgtccaaatgctggaaggacttacatgtatatgtctgggattgaatcaaatcttctgactcaattctctttgggagttctgagaatggaggtcacttcccagaaccccgtcttccccctacagacagctttggccttcttttcagggaagaaaagaaaagggactcttggaaaccctgctgagggccacgcagctctggttgttgaggctcatatggtttatgaggcgccatcacccccttccgccaccccctgcctgctgtggcctgaggcttaccttcgtgactgccctaaaaacagcatccagactcagtaaccacgtcaatcagcttttagaggaaaacatttattctggggaggtgtcagggaaaggattcaggagatcttggttctttctagctctggccttgacatcgacttgctgggtggtctgaaggatttcacttatttacagagcgaatattgttcaagagtttgggatgtgcaaaactcagctgcaggcgtgatgcagggtgggaagatgagcaaggcagggtcctcctctccaagtacagcgaatatggtgggacagatgcacatgcactttatgcacgcatgcacgcacaccatgtgctcagctgccactgagaggagataggagatgcagagggagagggagaacagccgccctctgactaaggatggagcccagctgtctcaagagctctcctggatggacagactggtggcgtcccagcaaaatcccccatctctccatccggctgtgtaatgaatgactggaaacctcagctggcctgtgagcaggagatctggccaggtggaagggaatccctgacaccccacagcccctggtgtagctaaagcagacgggcctcctgggctggtgcaggaagaacagcttatgttctcgaacacattgaccacgtgctccatgcatctgacacacacggactcgtctactccacacagcaccctaggagatggggctgtttaaaataccaatccccactgtatagttgaaaaaaacgaggtgcaatgaggttaaataacgagctctagagaggaggactcaattcacagtcagcttccagagcccatcggcctaaccgccaggctggcttcccgtccgtaatgcacgtttccagctagaggctttcaggctgtgtttcccacacttagccattgacattcacgttcacagtttttgccacatccatgtcacctgtacaaccatttctttagtagtgacttacttttgaactgcaacttcatgtcaccaatttaaatggaaaatgagtatcacttatcataaaaaagatgataactgtacaaaataaaagcaatagaatgtgaacaatgctattagagcctgggtagattcggggaccagccaaggctctgaacctgctcagtctgttgaaaaaggagattacgcacatagaaaggcgttgaagtgcacggacaccacgctgagacgttcttgttggcctaatcaggaggaacgactagattattcaattcaaggttgtttaccaggccaaactacttcccttgctgggaaatgcttcccagctctaacgtgcagtcagaaaatacgggacacaagttgacatccgaaggaaaaatatcttttccttctccacttccgagttcttggttgggggccctgaaacaaaaaacagatgaacaagagaaaagtgaacaaattaatttaatgtaagtttaatgtgacatgggaaccttcataaggaaatgaagtgattaagcctgagtgcctttttgtttttttgagacagagtctcgctctatagcccaggctggagtgcagtggtgcgatacggctcactgcagcctcgatcaccccgggctcagctgatcctcccacctcagcctcccaggtagttaggaccaggactacaggtgtgtgccaccacgcccacctaattttttggtactttttgtagacacagtctcggctgtgttggccaggctggtctcccactcctgggctcaagcgatccgcctgcctcagcctcccaaagtgctggggtcacaggcatgaaccactgtgaccggcctgagtgtttccattagatgtcatgaacagtggagaatcatggggctgtggtgggaccagggggcacgagcgaagtacagagaactggagaaacagcaaggcctgtcggggctcctctcagtgtccccagtgctcggagtggacggtgcccctttcctctggctgtggagtctggtgtcctgcttcagggaacaatcacatagtccttctgcgcctgctgtttcttggattctttccacttaaaatattcaacatgcgaagctgccacattttggggtagcgtgccctgaatcattggctacaaggtcgcgggccccacatgaggcacagttggcccttgagacagtgacactatgtatttcgtggaggccactgcttcaaaggccctaaggtgtggattcctgggaaaccaaaacaggctgtctccaaggctcaagtggaattgatttctaacagcccaggcccacggtgtctgtgcgagtaaatgaagaaagtgtttttacagtaagtcttcttggatagaattctgagggagagagagaatgagtgaatcagaatgttggatgttccctctaaggcatctgtttaaaaaatcaggggaaaaacccaggagcagagtcatcacctgtccccagctctgaggatctgtgtctgtgaggcacatgagtccaccctcctagctctgtagacaaggaaactgtggtccagagagatggagatcccacagacaacggcccacctggagcaccccctccccgcctgactttatattcccaggatgcattcatcagggtctcagtaaaaaaaagagggcacattccaattgggtaataggaagaggatgttaatgaagcgtttctttacagtgctgtaggcagcatattggggttctgcgaagagcaggcagcaccctgggtgcctcagggctggtacggcaaagcctcagcaccctccctacctccttcccccctcgcgatcaggcccctgataaaagcagtgaactctgctccaggcctggccagcataaaggcccccaagagaggagccaacaacaccccatcctccctctcaccctccctcaggctcctgctggggctcccactggccaaacccaaagagaagccggaaggcaaagagctccgtggtacccatcagggctcccaagcaggggccacagaggagaagccaggaggtgacctggagcaggacacagcagctccctgacagggatcctcacccagggcacgcctctagtagcagatggagaaaacaactcagtagacttcagactcccaaattctcccagttccttaacccgcctgccctctggacttcgggagaaagttgagagggaaagccctcaactttgttttgaaaatgagagcaatgtttacagccactagcaagcaattaggatccagctgggctgatgtggccagatctggggacacccagccaggtagatgcacaacagacccataatggaggccagcgaggaaacgctggacacgtcccccatgactgagctgtgaggacctgacttatctgtgcggcggtcactgtcgtgtagaaatggaagctgtacatgcaggctgaggcttctcagctggacagttcagcccgagtgagccccaagaggacaggggaggctggtcttcattcttcccctctgaatcaccagcaaatgatagaccgtcaataatttgttaaatgctttttaaaatgaatgctttaagccgggtgcagtggctcacatctgtaatcccagcactttgggaggccgaggcgggtggattgtttgaggtcaggagttcgagaccaacctggccaacatggcaaaacctcatctctaccaaaaatacaaaaattagccaggcatggtggcaggcacctgtgatcccagctactcaggaggctgagacaggagaatcgcttgaacccgggaggcagaggttgcagtgagccaagattacgccattgtactccagcctgggtgacagagagagactccgtctcaaaaaaaaaaaaaaaaaaaaaaaaattacgcttcaaacacatgatctctcaccactgttgaattttctttctatgagcccaggagggcctctcagagaggaaagctcctaggtcttcctttccctctgcaaactccctgccttgaaggatcagaaggactgtgctgstcgttgcatcctttgcaagttccaaaccctgatcccagctgtgcttaggggttcctgcaaaycttttccaggtgttaattacctcccacttcatttcctgtttaccaactcagctttttgttttagtgtgtttgaattccctgaactgaccgttgtctgatctccacctcccaactgaattaggggagctgggcttctggaaacccaggtgccgggtgttgcagagtggctgaaagctgggatgtggcagatccgtggctacattcatgcacacacacacacccacatacccacacatgcacacacacacacacacctgcactcacacacttgcacatgcatagaccacagctttccacacccttcctagacaggggtcacttggtrtcctggagagagtgtgaagtctggaakggaaagaggggggattaagccccacctctagccatgggactgagacaagtcacccccacccatctgcgccttgtttcctcctctgtgaggcaagcacagagcccatgcctccctccctggatgggagtgatgtgaaacttgaagaggggtagagayaagggtcgtcaatggaagccccttgggcaaaaaggccctttcaactaggggcacagaggaggccctgggctgagaacttgacagcaccttgtattggtaaccagccggagggactggaaatactcagatgtgtctgtctcccttattaggttcaaagtccctcragaccctgtctccatcacagtgctccagtccagacccctcctctgagctccagaccctgctggacccaacagccatccccatccccacctgcctggaattctccaaagaacctcccctttaacagttccagcctttaacagttccagtctaaacacatgacctttctcctctaaatcagccccccatctctgcctttgcaggagatggaagccatgacacctgcctcgcccctgtcctcaccccatccatgtccaatcaagcactaggcatgtcaggtttaccctctaaactcctctggaatccagtctctcagtctccatcatcccaggtcgaagctaatgggctaactggtccttgcttccactctacccccactgcagtcctgacttcctgagcagcagccagggcctaatccatattcacaccaagcgccttcctgactgagatatcctcctgcaccatcatccctccaccctgtttagttctgctcaccctcagtgttctcatcaataatccactcgccctcacaggcgcgtttgggaccccatgttctatgctctcacaggaccttttgcttgatttttcactgtaytyaggtcagtttgcagttattaagtgactgagcaatgtctggcttctccagtagactgtcagctcctagccattgtatccytagcaccgctgtgtgggagcacttcacaaacgtccattgagtcagggactcagcagtctccatttcycctccctgctggagaatgmgtgtattttgcaatccccagcccctgtgccatctaaccrtcttttcttctctgttcagcccaggtgtggcctcactcacatcccactctgagtccaaatgttctctccctggaagatatcaatgtttctgtctgttygtgaggactccgtgcccaccacggcctctttcaggtgagtcaaagggattcctcagttcactagttagrggaggtgggcagacaccctggagaactccctggaaagctcaactctcatgccccggacaacagttgaaggaaccagtgatgttaagcccaaagacaaaacctctcaggtgtccaagtccctgtaggcctgttgggagcagagggaatgttctgcggaactagaggaagaggggctcagggagaagaagggcacattcctggttgtcatatgtgatctatcccagatgaacttggaagtgaarggaagagagttaaacattaaagtaaatacccagtggatcagacagcaatgtgccagattgccttggagacaaaatatctccaacacatggctgacatttggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaattwataagcagcatctggtgctatactttggtctctagtgagttagctcatgaaagatgayagactctccaagccaggggtaygcaggaaatgggttttctgtagctacagaaatggggttgagggttggaccaaggsgactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactytcaaggtggcaagttggttccccccatgtggctgcttgagtatcctcacatggcggctcacatccttccaagtaagcaatgcaaaaggccaagaaagatgctgcaaagcatgttatgacctagcctcagaaatcacacaccatccctgccaccattagtaagaagtccagcccacrtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctccygtccaacatctagtgtcactttccagaacataccaacagcttccccagttctgtgcctctgctmaggctgttccccctgcctggtccacttgtcctccttcttgtccsktcaaaatgcttcttatccttcaagacccagctctagagtcacctccarccccttacccaccagccycctctccaagtctgtgtcccacaasccccctgctccctccagggcmccctccaccctctgggccacagttgtcaggagtcaggcagggcaggggccrggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtatctctcccgtgactcgtagttcagctcttcctccatgagcctgactatcagtggaccttccagaaagagccccttttccttctctcacccacagcacagggcactgggaaaatgcccaatgagtcctgccctctgggttgtgctttggacttttcagtgtgtcttcgcatccactcttcarcttgaatgttgcaacagccatgaaaaaagaaatgcaaagcgattcaggatgagagcaataccctactccaaagaaggcaaaatagaagctcagagaggtcaagcawtttkcccaagaccacacagctaggagtggaactcatggctgtccaagccccacgcctctgctgaaggtagagatgaattacagcaacaagtctagaaaggtgcctgccctatggtctgtgagtcttgcctaagaatgaaagaggagccagtgggttaaagatgaggtcaccaacaaacggtggtgttggagtttaccactggttattttaatgggtttgcaagaattgttaattactaatgtttattgagcctagtgcagtgcttggggyattttgcacattgtctctgatccctatcacaaccctgagaggtagtttttttaactcccattttacaggtgaggtcattgtggttcaaggacgttaagtaacttccccagcrtcacacggcttataagtaaggcagccaggatgtgaacccagtaggactatctggctgcaaagtccccaccctccctcgccatctgtatcctccaatcaycttcagtgctttgctgatagaaggtacggaaatacgatgccacagactgtcsaggaagacagaaactaggcagatgggctggccatggtctccaagccagactggaatctccaggtctggaatgatatcatttttctcttttaataaattaactcacccaccacacggctttgagaggctcaaagktgaccaactcccttgggagggccccggttgataaggaaggaaygtgaatcctcccatcacggaagcttcaaggaggtcaagggtccaacacttgagattgttagtgctgttggtggatactggccaaggaaatatcccagtggagcctcgagatgargaacatgaggcccccgtttagatccaaggatcagagggggctctgtaagacccaggggagtcaggtgcactggagcgcgggctgcagaaaacagcctgagctccacctcggcttctccttgycctggctggttgtccttaacccctgtctccttctggaccagtttttgtccttcccttgtgaccctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacrgagaggagggccacggtgctagtcctggttgtgctgctgctattcatcatctgctggctgcccttccagatcagcaccttcctggatacgctgcatcgcctcggcatcctctccagctgccaggacgagcgcatcatcgaygtaatcacacagatcgcctccttcatggcctacagcaacagctgcctcaacccactggtgtacgtgatcgtgggcaagcgcttccgaaagaagtcttgggaggtgtaccagggagtgtgccagaaagrgggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaacygccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacractgggcactgccaccaccagaaagctgttcgacgagacggtcgagcagggtgctgtgggtgatatggacagcagaagggggagaccaaggttccagctcaaccaataactattgcacaaccayctgtccctgcctcagttccctcttctgtaacatgaagtcgttgtgaggrttaaargcagtaacaggtataaagtacttagaaaagcaaagggtgctacgtacatgtgaggcatcwttacgcagacgtaactgggatatgtttactataaggaaaagacactgagktctagaaatagctccrtggagcagaatcagtattgggagccggtggcggtgtgaagcaccagtgtctggcacacagtaggtgctcattggctcccttccacctgtcattcccaccaccctgaggccccaaccrccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatgrcaatggtgttcaccatcggcagtgccagggcagcactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctagaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtsaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcatagctctagcatttgttacaactcccgaaacccccgagtttggtccctggggtaccgccttgcacactcagaagcctttgggaaggggtgctattcatttctgctcaatctgttaacaggcttctggcatgtagatcagtggtctccaagcttttgtgattgtatattcctataggaaaaaaagaattgattatgcatacccrgtatgtatacttattaatctgtatgaagatgtacattctaaaatataatcaaccagtagaaatttaagaaagaagatgtaaaaaaaaaaaatattaacagtgcttgaatatttccttccatcttacatttctgcagggataactcattaccaagttcccactacatgaatgtgagaccctcatgaggcctagaatcataggcgcagcagcgattcaatcatttattcatgcaatatagacttactgagtgcctaccacttgacttcccttcaaatcaggagtatcttctacaatatcctgatgaaaagccacttgtttcatactcccagtgatggggaattcattatccatgccactttgggatcccttcattattcatgtattcattccttcactcatttattaaacaaaacttgcctagtctgtctccataaatgcccctcctccatccatgcatccatccatccatgccaggaacctggggctcatcgctcaacgtaccctctccttcatctgttccatctggtgggtcagcacctcttttatttttttctaacttttattttgagttcaggggtacacgtgcaggtttgttacatagataaacttgggtcatgggggtttgttgtacagattatttcatcacccaagcattaagcctactacccattagttatttttcctgctcctctccctcctcccaacccccaccctccactagacctcagtgtctgttgttcccttctttgtgtccatgtgttctcaccatttagctcccacttacaaatgagaacatgtggtatttggttttctgttcttgggttagttcgctaagaataatggcctccagctccatccatgtccccgcagaggacatgatctcattcttttttatggctgcatagtgttccatggttgtatatgtaccgcattttctttatccagtctataattgatgggcacttacattgactccatgcctttgccattgtgaatagtgctgcagtgagcactcatgtgcatgtgtatttatgatagaatgatttatattcctttgggtatatacccagtaataggatcagcacctcttttagattctactcactaagtgtttcctaaatctatgtttccttctatgtccaaccatcgtctgtcatgggtgcctccaatactaactactaccatctcccaattcttattcttcactctgcagccaacatggtcttttaagaatgcaaatacattcatggggaggctataaacatagagaactgtgttcaggagccaagactttaggattaggtagacctggattccacttgtggttcagccttgggctcttatttgctgtgtagtcttgggtacctcagttatcctttctgagtcaacatttccttgtctgcaaaatggggataataatggtatctacctcataaaattgttaataggattaatgtatgaaagcatctagcacagtgcctggtacatagttggcactgaacatgtactagctttgatgatgatgatgatgatgatgatgatgatgtggtggtggtgttggcagtgagtgtgatgggggcatcctccaagggaaacccttccatagtgtcccacccctcttgcgataaggttctacagctgtaacatggcttgcaagacccttcatgatctggtccctgtcttgtctctatgtctccctctctctgctccaggctcattctctaccctccagccatttggacacaagaacctagacagatcccagaagatatttcattctgcctccagtgcccactcttcccacccagactgcaccccctcactaagtgccctgaacttggaggaagttgtccacaagtgcccaagggagctcactcctccagggaattttgttcacagatgcctgcattactcaagggagtctgcaatccaggggaaaccacatgcctggaaacctgagcagggctcttagcaggcaaaaaaagaaaaaaaaaatgctgggagagcctccccagcgaggcaacaggagcagcccctcaactcctgaccctctctggctccagcaagctggygcaatgagaagaagtccaggtgggctcaggagaccaggcaaggggcctagctcctgagtcttccctggccacagaggggtgagaataggatgcagagatgcaaactggacaccagatgacctcatgggaattcatgctagtgctggagcctcttgagcacagccttcatgactcagagggggagtgtctccattgtgtagatcccagccatgtgctgcattatctccttgttacccaattcctgacccttacgtagctctgatccttcaccaaggatgagggtggggagcagggatgagcaacagaggtcatgatttggcaacagcaatggctgaaagtttaatcgtttgttcatgagagttttattctggttttagttttttattttgttttgctggctgaggcaaaatagtcccaggtcaaaggraccccatcaaaatacttcacgctcacaaccactctgggagtttgcatgatcactggttcatggtatggaaactggggcccagagagggaagtaactttccaaggccatgcagttcttaaggagggtgctctggaaattctctctgttcttggggtgttcatgccttaacaaaccgaggatacaaattctgtcacaggaaaagtcctcgaagtgccttcttgcatgacgagcttatgacccagggcttgggctatttctgccacaataaaagctttgcatctcataggccttgtgcatacttgcttcctgcagatcaccttcccagagctggtggatgtaattcacatgccgtagagtttacccacttcagcttttacttaataaccaattcatgcaaccatcactactgtctaattccagaacactttcatcatcccccaagaaatcgcatattcattaacagtcacgtcccattctcccttcctcatggctttgggcaaccactaatctttctgtctctagatttacctgttgtgaaagaagccaggcacatgttgtaggatgctgtctctgtagagcctataacacatgccttttgtgtctagctccttttacctcctaacactgagctagaatgtttaattgttgggggagaattttggggaccagtccatgggttccctaccatgccacttgtgtgatctcagcaagccactttactcatcttccctcccaccacctttggccttagttttctcgtctgtcaagtggagagataataagtcatgactctaacaggtttctggcatgtagatcagtggtctcgaaggactgccttatgtgatgttgatgctgtcctctatagtttacgaaggccccagcaccaacagtacaggggcttggaggcaggttcctggttcacatcttacctctgccacttcccagctgtgggaatttgaagaaggtcagtgaatttctctgagtgtctcttttctcatctattaaatgaagatccaagtattgtgaagattcagtgagataaagatgttgtgatgagttgaagagtatccctccaccccaactcatgtccacatggaacttcagaatatgaccttatttgggaatagggtctttgcagaagtagttaaattaagatgaggttacacaggttgagcattcctaatccaaaaatctggaatcacaaatgcccccaaatccacaactttttgagcactgacatgatgctcaaaggacatgttattggaacattttagattttggatttctggattaaggatggtcagctagtatgtattctgcaaatactccaaaatccaaaaacattcaaaatgcaaaacacaaaaacttctggtcccaagcatttctggataagggatccccaacctgtactggactaaggtgacccttaaatccaataactggtgtccttataagaagaggagaaaaacacacagagacacagagagagatggaggcagagactggagcgatgcttccacaagccaagaaatgtgaaggattgcccagaatcaccagaagggaggaagaagcaaggagtggcttctccttcagaccctccaggaggaaccaacactgccagcaccttgattttggacttctggcctccagaactgtgagaggacaaatgttcattgtttaggccacttaggttttgatactttgtatggagccctgagcaaatggatacaggtattttagtctttttgagcacatgctcaccatccagttgcccattaaggtacctgcaggccccttctctcaacaatgagagggcacactggatgtttttctcaggtctttttagggttagagatacttgttcgtgcagatttcctaagaaataataccaaatgccatcttactaaattgtagaggatttttttcaaatggaagatactgaggcctttcccatattgcgggccagcccaagcccccagagcgtgaatcatgggccccgggtgctgagtgtaaatgcccatccttgcggacctaggacctgggatctgctgattctttcttccttccccagaaccaaaaggcaggccaattcaaagagtctcagaccaggattcaaataaataaataaatggcctcagagcccagctcccagcttccagacagcccagccaccaaccccacccaggtgggaggctacttatagacaaccctgaaagatggtcaaagatggggttctgagactctctggatgcctcccttcatgctgagtcaccctttgccgtccactcagccggcgagcaatgagtgtctgtttcctctcttcagttctggccaagacagagcacggtgtgtgtgggccctcctcataatgacactaccatcgtcttgtgcaacagtaaaatgataaaatcaggaacagttactgtggggtgcctactaaaggccagttgcatcaccacattatcccatgtgattaccaaattctacaacatgctccactttacagactgaggctctggaaggtggaattgaaaatggtccagattctccaattgcacacaaaaaatgtgttgctttctaccataatttcccattaaattgtctctttcacaaaaaaaaaaaagaagaagaagaagaggaagaagaaaatggtccagattcaccttctcagcagtgacggagctagggtgtcaacgctgctgaggcagctccacaccgtacacctgcctgcctggacttccaaatcagaccttaaggaccagggacgggacttgtttttgcagtcagatttgctcactgtcttcctgacctccctaagtacagtagtccccccctttatccatggtttcaattacctgtggccaatataggtctgaaaatattaaatggaaaattccagaaaaaagcaattaatacgttttaaattatgcaccagtctgagcagtgtgatgaaacctcgccccgtcctgctttgtcccacctgggacatgagttgtccctttgtccaatgtacccatgctatataagctacccaccattactgtatagcaaaaagcatagtgttataaggtttggtactatctgcagtttcaggcatccactgggggtcttggaacgttttccccatgcctaagggggaactgctgtacagagcctcattcctttctgttttgaagaccactggatcctgttctgtttcttcatagaactcacaatcacgatcctgtacaggtttctctgttagtctgtctctatcccaagtctgtagcccccatgagggctgggacagtcaagaatgaccccaagtcttcaagaaaagttatggttatcttcagcaatttcagttcccctatactcagagttctgcagctcacagaagcaatttcagtttccctggatccggagttttgcatccccatcatggggaccaatatgatttatatgaaagataaatgctcacagcatcaactttataatacggtaatccaattccatctctttaaaacatcataaaggaactactggtttctaaggaaaacatcttattccatacccccattctttgctgtacacatggcttaattagg

SEQ ID NO: 17610 - DNA, 14675 bp, Homo sapiens
tcctggcctgtaaggattctgctgagaaatctgctgttagtctgataggagttcccttgtaaatgatgagatgcttttctgttattgtttttagaattctctctttgtctttgacttttcacagtttgactataatgtgccttggcagagaccttttcgagttgtatctatttgaaggtctctgaggttcctatatctgggtgtcaaaattgctttctagatttgggaagttttcagctcttattttgttaaataggttttttatcccttttgttttttctttgccttctggggcactgaaaatttgaatatttggtcactttatagtgtctacatgtcatgtatgctgtgtttattcttctttatttttatgttattggattatttcaaaatacctgtcttaaagttgtgaaattctttcttttgcttgatctagtgtattgatgaagcttttgaaataatttttgtatttcattcaatgaattctttacttccagtagttgcatttcgttcttttttatgatatctgtctatcttttttttttttttttgagacaaggtctcactctgttgcccaggctagagtacattgatgcgatcttggctcactgcaacctctgccttctgggctgaagcgatcctcccacctcaaccacctgagtagttgggactacaggttcacgccaatatgctgggctaattttttttttttttttttttagagatggggttttgccgtgttgcccaggctggtctcaaactcctgggttgaaacgatccacctgcctcagcctcccacagtgctgggattacagatgtgagcctagccctatgatatctgtctttggtaaatttctcattcgtattctaaattttatgatttcttagtattgtgtctgtatattgtacctcacttagctttttaaatattattttgaattctttttctgggatctcataaatttctttttcattggaatctattgctgcagaattatttaggtcatatttccttgctttatcatgtttcttgggtccttattgcgcatatggtataacagtcacttcttcccagttttttgaattcgctttctgaggcgagggctttttcctgaagatgtgtttatgatgttgattgggtagggcattttggcatgaatctgggtgcatgcagtggtgtagtctccgtataaattattcggctgtttacagcgttaatagtgtctgattttctcagtgatgtagggtttggtttgttagtggagtctgtggtgaggcttagctggggacaggttcaccaagtgggcctgtccttgggccttagggcaacatatgctggcactggtgttagcaggtccaggtgggctgattcttgggcctccaggtggcttacttgggtgttggtaggggcagtggttggccagttgggtgggcagattctcaggctcctgggcagcgtatgtggcatggttgatagtgggaaaaccctctgtttcccaggtggtctgtgctgataatggcagtggctgcaatgggctgggcaggccagtctccaggcctgcaggtggtgcatgtggttggggaccagctgtggtatgtaatggcagattgagtgggctaaatctcaggcccctaggagaagtgttcacatgttaacggtggtggagggggctgggtagacctgtcctcaggcccactagtaatgtgtgtgggtgttggctgtggtaggcaggggtggggtgatccccatggccccagtggagtgctcgagtggggccctgccactggggagggaagggttgctttcagtggcaccagacataaacattcagctgatgagtgggtctttgggccccaggtggcagctgtgggcagggtagtctgtcctcaggacacttgtaaaggtgtagtagctccactgcttggggcagcagggtcactgccaatagtttgtggtttagcaccagtggcagcagccagcaggagtggtggctttgggtggtgggagtcttacagtctaacttaggcctccttggggcacatgaaaatgcatagcagctctgctgctgggggcagtggggttgctgccagtggtttacactttggcttgggggcagcatgggatcacaacagtggctgtaggtggggatgtaagtggactccagggatatggagatgccggggctgtttggccccagggcagggtacagccttgttggggctgggctctcaaaacgtgctgtgctctagctgcttaggactaaggagtggaggggaccgttcatgagcagtatcatcgtgtggtccccaggcagctccctttgtcagtatgagatgattttcttattatgaaatcgatattggccaggtgcggtggctcacacatgtaatcccagcactttcccaggctgaagtgggtggatcacctgaggtcaggagttcgagactagcctggctaacatggtgaaaccgcatctgtacaaaagtacaaaaattagctggtcatgatggcagatgcctgtaatcccagctgctcaggaggctgaggcggaagaatcacttgaacctgggaggcggaggttgcggtgagccgagatcgctgcattgcactctagtctgggcgagagagagtgagactcatcttgggaaaaaaaaaaaaagaaagaaagaaaaaaagaaatcagtatcaaggctgtaaggggcctacttcaagtgttcttaacttctgttttccttctaagttgtttatctagcttgtacttagacaccttaatagatacataaatatttctttgggtagggtgtatagcatacaatgtttttttttgttgttgtttttgagacagggtctcactctgtcacccagacttggagtgcagtggcgtgatcttggcccactgcaacctctgcctcccgggctcaggattctcccattttagcctctcgaagtgctgggagtagcgtgtgccactaccgcccggctaatttttgtatttttattttaatttttgaggtggagtctcactcttgttgcccaggctggagtgcagtggtgcaatcttggctcaccttaacctctgcctcctgggttcaagcgattctcctgccgcagcttcccaagtagctgggattacaggcatgtatcatcacaaccggctcattttgtaatttcagtagagatggggtttcaccatgttggtcaggctggtcttgaactcctgacctccggtgatccacccgcctcggcctcccaaagtgctgggataacaattgtgagccaccgcaccctgcttaatttttatatttgtaatagagacagggtttcaccacgttggccaggctgatcttgaactcctgacctcaaatatctatccgcctcagcctcccaaaatgttgggattaccaccaataccgtgccaggccagaatgttcgttcttttttttttagacaagtcttgctctgttggccaggtcttatattaaaacttaaatatctttttgtagcttttgccctcaatttttttttaccatatagaatactagtgctttcatttaacaggggtttcagggtgcaattttgctgaataataaattttaatgacgatgctgttttgagatagtgtttttatagtaactgtaaatgtgtaaatatgataatgatttttcaaaatagtgtgtacctttataaacataatttatgtatttacagtcacatatatggcctagaatttcctatcagtttgcaaaagtaattttatgaaaatacatgataggcagcaaaagttgaggcaggatacttgtttgttcaggagagtctatttttaagtttgtggagttctcatttagaagatgtgttgggctttgttgattacttaacagcagtagcttgggtccttaaggctttaagtagaaagcctggagttcttgtacctgggaagccctgggagttatttggcaagaggaatgtgagtacagcctcaaactaaaagggtgccaagactgacgtgaaatgaaggaaaagagaaaatagacaatgtttaaaaatgtacacagttttcaagctagtaaatgtatgctactgacccctacttacataaaatatattcatgttaggtatatagttagaggtgcattttggcaaatgtatatacttaggcaactgccattgaaatcaagataaagaatgtttctgtcgtatcacaaaattccctcattactttttactcttagtctccaccctaggcaactactgatttgcttcctgtcactactagatagattttgactgttccagaattacatatcaatggaattagactctgcattcttttgtgtcttaacaaaagtgcgtgttttcaatagttggcttttttttttttttaatttctgagtagtttgccattatatgaatacatctttctctttacttgttgatagacatttaggttatgttcagtttttggctattataaataaagctgctgctaacatttgtgttcagttatttgtgtggatatatgctttatgttttcttttttcttgagtagaattgctgggtcataagctttttttgtttgtttgtttgttttagatggggtttccctcagcctcccaaagtactgggattacaggcactagccaactcgcctggccttgtttgtttttgtttttgttttgaaagggagtgttgttctgtttcccaggctggagtgcagtgtcgtgatctcggctcactgcaacctcctcctcctgggttcaagcaattctcttgcctcagcctcccaaatcactgagattacaggcacctgccaccacacctggctaattgttgtatgtttagtacagacggggtttcaaacatgctggccaggctggtcttgaactcctcaccttcagtgatctgcctgtctcggcctcccagagtgctgggattataggcatgagccactgtgcctggcctggtttttatatgtttgactttgtaagaaagtgctaaacagttttccaaagtgatgttgtcattttccattcccatcagcagtgtgtgagttccaggtactcaacaccctactaatatttggagatgttattctagcaaagggtatgtgataatatattattctagttctgatttacatttctttgttgactaatgatgttatgtaggtttccatatgcttgtttgccacctgtgtatcttctttgtgaagtattttttcacattgttgtttgtctttcaatggttgtcttattattgatttgtaagaggtttttaaaaagatattccgaatataagttctttgtcagaccatatgtattgcaaatgttttctcccagactgtggcttgcctttttttttttttttaaagctatttctcagcggaagttttgaatttttaagaagcccttttaatgaaaaaatttttttcttttatgatttttgcttttgtttcttaaggtagcattgactaccaaggccatgacagttttcttctagatgtttccagttacagttttacatgtaagtctgtattgcaattcaatttaatttttctttatgatagaggtaagggtcaagggtaatatttttcacatggatataaattttttagcatcactttttgaaaaacctatcaattctttgaattgccatgatctatatatgttgagacctatttatatattcttaggtctttcatttcattgatctgtctatatttttatgccactgtttggttactgtagctttatggtacatgtgctaagcaaggtccatttacgaggcagaatccatacagtaaattgaagaatgaaattttagtataaagaattagctcttgagtcacccctgtgcagccttggtgccgtgtgcattttggacactcagcccaccttgctctctagtacttgtaagccttttcctttcaagatgcctgcagaggtgtaccatggagaaggggaggtggcgacttttgccttttaggcagaaattgcccaactcatgtctctcataatcaataccttctattccaacaaggagattttccttcaggagttgatctctaatgcttctgatgccttagacaagattcgctatgagagcctgacagacccttccaagttggacggtggtaaagaactgaaaattgacatcatccccamccctcgggaatgcatcctgactttggtcaacacaggcattggcatgaccaaggctgatctcataaataatttgggagccattgccaagtctggtactgaagcatttatggaggcttttcagtcttgtgcagaaatctccatgattgggcaatttggtgttggcttttattctgcctacctggtggcagagaaagtagccatcacaaagcacaatgacgaagaacagtattcctgggtatcttctgctgggagttccttcactttacatgttgaccatggtgagcccattgacagggataccaaagtgatccttcaccttaaagaagatcagacagagtacttagaagagaggtgggtcaaagaagtagtgaagaagcaccctcagttcataggctgtcttatcgccgtttatttggagaaggaaccagagaaggaaatcagtgatgatgaggaagagaaaggtgagaaagaagaggaagataaagatgataaagaaaagcccaagactgaagatgtgggttccgatgaggaggatgacactgataagaataataagaagaaaacaaagaagatcaaggagaaatacactgatcgggaagaactaaaccagaccaagccgatttggaccagaaaccctgatgacatcacccaggaagagtgtggagaattctacaagagcctcaccagtgcctgggaagaccacttggcagtcaagcaattccctgtagaaggtcatttggaattcagggcattgctrttcatccctcatsaggctccctttgaccttttttagaacaagaggaaaatgaacaactctgtgtccatcatgtgtggatcatggacagctttgatgatttgatgccagagtatgtcggctttgtccgtggtatggttgactcttaaggatctttccccaaacatctcccgggaaatgctccagcagagcaaaatcttggaagtcatttgcaaaaacattgttaagaaatgccggctgggcatggtggctcacgcctgtaatcctagcactttgggaggctgaggcgggcagatcacctgaggtcaggagttcaagaccagcctggtcaacatggtgaaagcccgtctctactaaaaatacaaaaattagctgggcacaacgcctgtaatcccagctacttgggaggctgaggcaggagaattgcttgaacctgggaggcggaagttgcagtgagccaagatcatgccactgcactaagcctgggcgacagaagaaggctctgtctcaaaaaaaaaaaaaaaaaaaaaaaaagaagaagaagtggcttgagcttagcttctctgggctggcagaagacaaggagaataacaagaaattagatgaggtattctctaaaatctcgtggcttggaatccatgaggactctattaactggcgacacctgtctgaactgctgtggtctcacaccttccagtctggagatgagatgacatctctgtcagagtatgtgtcttgcatgaaggaggcacagaagtccatctgtgacatcattggtgagtgcaaagagcaggtagccaactctgcttttgtggagcaagwgtggaagaagggcttcgaggtaatatatatgagtgagcccattgatgagtactgtgtgcagcagctcaaggaatttgatgggaagagcctgctgtcagttaccaaggagggtctggagctacctgaggatgaggaggagaagaagataatggaggagagcaasgtaaagtttgagaacctctgcaggctcatgaaagaaatcttagataagaaggttgagcgggtgacaatctccagtaggcttgtgtcttcaccctgccgcattgtgaccagcacctacagctagatagccaatatgaagtggatcatgaaagcgcaggcattttgggacaactctatgatgggttatatgatggctaaaaagcacctggagatcaaccccaaccaccccattgtggagacactacagcagaaggctgaggcagacaagaacaacgaggctgtcagtgacccggtggtgctgctgtttgaaaccacactgctctcttctggcttctcccttgaggatcctcaracctatccagctgcatctaccacatgatcaagctaggttagctattgatgaagatgaagtggcaacagaggaactcagtgctgctgytcctgatgtgatgtgttcctgaggatgtgtttcacatggaagaagtagattaagagtttatacctgcaaaccttgtgcccttgcatagtgtccccatggctcccactgcagctttgagtggtcctgtcccacctggckctctctgctgatatctagtattttttctcttctgtccttgtgtctaaggcaggaaacaagggcatcaagccccattccctctctactttgacagcagaattggatgttgtatatcctgtttttttgttgttgtttattttgttctgaaagtatgtaaaataaagaatatgctgtttttatacagtaaaacaacacaaaagattaccatttctggggattagcaactaaaagaggattatttttcttggcttgttgtggtatctgtaacatcatacttaatgttacagagttgcataaaagtggcaagtgtgaatatctttaccttcttcccaatcttaggagagaagcattcagtctttcatctttaagtatgatgttaactggagtttgtagttgcattttatcgggttaaggaagttcctgtctcttcctagtttgctgagaattttatcatgagtaggtgctgaaatttgttagatgctttttctgtacctaatgagatgattttgtggcttttctcccctttgaatgcggtgaattacattgatgattttagaatgttaagccagcctcttattacttcatttgcttatgatgtattgtcctttttatttattgctttgttcagttttctagtttttggttggatttttttgtttatgttcataaggaatatcagtcttttttttttttttttggggggggtctgtctttggttttggaatcagagtgagccacataaaatgagttgagtactcttccctcctgttttcttaaaatagttttataggacatcaggggaaccatctggccctggtatttttcttgtggaaaggccttaaatcatgaattcattttcttcagtagataggggcttattcagattttctatattttgtgatagttttcataatttgtaccttttaaggagtttattttatctaagtaattgaatttattttcattatgctcataatattactttatcactcaatgtctgcagtactggaatgatgttttcttttttattcttcattgacaatgtattttttaatgatcttttttattggctgtagaatttggattgacattgtttttctttcagcattaaaaaagttactccaataatttctagcttgcattattattattattatttttgtggagacagagtcttgctctgtggcccacgttggagtgcagtggcatgatctcagctcactgcaacctctgcctcctgggttcaagcaattctcctgcctcatcctactgagtagctgggactacagatgcacaccaccatgcccggctaattttttgtattttagtagagacaggctttcaccatgttgcccaggctggtctcgaactcctaagctaaggcaatctgcccaccttggcctcccaaagtgctaggattacaggcgtgagccaccacgcccggcctgcttgcattatttctaatgttaaatcagcagtcactctgcatataatcagtctctttgatggattttaagattttctctttaacgctgattttcagcagtgactgtggtgtgttttgtgggtttttctttgtgtgtatctttcttggtgtttgttgagttacttagacttgtgtttatagttttatcagtttggaagttttttatcattttatcaaatttttttttctgtctcctctcgcttctttatttatttactgtttgataggttactgaggctctgggttttttttttttaaactctttatctctctgtacatcaagttagatagtttttgttaccctgtcttcaagttcgctgatattctttcttgcagtatctcatctgctcttaagtcagtccagtgagagagagagatatatatatatatatatataattttttttttcattttagaaattatattttccaattctggaagtttcctcccctctcattcctttccctctctcctctcttccctgtccctccccttccctcccctctttcgacagtttttggtttctccttattgtgcttatattttccccataattctttaacatatttacaatatatagacactaaatcactaaatccttgtctgctaattccgttatcattcattctcactttttttgggggggactaattttcttcttctttgtcacatttctttatagttagtggtttggtttttttaccccttgttttttttaatagtttgtggtttttaattggatatttcacattttgattaatatttagtgtctttttgtcgttgtttgttttttttaaaattagagatggagtcttgctacattgcccaggctgattgaaaactcctgggctcaagcaatcttcccaccttgccctcccaaaatactgggactacaggtgtgagccactgtgcccacctgtgtctggatttttaaaaaacttttaatttaaaaataattgtagagtcacaggagcttctactgggaagtcctggacatctttcccccagtctccctcagtgttcacaatttatataactatattacaacatcaaaaccaagattgatattggtacaatgcatagagtttatttgggtttcatcagttttacatgtacgtgcatgtgtgtgtgcctgtgcataattctgtgcaattttgtcacatgggtagtcttgtgtaattatccctacaatcaaagatactcaatggtagcatcaccagactcccttgtgctatccctttatggccacattcatcccctcccccatctataatcctaaacaaccattaattggttctccatctccataattagattatttcatgattgtcgcatgaatcgtattatgcaagtagtatctttgagattgacttttccactcagcataatttttttgaagtttgtacaaattgttgtgtttatcaatagtttgttcctttttattactaaattctatcctattgtatggatataccacagtttaactgttcgtattttttttttaaaaagtatggagttttgtttgttagatagttgagtaacttgtggatcagcttgacccttttgagccttttttttttttatgattaattaagcagaaattttatttccaagctcttcaaagactgttacaaacacaaataatgtatccttctaaaaaagtgtcccaaattaaatcagattcacatcatcaaagtaaaacccttgtgaagttaagaattcttttaggttgtaatgtttttatgttagtttttaatcatttacaatgttctgtgggtcacattttaaacatttttaaatatatgaaattctgtatttctttaagtacagccacagctacaaagtagaggaacgtaagaatacaaagaccaaatctgcttcatttatatacacgatggggcagcctaatgcacatcataacattaacttttccaaacaagtttgctaagaatctgctcccataattagtgttaaaaataaaacaatcttcccatttagaaaaatcaagacatcagttgattagtaaagcctattcttcctcccagcaatttgtactttctggtcttcatttaggaattgtaaattcatgagaaaagaacaaattttttatggtataaatatcttccaggaacaacagtttacaagtattcgattgtttaaataaacaaaactattttccttcctaaaatgtaaacatccagtaaatgaaacatacatgatattccaggtatagaaatcttagtaactcacttatgaaagaggtgcattttggtatgtttggtggtaaggtttttgtttatcttatgtataaaagtacttgcacaaaaaaacaagctattactatttaaaactctattccttcacccagtttcctcactcaagtagaaactcatgaatttctgtgattttggctataggacggggccacaggaaagggctgaaatatctctaaaagttagggaaaagtgttttcttgagacttgaaggcagtcattcatcactttgtgcttgaaggcattcctcagcaaacttctctcttagagtcttcagagtaaagcacaggatctgggttcccagaaggggttacttccagctagaacacccaccagcagggcatccttgcaggcattctgcatacagtactgttgaagctctgcggctgcctgagagacattgatcctctccacgccagcctccaacttgagctgctccaccaggcactgcagggcgctcgcgctagccccagaggacatggtggcggcgctgggctccgagggcccagccttgtttttaagctttattaggataggtttgaagtagcctttattctaggaatagtttgttcctatttccaaggagtggcttttctgggttctctattaaatgacaacaaagtctgtcttctgtgcttgatcacaacttcgatgtatccctgtctcttgtaagatccagtaattggtcaactaacagctccttaatagttgtttttgggcccacctttgtggagtctctctttatgcatccacgatagtattgagccacagactacaggtgaacgcctgtgcagatttctggagttctttctcattgttgcaccttccttttttcttaaatcatagtccttcactgcttgttgtctattgtctgaaagcagttgtttcatttatgtaactgaaaaactgtatttttgaggtgggtaggcaagtccagtaatggtttctccaccattgtggcaacaaaactttttgtttatttctaagttagtaatttgaaagtcaaaattgattcatctgtccaaagagcagtagtttttgttttgtgtcttaagatgttattttaacttacattttattttttgaataagaaatatgctcgtatgttttaaaatttaaatgccacaaaagatatacaatgaggtatccttccctcccttatttcccagtcacccactttccattcttggggacaaccattgttactagtttattgtgtatctgtcaagaaatttgatgcacattcttataatgtgtatcttactcagaaattctctacacagaaatgtggagatatgtatatatacatatatatatatatatatatatatatatatatatatattctccttcatattcttgtttttaaaaaaaggtaacgtactatattcttttttgtatcttatttatttatttatttatttattggagatggagtgttgttctgtcacctaggctgcagtgcagtggcgtgatctcggctcactgcaagctctgcctcccccgggttcacgccattctcctgccttagcctcccaagtagctgggactacaggcacccgtcaccacgcccggctaattttttgtatttttagtagagatggggtttcactgtgttagccaggatggtctcgatctcctgacctcatgatctgcctgcgtcggcctccccaaatgctgggattacaggcgtgagccactgcacttggtctttttttttttttttttttacttaatataacttagaggtctatgatttgattacatgtaaatattttatatatttttttcagctttgtagtatacagttatatgggtatacccataaatacgattatgtaccataagcaaattaactagttctgttgttactaatcatgtactatttcaaatagtgctaaggtgaataatctttctgggctattttccaacaccagcaaccaattctcttgattctccagacaccaagtgggtgttcaacaattcagcgtaattcagttctcacagtaaatatctggagctagtgcagaccccacagcttaagggcccattcctacaacactgctttccacttcagacaccatttgtaagtcctgcgccacctgtacttcggaccacctgctataaattgggggttccctcaacctcctcctaaggttagataatttgttaacctggctgacagaactcaggaaaacagtttacttactcttgctggtttattataaaggatacaactcatgatcacctaagtggaagagatgcgtaggaatgtgggaggcagcacagagtttctgtgcgctctctgggttcactaccctccaatcaactcagtgtgttcaaccctggaagctgatcagatctcattgttcaagagtttctatagagcttaatctcctgtctctcccacctcactttctggggtggagtcagtggcta

SEQ ID NO: 17611 - DNA, 255015 bp, Homo sapiens
  misc_feature (1)...(255015): n = A,T,C or G, or insertion/deletion polymorphism (see Tables 1-2)
ttctccactgaaatagctttacacaaacatgagttgtttatacatgtgtgtttctatttctgagttctgttttgattcatctgtctatcttgatttgacaccacactgtctggttttgatataagagtaagggtggcttcatgaaatgagttgtgaaataaagtttctgaaataatttgtatataatggttattatttctttcttaatcattttgtagaataccagtgaagccatctatgtctcaaattttctttatgtgaatgtttttaagtatactttcaattttaaagtaaataaatatagggctattctggttatccagtttttctagagtgagctttgacagtttttgtcctcaaggaatttgtccacttcatctaagttgttgaatttattgacataaatttccataaaattgtcttactttccttttaatatctccagaatctgtagtgatgttaactcatttattcctgatactggtaatttgcatcttttctctatttttcctatcaggttggctagcattttttcagtaaaaggatatgtcccctttctttctctttgctaatactggaaaaattagaattattttttaccagtttggcaagaaaaatytgcatatcagtcaatgggtttctttgctgtccctctccttctgcatcagaattattttcaattatagaattgttatttcactgatgtttttataaagaaagcatcattcatgaattttttattgaattctttccttgtgctaatagtagtagagctgaggttcctcagatgagttaaaacctcatgcctgtccttgaggggttgtcagctagtgggagagaatgagaattatatagtagaggtctgtaggagttaccctgtggagacaaaggaagatgtgatcagctctactaggcatgcatatctttccagagaggaagaggtaagagttatggttggaagatgagttggcattttatagacagatcatggtgtttgagattgagggactggcaggagcaaggcacagaagtagaagggagagtgacgagtatatatcatcagtcagggttttttagttgcaagtgacagaagcatttcttgggtgactaaacagttatggattttattatgataatggaaattcacaaaattgctgggagaactgaataatcaaaaccacactggagaacaggcattatgaggaagcccctgctgctcctgtactaggtcctatgggaaaccaccactgcccccacaggtgccaatgctgagccaggaacttgctcttgctaccacatctgcccatgaaggacagagctttctgctaccaaattcaatgacacagtggtttctacagtcatccttcaccagatcgtttacttctaaatcacagttttgcatggagagtttgattgagcttaaattaccttcacccatttattcaaagtttattcaacaactcaggttcatattaagtgccagatatcatgtcaaagtctagggatcaagcgaacaaataaagtatctgccctcataaagtttatattctagagacagtggcgagagaagggtaatttttaaaaagaaataagtaaatttatagtatgtcagttgatagtaagtgctatggacaaaaatttgaaaataaagcaggaaacgagacatgcctggaagggagggtatgttgctcttttacagagattgatcaagggaaacatgtatgggtaatgtatagtaaagatatgaaggaagtgaagaagcaagccatgtgaacttctggagtaaaagcctgctaggcagagggaatagcgaatgcaaaggctctgtggtgggaattacctattgtgaccaaggattaacaaggaaactctgtgtagctccagtgtaactggagcagagagatcaaaacaaagaattgtaagagataaagttgaagatgtgggggagatggggaagccatatcatatagggctttgttaatcattgaaaggactctggctttgactcagggtgagatgtagagccattcaattgcactgtattgaatagaggagagtcagttctggcttgtattttagtaggatcacctggatgctctgtttagactatattttcgcataccaaagacagaatccagggacccattgcaataatccaagttagagttgagatgatggtgttttgatcacagacaacagtggtagtaaagatggtgaaaagtgataggctcttggatgtattctgagtgtagtgacctcactacacagggttgtgtgtgcataagcaagggaagcaaagatgaagagtcaggtgcagactagattacaaagtcccttgtgtgccaagcaaaggaacttgatttcatcctcaggtaatgggtgccacttgtgaattttaagcagagattcatatatcatattttattttagaaagctgatttagtggcagaagtgagaatgaagttgaagaggccatgttagaggcagggagacctttgaagagactaatgtcaatagccagacaagaaaggatgaagaatttacaaagacaatagctatttatctatgacagtagatagggggaaaatggttgtatattcattttctgttactctgtaacaattaccatgaacttagttacttaaacaacacacatttattatttcatactttctgtgggctaagagttcagtcttggcttagatggttcctctgctcagaatctcacagggctgtagccagagcattggctgggctgtgttctcatgtggaagcttgtctggggatcttccaagttcactaaggttgttggaagaattcattcatttgtgtctgaaggactgagggccctggcttcttgctggttgttggctgcaggccacctttagctcctagactctactcatagttctttgtcatgtgggctttctcaacatggcccattactccatcaatccagcaaggagactctctagaggaagtttgccagcaatatggagccttagcaatataaggcaatcacaggaatagcattttatcatcttacttcattctattcattagaagcaagtcacaagtctcacctatactcaagtgggaaaaattacacaagggggaaataaacaccggaaagtggatcatcgagggccaccttgggatctatccagaatgttaaggacacagaatagataagacccagagagtcactggatgtgggtaagaaaaggaaggggagaaatacaggatgacactcagctttcctgtttgtatacttggtagatggtgagggccctcaccaaaataaacacggaaggaggagctagtttgggagaataatgagtcttctttaatttgggagcatgttttatcaaaatgttctttattataatgaaaaaaaatgaataaaccttagccatagggccctattcctgttcttaaagaaacttgactcttggccgggtgcagtggctcatgcctgtaattccaacactttgggaggctgaggctggtggatcacttgaggtcagaagtttgagatcagcctggccaacatggcgaaaccctgtctctactaaaatacaaacaaactaaaaaaaaaaaaaaaaaaaaattagccgggtgtggtggtgtgcgcctgtaattccagctactagggaggctgaggtgggagaattgcttgaacccaggaggcagaggttgcagtgagccaagatcgcaccactgcacttcagcctgggcaatagggcgagacttcttctcaaaaaaaaaaagaaagaaagaaagaaagaaagaaagaaagaaacttgactgtcatagttcatgccacatgctattttgctgagccaaaagggagttcctggctgtgtctgagtttttgtgcctgcaatggactcttcaaagctggaaggctgaccatagaaatggtgtgcttacaggagctttcatgattacaggtaagaaaaactgtttatagaaaatgaaatcattcagaagttctcagtgtttatatgtaactcacctatgtaagttgccttagaatttacctcttttctgtaaagaaaacgtctttgtctgattttgtggttacagacaatgttttatttcaagtttcccaaaggaggggaaggagtgagagttagacaagaacagaggggaaaaataaagacaaagcaatactctgtaaaactgattactcaaatacatttttgacaaacaggtgtaatatctggttgctgttgccattctgccaccaagaaacctgatgacttcatttgggcctcttcaaccagctgcccctaaagctagcaagctccacccttcagtgtccactgataaattccttaatagcgtaagtgattttaggaaatttttgaaaattgtgtatgaatggatggattccatgacaagggtattgaggtcaaatggtatgtggctaggtactgccaggcaagtctaagagattaaatttaattattttgggggactcaagtattgaggaaatgactatgtagctggttaggaaaaaataatttagaaggtcctgttttcaggtacactgaatgactacattcctttccaggcctttcttgcatctgctagttgtcagaggaagcctgtggttgtcactgaaggagcccatttgtcatagatagttcctgttgagtctcttagtccacttaattttcaatgagctgcacccaggagagacttcccacaaaactaggttaggctgattctgtcaggtggaaattttttaatggtaaatggcagaaaacccaatctaaaatcacttaagctattaaggaatttattagtgtacactgaagggtaggtcttgctagcattaggggcaggtggtttaaggggcccaaatgaagtcaacagttttcttggtggcaagagggcaatagcagccagaccttacaccttcttatcatcaagtccagcagcttagactttttactcccaaagctgagctttcatcattgtcctctcattggcctagaaggggtcgcacacctgccctgcattagtcactatgatcacaggaatgcaattactctaatttgggtaagaccaattaaggcccatcctgtttatgggcatcagctgtacccaaaggacatggtttcccaagggaaatttgggtgcagttttgactaaaagtagagtaagtgaatgttgagtgtcaaacacaagagaaagtaatcttcaccccatgagtagtccttttaattggactagtaatttttttacatgcagcatgattgccactgaatggaaatatttttatttccacttgtacatcttacacctgactttccccactgcagcccccgcccccaccctccctgttaccctcacatggtttgactgaaagttccggtcgggagagactcagaaatgttttatcactttatgtgaaggcaaaacctcagatcaataagggaagaaagcccatgccatacacttaaagggagagaagagcctctagatataataatccactgggcaccaccaattaatttatgcattagaggttttaaagtgcattctccttaaaagagagagagagatgaggcgatgtgggagtgcttgtgagggatccccaatgaattaggtttgaaaagatgagttctatatttggatggtaaaaggaaggagttagaaatttgagtggatgcaagaaggaaccatgagggttcagaaaaatctctagtgctaccagggaagtttcattaagttgttgtgtgtttcgtaagcaataccaatagtataattagacttttgctcctttaccctagctattttgcttctcttgtggtatttttcttctatcatatttggcttaaataccatttcattccagtgcttcccttcctgcattccctccccaagcctttttcctgatgcctgctaaaaggccccacatctgatattaacctaaaacttccttgatttcttaaagtgagttattcattaacagaacctaaattactggttgttaggcaaatctaattctttcaaactacagatctgctcagagaaatctgtaaatctagtgtagaaataagtgaagctttgcgycaattgttaggtctaagcagaagtttgggagagagaagaaaagttactcatttgcctgattccgcacggtgagtcaatggggagggaatgaaatgtaccactggcttgacaggcagctcagggagacgcggctgcagcccacaggactgggcagcagctgcaaggctgcctctgagcatggtcatgggtcccagctgcagtgctctaaagatcaaggattttgccttctattttctatgaccagagattcctgtgcaaagaggtatggctatcttctttcatgaccttttgttcagcaaaaacaaaagctaattaaagtaaatgtcagaggctgcaaagaagcaaagagtgggggataggagaatggagctgagaaacttccaggggctggctgattatgcagataaagcacatttgggagctgtgtgtctagccatgtatgcaggcatttcggttattagagtaaaaatgccacttctctgtgggttattaaaacatgtctctaggcctcaggagcagaaagctgtgcttctagattcatatcatgtgcatttttgttttactccgtaataatctagtctcatttctattttatacttttgtttacytcaatcaacattttgcaaccagcaaagaaactggctctgcctacggattttcaaagaaaattaaatattatagcatcattacagtcagtgggttgaacagggtcaccattactgtttgttgctgctgccgttttttcctttggtgtttcagatatcttacaaatcataattaaatctaaccacttttttactctttcagatacacacttaaattgttgtagtaatcaaccattggattaaatgacatttatatatttttgatttaaaaagcagaaaaaaatatttagagaaatatttgagttggtcatatagatatttggtacatgaaacttaaatgtaaatgaagatacatttaacattgagttttccatgtagtttgagagttttggtacattttctggaagaacaaacccacgaatttgaattaggatttttcagcaagatttgtattattccagagcaaaaatgaccaacaaagtcaacatttacaggtgaaaatgaatacactataaaattatgacaagtcacaaaagccttgattttagaaagtttattagacttgaagataagtgtttctcatcctttttgaaggaaatgtttcctatttgtgttttaataagttgaaataggtaatcaaaattaagtagttttttgggctcttgactaaataggtcaccaaatctatttttttcatgtacttatgaaataagcctgctacaaacttagatcgtatgtactctagcaaaaagacagggctgaagcctttagcattgcttagaataagccagactcagaggctttcagtagaagtgaagtgtagcagcacgccacagccaaggaagcccagagacatccagggaacaatagacatcttgtgggaagggctgaaatgtatgcagccaattcccatgggaacgcctgtagtcctttcacgctgtgtgaaaaagatgctccttcaaaagaatctgtaatcctttctttcaagggaaaaatctgagaactttattgaaagtttctagagcccaaatgggtctaagtttgttaatgagcatttttaatacaggtgaataaaatgaaaatgttttgatgcagagtaatgtagtctaaagcgtaatgtaaataaatattgtcattctagaattttctgaagtgaggaagccagggtataccctaacctaagttgcaagctagaggctgaattcttcagaataagttggtttcttgagttaattatggtgattgaaatctcccccaagagtttcaattattctataggcagtatcccaatagtgtggcgattaagtcctccagttcatgtatattttcatttagcagaatctacagatgcataatagagtaagccactaatgttttattagtgggcattgagtgtacgtcaccttgaaaagtagtaaagaaagtagctggagccctggagggccactcctttctcactaataaacacgggaaggagtgctacacttccatggaaaactcaggtgtttggattacccagccacaaaaagtttgagatacattgtattctagcccatttctgctctgtaaaaacattcactgttattgttcaaccttggtgtgggtaggatcaccgtaaaactatctctccaggaaacaagataaggttgccaaaaaatcaacagggacccattcaagagaatgaagtttacagatgaaaagtgaacaacccagaggtaaggacaggatgactaagatagagaaaggacaacaaagatataaatatggctcaaatggaaacaacctaaacatctttagctctgtgaacccaatttagtgaacagtacagtcatgtattaatttttaaaaggtatggcatggggatgtgttaactggtggaccatctataggaataatagtactcttaaggatatgattgctggcactttttctgtggttgccatatgccaggctctgtgttraatgttttatatcatctccttaaacstcccaacaacccatatcacaatcctcaggagcaaaggaggaattccaggctcagggagtctaattaacctgcccacatttacactgcaggtaatggcatagctgagcttggaatccagttgagtctagattcccatactcttatcactctgctcttcttactggagttccatagagtgtccaattcaggactctacaccctttaaaaaaataaaactggataaaaatctagggattaaaaatcagtaataatgaatagaggattaaaagggaaggctaaagcaatatcatctattccattaaaagacgaaacttcattagtatattgtaaattagaaaaactactaatgaaaaaatacagctactcatgaatgactggattcttgatttttataaaggaattcttcaaggggatagttctccaaatgtggatggcataaaaatatgattgatcaccaactgtctaggcagatttacgaggtcgttctcctggaacatatgacctggtttaactgtggccaccctgaccacaccctttgagtagacacaccctagtgagcacaaagatgagattatctgcaggatagctgcctgtacacattgccagaagtgagatgatttgatatagctatagatctaccacaggaacagacgacttaggggtcgagaagaatgcagtcttaaaaaccttgctttttaaagtgcactgttaactgtttaaagaataaaggaaggttccagtgcccttttctccatcggagtgtcagtagattaagcaggataaaccttttgcctgagtgttgctgcaatatttaaaagtacaaatccaatatttctggtccacgtrgatttctatgaatagcttcccagcaaataacgaaaaaaagagagtacgtatgttgtgaagtttgttctgtttattagcaacttcccgcatacttcaactttcaacaattttactctagaggcagagtaaagggatactttctttaggaggtgactcttactggacgaacactcagtgtttccaaaacgtttgtgagatctcagggagagggaagtgttaatgaagctgcagttctcttctcctcccctggagctctgagaggtggctccctacagccattccgttcacctgcttgagttctgttgaaaattgtttcctgcgtggctcgcccccgccccccattcttccctgggaaagtatagattttcacgaacacagggagttctgttttctctgttaaaaacaactctcctttactggagcaggctttgtgtttcacctcaggaaacagagcgttgcactgggaggtaactccgctgggtgaggtgcagcctgtcacctgaccggtctctggggctgccggtggcatcaggctgcattccttgaattcttccacccggcaccggctccgcaatgaacaacttcaggttcactgagctgagcggattccactcgctgtgccctcggagcctgcctgaatctcccgcccagtctcaaaccatgcagctgagtaactgcaagggcgcctttgaggagtagcacgcaggtaaagtcgagtttgcgcgggacagctgtgactccctgaaatgtgccacgttttgcgccatcatttctgtttttgtggtttctgtttctccctacagaaagctgattcgccagcaaatacctgccaaaaaaaaaaaaaaaaactaaataatgagaaggtgggcctcagattagaaccccttaaagattagggaaggaaattatgaaggaagcaaattaaaggctgtaagaattttataagccagcttttaaaaatcatacaaaaaatatgagattttggagtctggcctacctgaatgtgaatattggctctgtgtgtaaccttgggcatgatacttaacctcactggtcctgtttcctcttaggtggtaatatctacctgcagagttgatgggagaactaaaagaagaaagcatctagtgtctagcaaaaaggttgatgtgtagaaagtattttgagtatgtgcacatatgtgcatgtgtgtatatggtatgcttgtgtgtacatgatacatgtatatgtacacgtgcacacaggccacaggactatgacattcataagggtagggagtttctcagaacatgaggtagaatttgatctggctytgaccttccctgctattgcaaaaagamcagcaggagaagccagacacctgagcaaaatattaatgagagctgctgaaaaataaataatgtgccttgccagtccttatttaggaagggatgtgcagcatgtggaggtactcattggatgagagctgatgggaagggagacagctcaataataattatctcacacagtcatgaatacaactatcctgggagaccagctgccttcaatcctgacttggcaacttactcttcaagtgcctctgctggtggttactttcctctctaaacatcagtttttgattgcatggaattgtcataagaattaagtggctaagtatgtgagaagcactgagataagtacctgacacatggcaaacacccaccaaatgtcagttgtgccattattttataaagggctcgtttacactttatcacctgtgaccctcaaaacaccctgatgaaatagacgaggtgtgtattagccccattttgcaaataagaaaaccaagtctcaagaaaggaaaacaacatgaactaaaggtccyataatcgctgartagctgagctgggacatgacccttggttcctagatgagcagatgacttagtatgaactcagcacaagtgcactgaataaaacctgtaaaaatcttagctatcctaaaggtgcttctcaaataccatttcctccataaagctattcattatcatcttcccctggaagtgacttctctctcccttgtacttccccaaacttctttttgtagtatccaggagatttttctcttggtcactcccatattgtagaaggtgttttgaagatcacagttgaaaacgtgcaaaagagccctttgaaaaataatgtgtaagtctcacctctccccactccacccctatgtttgtgaaagctttcctgtatggctgtgtgttaaacaacttgatgtttctgtttagggcccaaagcaatgttttgcatgtgatgggccctcaagagtaagagctgaagttggcagcatgaatgtgggactccacaccaggtgtcatgtaaatgtggagtgtgcagaaagagcccaggaaaagcctgggggtgctcctctgtaccagcacgtattactgctccttcttggagctcctgagcatctatgactggggcagttgaatgtacttcatggagtgccacatgtccaacaagctgacaggtcaggtgaagtcatttccatccaattttcctgaatattattttactgagactcttgtcactgtaaatatctgagcctgggaggaaaatgtgttaagagaaaaatgtaggaaaacactgtgctgattttccttagagatattgtgattcaccctcccacatttcccagggtgcgaactactttgcagtacctcactgtgctccacctccctctgaaagcttaccactctcctttgctcttcctccaagcgtcttctcctgtgactstcttgctctctggttgctctaaatctcagggcatagaatgggcaaggatccaggagcagtgtagaaggggagaggaattcattttcttgcttgataaccctgctcacaccttcatcattaatattaataatgctctgaggacctttactcctaacagtagcctcacattttacatggagtcaatatttcataatggttatgaacttggagtctagcactactggagtctctgggttcaaattccagctctccagttttgtagctgcatggctttagcagttatttaactacctcaggttgctcacctacaaagtggggatgacatattttcatatagttatgaggattagatgaattaatatttacaaagtgtttatgcctggtacatagataaaggcatgtaagtgttaggcttcatttttcaaaagctggtagatagtacaaaaattgcatatagagagtattttccttaaaatccctatgactcatgaattgtaccacttacaatactacagatagcttatttagttgagtgtgtaatgaaagctttggcttgtattttgaggccatggtgtttgaagagtatgtgtctttaaacttgcactcaacacaaagaggtgctctcacaacaatagctcagaggagaggtctgagactacccaaggaaacaatagattctcctctcccttttcacactctttctggcaaaccattcagagtaaaatgctaggtagaaatgcctattacttgtattaaataactcactcttggctctcactaagcatgtggctacatttgtaagctacccacatgtatgaggtgattccactctactgtaaactgtgagggaagtgcactggactgaaatcagtagactatccttgccacagctattatggggccttggggcagtcattaaacctcactggacattaaatgattactaaggtctctgccagtgcaaatggtctgtgattttattaggcccagaagggagctgatgagaataatcagatgtctaatttgtgccattgccctcctctctgtagactgttaattgggtgagaaatatagtgggactttattacttcaactggaatagagggagagttgcctgatcccaaagccctcctctttagcccacatggcaaggctatcatgttcatttcagtgttaaagttcatcttcatgttcagtagagatttatctaacgccattctcctaagcagcatctttattttattgctacttgattatagagtacgtaggagtagggtaagtactgaggtcacctttttgactgacagagcagggaacttctactgctagcgtagcaaggcagcccaaccaagaggtaagcactggtttctgtgtccaggttctggaagaaagggttcaaggaagtgggtctaggagatgtttcctatgctccctcttttccttttgttctccctttctgtttgattcccatgagaatctttttgaggaaaatctggcaagtgttaggcatgattgttgtttttccttgtgacatggagagaagagaaggatgtagaaaggagaaaagcgtagggctcatgttgacttttaaagttcaaattaaattctggagaaacctagtaatttttgacaagactttttgagacaaaaacaaggaaagagttcatttaaagatcattaagccaggatctattagtctaggcacatgtttccaagtttcttttttctctctctctccgctggacactgagttcacattctgagcttatgccattctgccagtggctacattgtgtcatttgyttcccttgcagagagtgtcaatgaagacctcaaagtctggagaaaaatgacctttcatggaataagaagtatacctccttctacatgtttttgtcttactgacctctgataactggaacacatgactctgggtmtgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagtaagtaaactggtttatagactacatctctgaaatggcctgtcctagagctagagatttgtttatatcctggcagaaagatctttgcaggggaaagaggaaataccactaatattggtctctcttaatctgctctgtggttttgttggcatctaagaaatatcagtagggaagtcatggcttagtagggggcagttagatcatcttttgcccactcacaaagaccagaattctgaaaattgcagagcagcatggaattctcacaaaaatattatttaggggctatttttatgtccttgaaatgacactgagaggagagggagccaatccagggaaaagcagacctgcagagcagcmtaacagcatcagtaaacaagagcagggtgtgtgtgggaggctgaataatgaaagaaggcaggatgacacctcctgccacgcaggtaatatgagacaaggacaacgatcgctttgctgccagaagtgacagttgcccaggrcttaataaggctgattctgtttacttctgtattgtctctatttttatctttcccttgcttctttttctacccacctgcatccctactccctggacctgccatttaattccacccacccattattagtccccagtgtgatcagacagatgtaaaacctcccatcaatacttgcattccttcgcttctcttcaatgtcaagattatatattctgaaagcacttcccaaaggggatggatgtggagtgcccagtgtggtttcatgttgaccttcttgattgtacttggaccctccatgagactggtcccacttcaaaggcctagggccaccaggcatccacccacatcctcccagctcagcagtgttagccaacacttggcacagacactcattggaaagatgaaagtggtgggactcaagccatacaatactgaattggcaaatgtgtgcatatttcagaaacaacagcgctcttctgtgttacaaagaagatatatttaaaaggtatactggcaacccgtgcagcctcctcttcaagcctattttctcttgctggctgccattaacatgctgaactccccccagtgaccaatgaagtcactgctcaaaaaactcttcttttctcaggtaatgtctttgatggcaattactcatccacatcttttccagaacattaatcaacttaggttgacgcaaagcacaacatgttcctggtacattttcattttctgggtaagatttttgtcctgttttcagaaaccccttctttcacactcctctgcaaatcagttggctgaaaattacactggttttcatcttcttactaggaaaacaaaacaaaacagtaatcaaagatcacataagttccctaaagcctacttccactagaggtcactagtggccagttatttattttgtttgcatcattaattgctttgtttcacagacatcaaattcagaattttaggactggtgactcagttctattayataactccactggttagccattaaggctggcaggtcccttgtcattaggatcatcgtccattcattaagctgtccaaatagcatctcactctaccaggagttctggagagccaggagttcgtgtgtcttcttcatctactaacttttaccacatcttacttcttccatttctctatctgtaaccctctcatggaacagaagaagaatggtagcttgtaatttacatatatcaagtttgaggttaccaatgccagcagctccttatcttccttttctgattagcacatggaaccaccatgcctgctctatggcttacatccctgttagctgcgtcccatccttccctcagatccagccccagctattcctctctaggcctctcctaatgaccttggatctcagtaatcaattccacttctcaatttctcttcagaaacgtagaacaggaagggatcgtctaaattgccccttccaacttccagcacagaagattgctgaaaaataggtggcttctcctgcacttgcaatgatgcgaatatggtgggtttctaatatttttacctgcttctcaattttcctttggtaaattgtccctttccattgcataaaaccttgatggcatctccatcaaggttccctactcatgagtgcccactacccttccctatcagtggtgggggagagaagaggtgaacacctggcccaagcttgaaaatcagaagtttttccccagtagttttaagaaagatatcagcagggggtgatttatcatgaggacggtgccccaaagaaacagtactttacttcctcccyctctatcattgtagctgccttgatcactgctccttttaaggcctggtacttcactttctccttcaaataagtgggccacctctaatcttcttcttatagctattattattattgtttgctgtacttattcagactttttctgttgcttatgatcaaagaaccctgacaaagagagagcattttcattgttgggagttcaaattgttaacatgttcctctgcttagccagatgaaatcttactttgtactttctacctgttgtctctgttctgttctctgcccccaacaatcaaaagagtctaccctctgtttctacaagaaaaactttaaaccttttgaagataagcaccaggcttcacctctggcttgtctcatcccagctaaacatcttagtgaccttgggtttttccatgacaaagaaggagcctgtgtctgggaaaggttacagcacctcatgttgtagccatcaactgtcagatctggaaaactcaattttgttggtacctgagaaatgctatccaaatcatgctatccaaatacaagacttggaaatataaattagattaaaacacgatgtactgatttacaatgaaaattataactcgtacggatcagaattcttgtgtgtttcatgctgttctcaagtctgtttactcagtctttctttggataagaaatacttttattgattaggtttcttcctcctccatgacaatcacattccagcccttcctccctgagattacatctaactcacctgcaaagtcacccatcaaaagataatgtcttggtttaggcctgtactggctaatcccactcataygagtggactttattggtttaatcctcaaaggacaatcttgtttctgcattgttagagaaggcttcattgaagctcccaggtatggcctacactcttatcattctgcttaccmtcctttggaatagtcctaatttattattgtaatttatcattgcccaatactcagaccaattgcttagaacaactactaatactagtcaaatattctatgtttttaaaaaatcagttgtccacatttatcttgtgatgtgctaaggcattcaggttgaatcaagacttgtaattagataagtttaaattttttaaagtgtattctgccacattttcaacattgcaaaaaaaattattgtctttaagccctcattccagaatatgtcttttaaacatcatgattctgtcaaatatattacttagcactttcagctttgtggaatccaaaaatgtggcaaacaagcctccaatccttcccccaaagccactcacaaaaataattaaactttactagattttactgtccagtccatgtcctctttttctaccagttactacaaaatactactatgaaatgttttgcccttatgtttcactttgaaaatgtgactactcaactcagtatcctctccaagttcccaaacatacctttaagttttgtcttttcatttcaagtcctttctagaccagttttacctgataatcacttgtactaacttggctttcctcccaggctactccaagagagattgtctcatccactcatccacttctcccacctttccattggtgctcacctcatgcccaaccgatccacccgccttccagttctctttatttttcttttaacaatgaaacacaccaggcacacagaatcacccactttaacatgttaggtacaattgaaaatccctgcatgtctctttttaatccaattctcctccctcatgcctcccaaggtaaccaatatcctccttgtggtatttagctatgcatggttgctttttgtttttgtttttgctacacatccatggttccaaagtgaattacagcatagtattttgtatttttaaactttatataaatgttgtcatagggctcaaattacgtttttgagatttgtctatattggtacaggtagtttcaactcatttatttttgctgaggcagagtattcccttatgtgaatgtgctacaatgtatccattctttttttggtttatatttattatttaaacagtgctacagtaaacattgttgtaattggcaattttggccaattatttctaaagttctaaatacttgtaattgccaagtatttctaaagtacacaattaaaagtgaaacaacaggttttagggttttgtgtatttgcaactttgtgatataccaacaaattgctttccaacagggatgtgccagtttacacacccaacatcagtgtatgaaagttccagttgctttatatcctcaccagtgcttgcttttatcagattttaaaagttttttttaatctaagtgaagcagcatgtaattgtttaaatatacactcctctcattattaccaaggttgaccattttttcatatgcttatttgctgtatgccatttgttttcctctgaaggaagtgcctaccactttacttccagtgaagtatctgtttatgttttttttttcttttttcttttgtagtcttaaaatcttatttttattaacttggactattttgtatattcttgtattagtcctttgtcacctatgcaggttgcatatctcactctgatacacagtttatctcttaccttgtaataagtcttgatatctgataggacagtattcccacccttctttaacactgctttgtttttttctgttctttaataattttatattaagcttctcctgttttctgaataattctatcagtatcttaactgggtgttattataactatagattaatttgaagaaaattaacatcattatgtactactgtctttatatctatagacattacatttctatccctttatttatatgtttttaaatgttgctcaaagaggttttatgatatttttcctaagaatgttaatattatacatcttttgttaaatgtataagtgttttatatttttttctgagaatataataatattcttttttaaaattatattttccaattctattttcagttggttataacataaatgattcttgtatggtgatcttatgttcagcaaactcactcaactctcttactaatcctaataatttgtctatatacattttccagtttattcaacaaatatttattagttgtctactatgtttcagacactgtactggatgctaggatagaagggtaatcaaaaaagacaaaaaaaaaaagccctctgacatcatccatttaattgggtaagacagaaaataaacaaataaataaggaagatatgtagtgtattagaagattataagtaagtgctatgtagaaaattaacgcagagggcagtgacaggatatcggaggcttgaaatttcaaatagggtgcacaaggtagtccatactgagacaaaagctgacatttaagcaaaacttgaaggagatgagagagcaatacttttgggtacctggaggaaatcatttcaggcagaggaactattaagtacaaaggtcctaaggctgtagactggagtttctgaggtcagtgtggctgtactggagaaaatcatttcaggcagaaggaccattaagtacaaaagtcctgaggttgtaggctggagtttctgaggtcggtgtggctgtagtgaagggaacaatgtggaaagggagatgaggttaggagagaagtggaggctggattgttggagtcttgggcagccactggagagttctgagcagaagtaacatggtctaatttttctattcctgttttgggaacagtctgtggaaaggcaagagtgaaatcagaaaggccagttgagtggctactgaaataattcagataagaagaagcagaggttctgaccatcatggagcagtggtggtggtaagtgttcagatgatcctggatgtattttgaagataggaccaacaggatttgctgaagtatgtgcatgtgatgaagagggggaggtggggggaagggggagagagaaagagagagagagagagagagagagagagagagagaacgaacttaagatttttggcctgaaaaactaggatgataaaattgtcaataattaagatgaagacgaccaaggaaggaaggaatttggaaagggagggtgaggggaagggagtgtaggaagaatcacgagttccactttacatgtgtaaagtctgagctgtcagaattctgagtggagatgtgcaagtattgtatgtatgagtctggagcaggagagaagtctgggctggccattataattttggaacttgtcagacttgagactgagcgagatcaccaagggagtgagtgcagacagaaagtaaaaagtccaaagactgagtccagtactcagaagttaaggagatgatgaaggactaggaaaataaactgagaagaaatatccagtaaaaaaaaaaaaaaaraaagaaagaaagaaagtcagaaaatcatggtttcctgaatgccaggtgaataagctgttgcaaggaaagagtgatgtcaaatgccactgattggtcaaatgagatttgtcactgattggtcaagactgagaattgactgaggttcagacacatgaaggtcattatgactggacaagagcagttgtcactggatgggtcagactgaaagccagattggagttagtttcagatggtgggaagagaattgaagaaaatgagcagtgacaaccctgggcattttcccataaagatcagagaaatgggctggtatttagaaagaatgagatggggagagaggagagaatcaagaaaaaaataygttttaaatggaagaagcacattccttgattattttttatgtgtaagtcatcactttaaaataattatagttttgtttcttcctttccaatccttattctattatttgatttctttgtctcatatcctgactagctctccagaactagattgactagaatgagttatccttctctctttttatttaaagagaattttctgacttttcagtgtaagcataatgtttgctccaggcttttggttaatgctctttatcagattaaggaggttcccatttattcctgtttttctaagaattgtttaattttatcaactgatttttctatcctcttgagataatcctattttcccctttaatctgttaatgtggtgaattacagtaatagatttttcaaatatagaaccattattgtattcctggagcaaaataaaatttgttgtttattttaatgcattttaaaatttgatttgctatttttaaagtagttttagaactatgcttatatatgagattggtctttaattgtcctttttccactgtctttacctagcttygacatcaagttatayacagtagtttcataaaatgagttgagaaatgttaccacattttgttatctgcaagagttttgtaatattgtgacctaatcctcaaagatttcatagaacagtataaaactctctggcactataaatttgtgtattttaakagatttttaaactactgattcaatctttttgaggaaaattaggaattttgcttcagtcacttttggtaaagtatattttctaagcaattttatattttatctgagttttcaagtttattagcatcaaattgtttgaattattattttttggcagcttctgtattcattgatatcttaccmatattttcaaagctttgccttctactttttaaagttttgatttattgatcatctgtataggatcatttcaaaatcttattaatttctttttaagtctttactactttactttttgtactttctgtagctttattctgctgttcttttttttagtctcctcaattgtataattaggttattgattattttaactttcttattttccaatataagcatgtaagaccataaatttcttgctaagtaacatttagtatcattctrcaagttttgagatatgtttttattgtaaattctaaatattttcttagttttattgtgacttcctctgactcacaagtaatttagaagttagttttaatttccccaagaatttttataatctttttgttgttaagttaaatcttaactgcatgtagtcagagaatgtgaactgcatggtatcagttatttygaagtagttgagacttgctttgttacagagtttatggctaatctgtgtaaattataatagctaatacttatgtagcacttattgtgtgccagaaactgttctaagagcttttcacattaatatatttatttaagtaaatttttgagataagtatactaatattccgattttatagatgaggaaacagacatagaaaggctaataatgtaactttaccaaggttgtatagctagtaactggtagaaccaaaaatcaagcccagaatgtgagttcagaagctattcttagccaccaaactatgctgcctctttttttttttttttgagtcagagtcttgctctgtcgagtgcagtggtacaatcttggctaactgcaacctccgcctcctgggttcaagcaattctcctgcctcagcctcctgggtagctgggattacaggtgcccaccaccacacctgactaatttttgtattttcagtatagacggggtttcaccatgttggtcaggcttgtcttgaactcctgacctcgtgatccacccgcctcggtctctcaaagtgctaggattacaggcataagccaccgtgtctggcctatgctgcctctttaaatgtttaatatgtgcttgaaaggaatgtgtattctctaattattggatgtcttaatatctatattattggatattaaatatgttgattaaataactcttgttaatgatattgttcaaattttgtatatcctcaataagtttgcatttgtttggaccatcagttactaacagatatgttttacattttccattataattttgggtttgccaatttctccttgtaattttgtcaagcttgttaggggcttttttattatgtatgcacaagttaaagattgttatttgtttcttggagaacttttcttttcattagtatatactgagcatttttattcctaataagttttgcctgttttctttggagtagaaatatctattttttctttgtctgtctttttacttttacctttctatgtcatgatgactttaatgtaatttgtaaatgttatataagtagattttttaaataatcaaaatagaraatatctgtcttttaattggtaaatttagtcaactcatacttattatgataagcratctatttggatgtatttcttcattttatttgtgttgtattttctgacttttccatgtttatttttatattttttctgaaaatttttaattgattgagtttttatcattttatttcctgccactcttgggactagtgggttgaagattatatattctatttctattattttaatatagttgcctttaacattttagcaaacatactgatgrtatttcatcaattctaagatagacattttcccatattaaaatctctgaaataaatatgtgttttataattgatgacaatcttccaattgctgttggccaggcagtagtcatacatagttgtcatggcctacatgtgcaggaacttgtcatattgttcttcatattgttaccattctaactgaattagataccttgttgttcctaccaatgttgagttaaatatccatttaaaatgttttcaaaactactagactataatgtggcactgaaacagaaacttattgtgtatgcagaaaggcatgcagaatagcatcatggtatataagttttatattagttaaccaatcattgggggaatgacagcaattccacattttcttgcaaaataataactgggcactatatggaacctaaaaaagaatatagtttttgttactgagatattggtaaaagatcacctacctattacactataataagtaatacaattgagggcaggagaaatggacaattctcttagcatagatgaaagaaatttcaaggaaatgagagtctagtatgctcaattaatatcctgtataggactctcttggaggcatgatgcccctcacaatttaactggcagtctcttctctttcttcatgacacacgaaataatcatagatcttctcattgctgccatattacatttgattaattacagtaactatgtctaaagttattcaggaactctgtcctcctcctattcctagaagtaccttggaagactttaatgcccatcttacatgttattaaccagcacttttatttacctgtgtaatacccttgaaactattctttttaaatgagaggctttaaaaaaatgtatagtcaatgcttgcttaaagtacctaatatttccctgtttcttttttcacctttcttttttatttgttttcctgaatccaagttcttgttttctgaagtatacattttaaaagtatcttcagcaagtgcagtggcatgtccctgtagtcccagttactcagcatggtgaggcaagaggatcatttgagacaggactttgaggctgcagcatgctataattgcacctctgaggagccactgtactccagcctgggcaacatagcaagaccccatctttggggaaaaggaagttccttcagtgaaggtctgttaatgataaactctctaaatgcttgtttttctaaaaaagtccttatttttgcccttaattttgaataattacctgaatatgcatttctagattggcagccatttcatttctcagtagtttctattattgctgttatgaaatgtgctgtcattttaattgctatttctttataccgaatctacttttctctctagttaatattttccctgtgcctttggtgttctatggtttcactattacatgtctagatatagttttatttgtatattcctactcaatccttattgtgttttgtgagtttgagggttttatgtcttttttcaattttgtaaagttcttaaactttttctcaaatattaactttcacatctaatctttccttttagaaatgatatttattcactcagttgtgcatccaacaaatatgtattgagtacatactctcttctagcaatattctaggcattgagaacataatagtacaaaaaaagaacagacaaaatcatcgccctcctatccgtcgtattctgtcctattttatcttcaatatttcttgatctattatattttccatctctatgtgagatattatattctcagctctatcttccaatccattaagtctttttttcagctctatccatccacggtttcatccatctactgaggttttaatttctagagatttcttttttaaaaacaaaatttctggtttttaaaaaagtgacttggtcttttaaaataaaaataattattctttatacattgattttgaatatataattttgtaatttgaggtcaataatttcttacctgaaatttttaaatatctaatctgctctgtgtttaatctgcttacatgtgctcatattgccttattttcttgggtgttttgtaatattaaatttttaagttcagcataagtaagattttatttgtgtaagtactgagtggtctgtgttgagtgttgtaccttcaaagtggtttgtatttgcttctgctaggaatcccagcaatactgtcagttctgagctcacttgttgttagtggtggtgatgtcttggctttggagattcttgaagtgatagaataaatggcataatgtatcattatatacacattgtgtgtgtgtgtgtgtgtgtgtgtgtgtgtatgcttttaaaagtggaaagaaggatgaaaatataaaggattattagtatggatgccaatgtagaatatgactataacagtaataactatgtggtccttgttcaatacattattaagtagttgtggaataaatgtataaaaatatcaaccacacatgaaaatgtttgtgaagaagtccaaatatctctcctccctgaaaacataatttatacctagaaaacactgcagataccaccaaaagggtcctagaactgataaacgacttcagtaaaattttaggatacaaaactcaatgtacaacaagcagtatcatttctatacctagtaacattcaagatgagagccaaaacaagaacacaatcccatttacaatagctgcaaaaaactaaaatacctaggaatgcatctaacaaaggagctgaaaaatctctacaaggacaactacagctacaaaacactactgaaagaaatcacagatgacacaaacaaatggaaaaatattccatgctcatggattggaagaatcagtatcatgaaaatagccatactgcccaaagcaatttatagattcaacacaattcctatcaaactatcaacatcagctgggcgtgggtggctcacacctgtaattccagcactttggggggccaaggcaggtggatcacttgaggccagtttgagaccagcctggccaacatggtgaaaccctgtctctactaaaaatacaaaaaattaactgggcctggtggtgcatgcctgtggttccagctattttgggaggcttaggcataagaatcacttgaacctgggaggcagaggttacggtgagttgggatcccatcactgcactccagcctgggygacagagtgagactctgtcttaaaatgaacaaamaaaaaacctaccaacatcatttttcacaatattaggaaaacctattctaaaattcatatataaccaaaaaagagtcaaaatacctgaagcaatcctaagcaaaaattacaaagctggaggcatcacattaccagaccttaaactatactataaggctacaataactaagacagcatggtactggtataaaaacagacacatagaccaatggaacagaatagagaacctagaaataaagctgcacacctacaactatctgatctttgacaaagtcaaaactaagcaatgttttgacaaagtcaaaaacttagcaatgttttgacaaagtcaaaaacttagcaatgttttgacaaagtcaaaaactaagcaatgaggaaaggataccctattcaataaatgactagccatatgcagaagaatgaaactgaattcctacctaccaccatatacaaagattaactcaaggtggattaaagatttaaatgtaagacctcaaattataagaatcctcaaagataatctaggaaacaccattttggacattggtcttgggaaagaatttatgactaagtcctcaaccacaattgcaacaaaaacaaaaattgacaagtgggacctaattaagctaaagagcttctgtttctgtagaagtaccatgctgttttagttactatagacttgtaacatagtttgaagtcaggtaatgtgatgtctccaactttgttctttttgcttaggattgtttttttttttttttttttttgtgtgtgtgtgtgtgtgtgtgtgtgtgtgtgtttggttccatatgaattttagaatagttttctctaattctgtgaaaaatgatgttggtaatttgataggaattgtgttgaatgtatagattgctttgggcagtatggccattttaacaattctgattcttccaatccatgagcttctttctgcacagcaaaagaaactatcaacaaagtaaacagataacctagagaatgggagaaaatattcgtgaactakgcatctgacaaagttctgatatccagagtcaataaataacttaaacaattcgacatgcaaaaaacaattagtcccattaaaaagtgggcaaaggacatgaacagacccttctcaaaagaagacataagcagctgacaaacatgaaaaaatgctcaactttagcagtcatcagagaaatgcaaatcaaaatcacaatgagatactatcccataccagctagaatggcttttgttaaaaagtcaaaaaacagcagatgttggtgaggctgtagatgcagagaaaagggaaagcttatacccagttggtgggaatgtaaattagttcagccactgtggaaaccagtgtgaagatttctcaaagaacaaggaactaccacttgacccagcaatyccattactgggtatatactcaaaggaaaataaattattctaccagaaagacatatgcagttttatgttcattgcagcactattcacaatarcaaagacatggaatcaacctaggtggtcattaacactggaatggataaagaaaatatggtacatatgcaccatggcatactgcacagccataaaaacaaagtcatgtcctttgcagcaacatggatgcaactagaggccatttatcctaagtgaactaaagcagaaacagaaactaaatatgatacttttttcacttataagtgggggctaagcatttgtacaaatagacgtaaggatgggaacaatagacactggagactagagaaagagggagggaagaaggtaaggaatgaaaaacttcctattgtgtactatactcactagctgggtgacagcataatttatgcccccaaacctcagtgtcataaaatatactcttgtaacaaacctgctgatgtacgctctgaatctaaaataaaagttgaaattataaaaaatttttaaaaagaaagtgagagataaatactttcccagacaaataaaaacaaggaattcattggcaacagacctactcaacaagaaatgaaagaaattcttcagagataaggaatataatatattcagacacttttatccatccaaaaaaatgaagaacactggaaatgcaataaagatatctattagaaagaaagagagagagagagrcagaaagaaagaaaggaaagaaagaaaaaggaaagaaagaaagaaaaaaagaatgaaagaaagagaaaagaaagaaaaagaaagaaagagagaaagtgaaaagaaaaagaaagaaagaatttgtaactcactgtaggttataaacccaaagctggcttttagggttatggtatccttaagggaaataaaaataatagctaacatttatctgcacttactgtgcaccagacactgttgtaaatcctttccatgtattaactcattgaatacttgcaacaatcctaggagccagatagtaacaatattctaactttaaaaattaggaaacagaggcttagagagatgagtgattgcctgtgaagagctggtaaaagcagagccgagcccttagcatgggcattctgatgcagtccatgttcttaaccactatgctatgcagcctctaaaggaagggagggagaaatgattacatcctttgccttaggactctccattcttttctttcaagtttccactcccatgccaaattcattcttcccaccaccaactgctttatctsaggtattccctcccttttgccagtgggccattccctgaagactgctttcagagtaggtaagagtgacataaaaggttaatgaatgctgaagcggaggtgtgttgagtgagagtgaaccatcctgataaacaagcctggagcagcacaatttgtggctttttcgttgtcctacttctcccatttgacaccccaccactttaggataaattactttaaaattgacaatggctaggtcactgtgagaatgactctctaagtctggcttgatgggtttgacattaaatagatttggtccttagaagttgctcattttaatatgcacaggtactgacccaatgtcgagcccaaacataaacacatacacatatgtatttcaaaagaacatgatattttctggaatgcaagtcagaaaaaccctaattgcaaagctgatcccttgccaaaatgctttaaatgattcaattataccactaaaacaggttaaaatttttttttgtctttttgaatatttgttaaaggaagcagttaactgtttattcaggttttccccctttttggaggaaatctcattttggagaattttttcttcatgccatgtacagaatttgaagatataaaatttttgaagttgaaaaatctctttgtagtaaagtgctgtgtaataagaaattcatagctttaaggggctcacagtaatatcaaagttcataactgatgtatctatacctgatatattactatattcgctgcagttatgaacaatgtgaagtaatttatctttatggacagctgcttaacttttctagttagaaatcataggatatttgccttatgttcaacaatgtcactgacacgatcctgtacacaatggcttcattcgaaaggcccctttcaaaattctctgataattcattactttcttagcatggagactgagttctagtgttcatgaccaagacacagatgactgtcatgtatttttcattgagttgcaccttccacttttattgaggcttgtttcattcagacaaacatctcattgccatttattaataaactattatttggacattgtttgctatgcttctcagtgtcatctatataaactgttcccaggaaaacagactctgaaatggtgattaccatgcagaacatttataggggagtgctctgagaaacaatacctgttagggggtagatgaagcaggattgggcagaggaaaaatttgcactgtaatgcagctgtgaaaaaaaggcctcaactaatctctcacagggacctctggaactgggatgacccttcagagtcatcctacgacaagggaccaggccttcatatctccatgatgactagtcattggatgcaggttgtccaatgggaggagcaaaatgttgaatgaggccattccctttgaccacagaaaatttctataggcagacttggctacaaaccaacagctgagagaatgagtacctaggtcctggagaggggatttgggcaatgtatcatcatgtccactatagtctaccccagaactgttctaaatggtatgctttgtataataaatttattctatatggaaacagcttctctgataagctgattgatctcttgttctaaggaaatttataataagaaagttagaaggggatctaacatgtctgtgattaactggtttccttgagggatggtgccattcttcgggcccagcattagcttctgttgctgtcaggtttcacatcagggcagcgttgaatgatgcataacttctatccctcaccatagctattccatttacgtgcctattggatcacactagagtgactgatgacagaggcttgatgtcatttagataagtcattctctctactttgtgttttattgcctcttttgtgatgaatgctctcatgggcattaacatgggataaaaaagatgtttatactttgtgcccaagtcaagtgtccaccactccagttcttatcaaggctgcaattggtatgcatcatctctgtggtaggctgaataatggcccacaaaaaatgtcctcatcctaaaccccagaacctgtgaatgtaatcttacatgggcaaggaccttttcagatataatataattaataatcttgagattgggagatcatcttggattatgtgggtgggcccaatataatcaagggtccttataagtggggaaacaaggtcaaaggtggaagaaagagaggraatgataaaagcagaggttgaagtgatgtgctttaaagatggaggaagggaccatgagccaaggaatgcaggtggcctctagaagctagaacagattaaaaaaaaaaaaaatgccctcagagcctccagagggcaccagccctgctgacaccttgactttagtccagtgagactgatttttkacttctgacctgcagaactttaatttctcaacacaaattcttgagccagtaggtatgtgataattatttgcaactataacaagaagacaaatgcagtatccctcctttacaacctcttctggatttccttcatcttcagctagcacctctattaatctaagttgcttcctagttgagttactcagatgcactttcttgagggatctaagtccctggactccattcctttctcaggttgtgactgctccattgtccatttaccatcaaaattgggcaagggagtaccaagagatatctccattgtgtaacagcagcctactgtcttctaatgggcatggctaattactcctgccaggttggcaactcctttcttaatctgctggtccccttgacacaaagaacctgaggtgactgggctgttgggctcatgtattctacctgcagggaatacagtaccatgcagtggtcactgttttagtatgtgtactgccccttggagaatggtgtttcatcttaacaggatataaggttgagtggcttctttgcaagcctgctccattgattcatcagtctagcagtattggggtgggggcagaagaagttatggtatgtgatagaaccagtgagtcccatgattatgtgcctactgctgtacatcctttgctataaaatggttctttggtttgatgcagtgttatgtagaatcctatgtcagcagaccaaatgctctgtgatccctcaaatagtgaatcaggcttaagccctgtgggcagaaaaaaagcaaacccaatcctggattacgtgtaaattccactcaatatgattgatgtcccttccagggtggaaaaggtctaatgtaaataacttgccaccaagtgattgatttgtttccttgagggatggtgccattctgaggacttagcaggggcctctgttgctggtagatttacatcaaggcagtggtgggtgatgcctagcctctatccctcaccatggctactccatttatgtgctgactggatcacactggagtgactgatgacagaggcttggttgatgtcatttggctgagtcattccctctgctttgtattttagtgcctcttgtgtagtgaatattcccatgaacataaaagatgtttatactttatgtccaatcccatgtgtggatccatgcttcttacccagagctccttatttccagtttctcaatcgttcttttttcaggcccttggccattcagccaagccatttctcttgccacacaaaattaacgatcmggtgcatggctgaagctctgaccgttgggagaatgttctctcatttttgtctttcagggtcaccctgagtaggtctatacataagagaagtcaaattttgaatttcacccacatacccagccaacccatcagtaaaccaagttgagacattttcctcctctgtcagctggccatgagggaacccctcatgtggccataagtgtcacctgagtgtaagatgttatttctatagtggttgatgacacaggggtccgggtcacctgttcacacagcttatttgtgcactctggcttttttcatgtctggtccaaaatgtaccacttcttagtaaaattcttgaacttcaaaacttaagaaaaaactcaagcgtaatatgagctaatatgacatgtttaaggccaaatgtatctatcatatcactttatataaatgggtaaaatgcacctatttttttaaaaagacttttagattagatcaccgggcaaaatctagcaaagaagagacatatatttaatgacttaggaaatgatttagaaaatgtaaaaataggctggacatggtggctcacacttataatcccagcactttgggaagccaaggtggggaggatcacttgagcctaggagttcaagactagccagggaaaaatarcgagactccatctctacaaaaaaaaaaaaaaaaattaaaaaaattagctgggaatggtggcatgcacctgtaatcccagctactcaggaggctgggataggaggaacccttgagcccaggaggttgaggctgcattgagccatggcaccactgcactgcaacctgggtggcagagagaacctgtctgaaaaaaaaacaaaaattaaaaattagaaaatctaaaataaaaagatgcaaaattaaacaatgatttacttgactataaaacacatgtgaataattcaaattaaagcaaatcattttgatgtttaccacaaaaccatatcacatattcaaacctaatatataggctatttctttttttttttaacaccatgccaaattaacagataaagcacaggaaataatcgtttgacacagaaaatcaatgctgagtcaaaactaatcctctttgcttaaaattgtgagagtttgcccactcatttgmtaaggcagggccctctgttctcaaatgaagacytgtgaagtctacatgtagctccaccatgcttaaattgttgattatgataaaatggtttggacccagacgatgatcaaggacttctgtatactctatgtactaggcatattttttactattaagaatcgttgaatgatgctactaaattatttcctagaaagttayagaaagagagttaacaaccactcacttgatacaatataggttgtaaaataaattttaaaaataagaataaaataggcaaatgatatgaggtaaatgtaaaccaaaaggaacagggatcatgttctttagtcagataagaaaaaattcatgccagaagcattcagtaaaataaaggcactttgtttttttaatggatttagttcacaagagttataaagattaagaatatctttatgttaaattacatagcaataaaattcataaagaaaaactccaggagataccagtaaaagcagatagacacattagttgcaggaaatgttaattcacttctgttgagccactgtaaggtcaaataataagtaagattatagagagcttaaatcttccaaaatcctttatggacttagcataaaattgatacgaaacctgacaaacataagaccaaatattgacgcaaaaaaatttaaatgaaatactaaaaacagaatttagcagcaccttaaaaaattatttcccaagatccagtacaacatgttccaggaatgcaaagttaactaatattgggaaatttgtttctgtaatttatcatattgatagatctaaggacaaaaatatttgatgtacctataaatgctaaaaaggcatttaatgaaattcacaatttattctttatttaaaaataaactcaataaatagcaatagactgatacctctttaatattgkaaattataatattataaaatctctcacccaaaaagccagcataatgcttactagggaaattaaatcaaatatgtaaaccttgaaaatagaaagtgatgtattctatatgatttaaaacatttactgtatttttttgtttgtttttctggaccataaaattttatgccaaaaatcaagaatcaaaactaggaactaagctagcattcttgttctaatcacttttatgtgaaatagcatagaagattctagccaacataataagccatgggatatataaaatatatagatctcagaaaggctgcatgaaacacaaaaatctttttagaaaacccaagatgatgaattgaaaatttatcataattaagtgtagttaagctaaagagcaagttacaaaataaatacaaaaagcacgacatggtggctcatgcttgtaatcccagcactttgggaggccaaggcaggcagatcacgaggtcaggggattgagaccatcctgactaacatggtgaaaccctgtctctactaaaaatccaaaaaattagccgggcgtggtggcatgctcctatagtcccagctactccagaggctgaggcaggagaattgcttgaaccccagaggcggaagtggcagtgacctgagatcgcaccactgcactccagcctgggtgacagagtgagactccatcaaaaaaaaaaaaaaaaaaaaaaaaaggttcatttaatcagcaaaaactaattaaaagttctaatgagaaaaaatattttgttaacaacaacaaaaagacaaaatacactaggaaacatggtcaaaaatttgtgaagctcaatagcaaagacatggagtcaacctaaatgcccatcaatggtacactggataaagaaaatatggtatatatacagcatggaatattacacaaccgtaaaaaagagcaagatcatgttatttgtaggaacatggagttggaggccattatccttagcagattaatgcaggaacagaaaaacaaatactgtgtgttgtcactttaagtgggagctaaatgataagaacacatggacacacagaggggaacaacacacactggggcctatcagtggttagatggtgggaggaaggagagaatcagaaaaaataacgaatgggtactaggcatgatacttgagtgacaaagtaatctgtataacaaactcccatgacacgagtttacctaaataacaaacttgcacatgtacccctgaacttaaaataaaagttaaaaaaaaattctgaagcttacatagggaaagttgcaaaattagtattgtaaaagaattgagaaatggcagacagaaaagacagccctgaaatagaatctgatatatttaaaacaattactaggaaatgaattattcactaaatggtagtaggaagattaggttagctatttagaagaaaatgtacatttcwacttatttccataaataccagatagatttaagagctaagcaaatggttaaaagatgaatttctaaagtaataaatggtgagtgttttgtgaagttctttttaatctggaaaaaagtagagatgatttttattcaaattttgaataaggaaaacttgaagttaaacaaaaatctgttacaggaatcacacagaaagaaaggagaatgtgtggataatatctgcatgtgcttagaatgcctctgtataaacataaggatttgctgagcctggctcccgctgaggaaggggactgggacggatgaggaacagcgctgacagggagattaacttttaactgtaaaccctttctttgcatcttttgaatttttgtacgatgtttatgtattacctttcaaaaaaatgtaaacaacttaagtttccaatttagaaaaggaaaaacaataaggccccaaaattgacaaatttaattacctaaaatcttaggatgtcattgaatagcagcaaaaaaactaaaaataatgaaacgtagagatatatttgcagccaaatgtcaaatattcacttaatacccttaatagaaaaatatattgtaccaaagaaggattaaaaaaaaaaaagatgaggtcacctaaagaaaaatatatataaggtaccgtgggtagttcccaaaggagaaaatacaaacagccaataaacacagaaccattcaacctcacttttgggcaaggaaattcctaagcaaaacagcgataagatactgtttctcactaatcaaattagaaatattataaatactctgttcttgtaagtgtacaataaggagatcattctattacccagctggagggagttcacattcgtaaaacctttctggaacatagttcarcagtacctattttgagccttaaaaatgtgcctgtcctttgtctcagaaattttcacttctggaggctctagtatataaataatttgcaatgtagagagagcttcatgcacaagatgtttactgtcctattagttatagcaacagaaaattgttacagctggagtttgctgtagtgccgaaaaaccccatcacttcccatctctaatctcacatgatgatgtcaggctctaaatactttcctgctctattatattttcagttttgtgagtccaccatgtgaagttcacagtcagaccaattwtccaaattaatgcagtgggtctgtttttcacatttagatgttttggaggtcccattatttctcagtaaagatgatcaggtatttgagggagaattaagacaggggaatggaggaaaacctggttggggaaaggtaaaatgggttttgtagttatttgagttgaaaagggagagatgaaatgatgtgttccattatgtccagaaagagggagaaaactaatgaggggaaattgaagggtaatttgaaacatttcacaaaagttgctgaaatgtcagagtaaaaagtaacccctgccctgtaatggacttagaaactgaaatagtctaaagattaaacccacttgcaagtgaatagttaagcgcctgtgtactctcagggatccctgtctaagggtgatagtagaacctgctccattttagcatgtttgtgtatctgcctcttccacaagattaggatctccaaggaagraagcctttattgtattaggctttacaccctcaccccttagcacacagcctggtgcacccattttctaaatgactgagttagtattttrtcctttgaaggataactttctagagtattatttaacatgaagattttctttccaaacaggattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacaggtatgtcagtgttcaacatcaggctatttgatactgagttggcagcctaggtgaaccygtgatgtctgtgaaccaagagccaatgcttctgcagcatttagatactgtaaaaagacactacaagccatcaatagctgggagggccggtaattaataaactgagaaagttctgtagagctcctgctacgtgcaagacacactgtagggaattcaagtaataccactgcaagcctctaatctgtttggagagtatacatataaaaagttaacaagaaagcaatatgtgccaagacccacaggaggagtactaaaaaattcagaagaggagatctctttcatccaaggagaacacagtagaagcagaaaatgaactgaggggcagtgcgctcgggacctagcagggaaagtgactaagtcatttcagacatatttctatatgtattgagaatttttcatgatgatatttgcccgttctgaccacagttaattatttcctctggtataaatgtgaatttggagttttggctcagccrctaatgagttgtgtaacactgcgatattgggcaagtcacttacattcttaagccacagggtcctctatgtgaaatkcacattaaatgacattgtctatgacaaatttaccaaccagagatgttgataggtgtttctcagaaaagaactttgtgatgaaataagttggaaaacaattcttttttcccttttgaatgatcacaatgtttcatggcatactaaaggttctgtaaagtactgcaataaagaaagctggttaaccttgtttaggccagcattttccagtctgatttcactatgaaacctcctttctcctccccactcccaacacaacactatgaacatccctcagaacctgtgttccactgagcacaggtcaggaaattctgattatgttaaaatgcttagcagtgcatgttgcagctgatatgagcgtcctttattcttcttcctttttttcccacagttgtttatgattaactggatcatattttaccttgtctgctcagtctaggaattgatcaactgaacaaaagactcttcatgcaccaccacactgtatctctttcatccccagggttaagggttggtggggagaaaatgaggattgcagcaaaattaacaaaagatgaatagtgcttgatggaacaccaaagacccagtgcatttgctcttcattggttatcttggtatattattgatatatatcagaaacatagattatttcactccaatgtgcactttaacagacattcagacaatttaaccatcctatccatctccccctgcaggttcaaaaccactcgtctttagggcagcactatcgaatagaaatctaatgcaagccacaaacagaagtcaaatatgtaattttaaatgttctcgtcccagggtgagtgggggaacaaaggtgaagagggagaaaaagaatacgaatatatttattaccactgaactgtacacttaaaaattgcaaagatggtaaattatatatgtatattttatctcaattaaaaaattaaaaaggaaaaaaattctagtagccacttacgtaaaaagaaagatgaaattgattttgataatatatttcttcaacccattatatccaaaatagtatcacttcaacatgcaatcaatatagcaatttttaaaatttatttatttactattattattgttgttattatcattattattattattattttgagatggagtctcgctctgtcgcccaggctggagtgcagtggcgtgatctcggctcactgcaacctccgcctcccgggttcaagtgattctcctgcctcagcctcctgagtagctgagactacaggtgcctgccaccacacgtggctaatttttgtatatttttagtagagaaggggtttcaccatattggccagcctggccttgaactcctgaccttgtgattcaccattttttttacacaattcttacatatctgatgtgcattttagtgcatcactaaatggactagtcacacttcagatgttcaagagcatcccatggtcagtggctcctgtgttaacacagttttagagtaatcagataaagttttctgggtgaagatcatgtttggaaggtttatgagcagtgagcaggaatttcactagataggctaagtagagtgagaagacagtctacacaggaaaacagcttgtgcaaaagtacagatttgtgaaataagaccaagatcagagaatcgtaagcatgctacctttctcaaatgcccataattctaacatttatgttagatgggatgttttattctgagtaaagcattgtgtctcctacttaaaagggatggggtatggtgtaaggaattaaatgtttttgagaaattgaaatgctcaactcattgatgatcaagacagtgtaaatgagtttgtaagattgtagagagcagggttctgaggtcaagggttgatattttgggaagygaaagagaaaaggactgaaggctagtaggctccttggttaagagggacaagttaggcagagaagtrggtaagtctagcatgtagggccggtgtagggatggggtgtccattgtaggccctcagaaggaggcagaagccactaaaatggaaagcctgaaggcctaaaggcaaacttgctttcagcaaagttcagcatcttgtcctggccacccctggaggtcccagaaatgcagcaccaggaactaaaggcaaacctggggtcatagcatttatatttagctatcatcagattttaaagggaaatttttggcttgcagtaaacattgaaaggatgattttggtattacttgtaatttaggatcctgtggggaacgtgtagaaatccaaatgactcattttcttctattttttttttcagtaaaatgaaacaataggccaactttcaaaagttagacactcagcatttttagctttacacaaaatggaaggaaaacaaacaacaagaaatgagtgattgcctctccacccatcccatctccccagataagcaacccagggtcttactgtctgatcaggcagaggcccagwcatttcttcttcctgcacccttggccatttcatttgatttttttttttctggccacttcactgtcattttaagctaaatgtgtacacacacacacacacacacacacatacacacacacacacttttctttttgtcccccagatttcctcttgtcggcctacgctcaaacctacttcaggtgaccattccttttcctcttttagttggtaattatacttcttttcttggtccctaaatttgtgaacttgccacatttaccttaaaataacttttaaaaattccagaactcaccttctactgattttgtattgaggaaactcaatacaaaatcggtacatatatgggacatgcacttgtgaatttgttttttggccttgggccatatgtttctacacatcctgtgtcrttagacaagtctctcaacttatgtgtaaaatagagaattgaatcagatcaccttccatgtcatctcccagtctgaaattttgactccctgaggagactctaagaatagaatagcaaagagctttagagcttgaaggcttccgtgtcatttggatcttggtcttatcaagatgagagattggcaaagtattttctctctctaaatctctgttctgccatctctaaaattgggataacaacacctcctgctcgggactattatgaaagttaaaaatgatattacatatacggtgtttacacagtacaattgctaaatagtaagtactcaatagaagtagtggtttgtagctagcaaattaatccagtcttgcagggcaaygaaaatgagcatccagctggttccattcaagacatcaaactactggagtttagtacttccmattggtggtggtaggtgcacatgaagaggatcttttattacaaaagcgatctctatctgtgctctagccactatgtggaagtacctaattcaaagtacagcttacctagagttaacagcttcctctaaccctctgaccagatatctatatggagttggccatccccacccccccacttttttttgctcctagaaaaatcctaaaaaagaatacacccatacaatgtgtattacgttctaggataaaaacaaacttggcaaacttgattaaaattaaaacgtacctcaaggacattataattattgacatagctgctgttctagaatgaagttctagagaattgaaagttcagccatcatgaagcctggcagccaatgcctggctttatcctcactctactgcagtcacagcctcttcccaagccaaatcacttagcagagccattgccatgtatttaatcagctccacatttcatcttcccccaatctctgctaccactgttgatgactgcatgaagagggaaataaccaaagcaggctgcctgcagggtaacaggggtaatagaataatctccagatctgctgctggaaaatcagaaagtgtctacttttccctctttatagaaggacctgctgttccttctccttgatgccgcacagtcttctcagttcttcttccccagtcaatgtaatatgaaggtttaaactctgcccttgctagtgttgcatgtgaagtgcctcagacagtggagagcatttccttcacaactcttagagatgggactggttatgccaatctagcagtttattcagtaggcaatcccagctctgctctgtacctgtagtgtggtcttgggaaaattaatctttccaggccttaattgtctcatatgtaaaatgcagatattaagaggagctgcctcatgagtttgctgtgaaaattaaattaatagactttaatagacaaaatatttagaacataggaagttggtatcatcatcattatcattatctgcaggagactaaaataacactggatgctttctaacaagctattgatttaattatgtgttatagccactttttaaatatcctgtctctcctttccccaaattataagctcttctattcactgaagtaatcccagcacgtagaatagtgcctggcatatagtaggtgctcaaataatatttgttgaatggttgagtgaaggggctcaggagacgtggctgccctctgactttcacagcagctayatttctctccagaataggcttcagtatctaatgctcatatagtggcaggaaatgggaggggactgggatgtacactcccaggttcctgagacctgctccctattacctgtcagaaaattcactggggaaacttagcttgtgtgccaattagattttacatatagctatgctgggaagaatgaaccattttatatgtaaatccaaaattggtttagctttgattgataatagtgaatgaataatcaaggaaccctattttaataaatgargtttaatatttcttgagcttaatcattttttatggttcttacttgaattcaaggcctaagagccaaagagctttttagttgctattacctcagatagatatctttcctacttagcttcattcttttcaattttaaaacactggggaacattcccaaagtgcattttcaaaaacacaatttccaccaaaagttcaaattggtgctaatctagtttagaaatataattcttggcatccgtagaacaaagctctcttgtttaacctctacagctaaattgtccccacgagaaagtctatttctatgctgcacttcgctgaatttgttccctcagcaccaaactgtaagatgatattcatccaacatgctcacatctgcactgagaagcaaggtctttcataggctctggcattatcagctgctgttaaagtcatttgtttgtagaactgtaatcatagggctttctctgcatgcatgccattagcatttctgtgacccaaataattccagagatgaaatagtttcatgggcctgagatctcctcctttaccaactccttttgctgcccttgaaagtgaagctcagccactggatgttgtttggtacctgttaggtccatgggaccctcgaacccaagaaaatgcaacccaagaaattgcataggtgagactgagatgtttggggaatacccaatgctctaataagtaacttttttgaatgtaagtcaagggagcagggacaggatatgatcataattgagaaaaatgaccaaatcaattagcttttctaaacaccacatgtttgatcagtatgttaacaaaaagaggatgctcaatgttgtgtcattattttggcatgtttgtccagcaccactaggaaaaatactggatctgatgaatggaaacttccaatgagcagagaaagggattcagttatagggcaggagtgttcttttaatcaggtttcaccgtggtctacctgaaatatccctcaggatctctctctgctctgacctgattttgtgcccatgagtggacactctagtttctaatctgtctcctaggtatcctgaaaatgtgaaagggataccctaagtctgacctatgaaagcctctcactggggttgagtgcactggcatgcctggttatgtaccagccttttggaaatcctttggtgtgagttagccttagtgggtccaaacaattttgtgtgttccaaccaagcacgtgccctgacttctaaagctgagcactaacctctggggaagggagcagccagcctctcagagaggtctcaaagctcatcgtatcagtaatgatccagtcagatcaggcccaattaaattcactgggaggggagacaatctagacaaaggcattcagggaagtcgtcagaggatactggctatgggctatggttctgatacttccgtgatgttaagaactctaggatggataggccagagacctactgagaggaactgctatatagacgcatgatttatcgycaaagaatagcatcagagctttcaacacgactgacttaatagtgggatatcaggttaggttatggagtacctattttctctgcccagtggtcagattgacccctgagtctggaaaatggatggaactgcaggaatggattaaagatttatcagttctgtttttgtttctagtgactggggaggcagggatgcttaagtgcaagatatttaattggctcatttagaaatctttaggaatataactggcctcaggcacagcctaaggcattgggctcaaatgatattaccaggatctggtctctcagatagaaccatgtttccttgagtctcatacagtttctctcctactgaggtcacaagatgacagcaactacttttgatcctcccttctcaatactttaaatacagcaggagagagaatctctttcacagagccattttatggctccttaattataatttggtaacgtgtccttccttgaaccagggaaatgtgattctctcattgatcagtgtctgagtcacttgatcacctttaagacaaaaggtagagatgccttcattagaagcacctggacagttccacagaggaattagggtagagtctccagaagaagtataaatgtatattgggcaggagtgtaaaaggctgatgatatgaagatcagagaaaaatcatagaatgttattttctgtgacttcaggaaagatttatggactggatatcaagatatgaatgctatcactcccaaaactcattagctctttaaggaacatacatttgagtgccttacatatcccataatatttattttacctgattcccatacttagtgtgaatagacaagtcatcttcctgacactgtcaccaccgtttttatattcttggctgcattgactccaccactgtgtgtcgttgtccttcgtagaaccctaagacaaaggttgtttataaaatgcatgcatacaatatgcaatyctgtattcatactaacttttgcatctatttaaaagaatagctaaaatctgtaattatataactgtgcttcttcttcagaaaagaggtcatatcatatcttgatgaattctctccaaatacaaccctgtaatcagaacccagagcaaaattaaaaattaatgaaattgagcatattttcatgttttggagctttattttgtaacgtgtctgtttaagtcctctgtctacttttctgtttgattgcatcttctttttcttatggattggaagagtgtgtatatatattatatatatataaataatacttttatatttataatatatattatatatayaaaatacatttatccaaaggtttaccagtacccagaacatattatagatatcttctttcactctttggattatcttttcactttttaaatgatatctcttgatgactagaagttcttgattttatccactttatgacttttttattgttaattatttttgagttaggtttaaggaagtccttgcctactctgaggccatcgagatgttctcctgggttgtcttctctgtcttgttttatttttcacctttagatctgcaatctatctgaaattgattttagttatggcagatataggggtggggatatgttttttccccatgtaaatatctaattgacccaattgccccatttctattgctcaggaattgtatgtatcaatgacaatttttatctcatgtcttttcttttgtccttattgtaagatttgatgtataaaggtggagttctacatttcattctaagaatatagttttctctttaagccacagggaaagttaaagaatgtaagtggtcctggctttgcattgtattaatcagggtacaagctcagctacaaaacaaagatctgaatataacagtgggacaagcaacacagaactttgtctgtcatcaaataatgcaagagtaggagtccagggctatttctcccaaacacgctgtgcactgcacagtttttttttctacagttagtctgagaggtggggttgatggccaggtgtagtgaatatgtaccattcatttttaagaaaacaatttgttgaccaaaacattatgtggtagaaaaaaaaagaaagcaatttgtattttctaaatattattccctaatttggtaactaaatgctaataggactactttatatgtaaggatatttatattcagtcacaaagtaaatcaagaagagaattattttaggatccagaatacctttaggttttaatcttacattcatttattttttttcctctgaatctaattagctgaaactttaatttttaagatagatataggcaaaaagcgacttgttcaacattccttaggtttttttctcaagtgtaaatctgacaagtgattcctgttatcagtggcccccgattaccctaaagatcaatgccaaacttcttagccttgtatgccggacctttcataatcatgcccctgtttacctgccccgtctctcccctcacctcccactccagttttctcacacataccacacttcagccatcctgagctatttacaactctccagtgccatcaggtactccctcacctcagtctctgcatacctactcttccttctttctgtctactccctgccttgccagcacccagccatctcttattcatccatgargtcccaactaagacattaccccctccaggaagtctttcttgacattccccaagactggattgagtgctccttctctgctctsttagcaccctgccttttgcccatctcggctgtcatcagtttatgctgttaactgcctgtttgtctttaggtctcttaaacaaaaccaagagttcccagaattcccaaatacaatataaacagggcaaggcctgtgttttcacagctgtactctggtagcttaatccartaaatattttttgaatgagtgaatgaatgaataaatgaataatgagtcacttattatttgtggctttcttatatttcctcagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacrgaagttatagtaaagagcatactccaaggtatggtgcgaaagttgagcttggggacatgttttgggagatatttaaaagtattttcatcaagcatttatggtttgtgggaagcaagacctagagtattagaagcaaattaatttctctgttttgctgccagttgacctgtgaacatgcaaaaggttacttaatctggctgtctgtgtcccttcccaaggcagatgaattacttagactcattaaaagaattgtaagcattcttccaaatctgtgtttctcagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaatattctccttgtcttcttttattttctttggtttcagatcaatcaaaaaacatgtttttgaacttgaagtcagagaacaatacatgatattaattgatgtgcatccaaatgtccccakttctcattaataaagatgcatgaggcccatgagtatctcagcccacagtttactgccataacccaccacatgataaggttgatcgtcaaccctctgtaaagtgctcacagtccaattaattcttagggtccccaagggtgtcctatgtgtgctctcttcccaaggtatccagacyaatccccaagcccatactgctattttgtccatgcttcctggmatagcatggtggggtgctgtcctcttccaccatgcgagcccagcagaccctaaggccactgccatgcaggtcccaggaatggactccactcctgggaactccgtgctgccctgccagtgatggcagtctttgtgctgaaccactggaagctttaggaacaaccaagtccttagcccagtaattcagtgtggcagcctgtggcaggatgggaaagaacactagcctttctcctcagtgttataccttggtagagaggccccagagcagtgccaaactgagttgccatgtttgcagtaacatagatggtttttcagtagaacagaatagagaacccagaaataaagctgcacacctagagccaccatctgatctttgacaaattcaacaaaaataatcagtgggggaaggactccctattcaacaaatggtgctaggataactgggtatctatatgcagaggaataaaactggacaactatcaccatatacaaaaattaactcaaaatggattaaagacctaaatgcaagacctcaaactataaaagtcctcaaggaaaatctaggaaatacccttcttgacaatagccttggcaataaatttatggctaagtccttaaaaccaattatgacaaaaacaaaaactgacaagtgggacctaattgaattagagagcttctagacagcagaagaaattatcaacagagtcaacagacaacctacagaatgggagaaaatttttgcaaactatgcatctgaaaaaggtctaatatccagaatctataaggaacttaagcaattcaacaagcaagaaacaaatagccccattaaaaagtgcaaatcaaaaagttagaaagatctcaatttaacaacctaacakcataactaaaagaactagagaaccaagaggaaaccaagtccaaagctagcagaaggcaagaaataaccaaaatcagagctgagctgaaggcgattaagacacaaataaatttaaaagatcaacaaatccaggagctagctagactaataaagaagrtaatagagaagctccaaataaacacaaccagaaacaacaaggtgatattactattgaccccacagaaatacaaacaaccatcagaagatattatgaacacctctatacacattaactagaaaatctagaggaaactaataaattcctgggcacatacacccttaagacctaaccagtaagaaattgaatccctgaacagaccaataatgagctctgaaattgaatcagtaataaatagtctaccaatcacaataagcttgggaccagacagattcacagctgaattctaccagatatacaaagaagagctggtaccattcctgctgaagctattccaaaaaattgaggagragagactcctccctaactcattctataaggccaccatcatcctgataccaaaatctggcagagacacaacataaaaagaaaacttcaaggcaatatccttgaacactgatgcaaaaactctcaacaaaatactggcaaaacaaatccagcagcacatcaaaaagcttatcgatcatgatcaagtaggctttatccctgggatgcaaggttggttgaacatatgcaaatcaataaatgtgattcatcacataaacacaactaaagacaaatccaatagatgcagataaggcttttgataaaattcaacaccgcttcatgttaaaaattcccaataatctaggtattgaagaaggatacctcaaaatagtaagagccatcaatggcaaacccacagccaacatcatactgaatgggcaaaagctggaaacattaccactgaaaactggcacaagacaaggacgccctctctcaccactcctattcaacatagtgttggaaatcctggccagagcaatcatgaaagagaaagaaatatagcacatccaaataggaagagaggaagtcaaactatccctatttgtagatgacatgatcctatatctagaaaatgccatagtctcaacccaaaaagctccttaagctgataaacaacttcagcaaagtctcaggatacaaaaatcaatgtacaaaagtcactagcactcccacacaccaccagtagccaagctgagagccaaatcagaaatgcaatcccatttacaagtkccacacacacatacaaataaaatacctaggaatccagctaaccagggagttgaaagatctctataaggagaactacaaaacactcctcaaagaagtcagagatgacacaaacaaatggaaaaatattctatactcatggataggaggaaacaatatcattaaaatggccatgctgcccaaagtaatttatagattcaatattattcctattaaattactaatgacattcatcacagaactagaaaaaatattttaaaattcatatggaaccaaaaaagagcctgaatagccaaggcaatcctaagcaaaaagaacaaacctggaggcatcacactgtattacttcaaactgacttcaaatagggatatagtaagcaaaacagcatggtacgggtacaaaaacacacgcatagaccaatagaacagaatagagaaccagaaataaggctacacacctacaactatctaatctctgaaaaagctgacaaaaacaagcaatgggcaaaagactacctattcaataaaaggtgctggaataactgcctagtcatatgcagaagattaaaactggaccccttctttataccacatacaaaaattaactcaagatggattaaatacttaaatgtaaaacccaaaactataaaaacgctggaagayaacctaggcaacaccattctggacataggaatgtgcaaaaatttcatgaagaagataccaaaagcaattgcaacaaaggcaactgcaacaagagcaaaaattgacaaatatgatctaattaaactaaagagcttctgcacagcaaaagaaactatcaacagagtgaacaatctagaggatgaaaggaaatatttgcaaagtatgcatctgacaaaggtctaatatccaacatctataagaaacttaaagaaatttacaagaaaaaaattacaaagtgggcaaaggacatgaaaagacacttttcaaaagaagacatacatgcagccaacaatcatgaaaaaaactcaacattactgatcattagagaaatgcaaatcaaaaccacaatgagataccatctcacaacagtgtattattaaaaaataacagctattggcaaggttgtggagaaaaaggaatgcttatacactgttagtggtgattggtcctcaaaaacctaaaaacagaactacaatcaactcagcaatcccattactgggtatatacccaaagaaatataaattgttccatcataaagacacatgcacacatatgttcaytgcagcactattcacgttagcaaagacattggaatcaacctaaacgcccatcaatcatagactggctaaagaaaatgtgatacctatacaccatggaaaactatgcagccgtawaaaagagcaagatcatgtcctttgcaggaacttggatggagccagaggctattatccttagcaagctaacacaggaacaggaaaccaaataccgcatgttgtcacttataagtgggagctaaattatgacaawacctggacacatagagaggaacaaaagatactggggcctattggagggtgaagggtgggaaaagggagaggatcaagaaaaataactaacaggtactgggcttaatacctgggtaataaaataatctgttcaacaaacccccatgacacaagtttacctatataaaaaaactgcctatgtacccctgaacttaaagaaaaaaaaaggcggcaaaggacatgaacagacacttctcaaaagaagacatgaaagcagtcaacaagtatatgaaaasatgctccacatcactaatcctcagagaaatgcaaatcaaaatcacaatgaggtaccatctcataccagtcaaaatgtctgttattaaaaattcagaaaacaatagatgttggcaaggctgcagagaaaagagaacgcttatacactatttgtgggaatgcccatcagttcagccactgtggaaagcagtttggtgatttctcaaagaagttaaaatagaactattatttgacccagcaattctactgctgggtatatatacccaaaggaaaataaatccttctaccaaaaagacacatgtactcatatcttcattgcaacactatttacaatagcaaagacatggaattaacctaggtgcccatcaacagtggattggatgaagaaaatgtggtacatatacaccaaggaatactatgctaccataaataagaacaaaatcatgtcctttgcagcaacgtggatgcagctagaggccattatcytaagcgaattaatgcagataccacatgttttcacttataagtgggaactaatcattgggtacatgtggacataaagatgggaatgatagacactgggggactgaaagaggggtaggaagagagggacaaggatagaaaaactacttattgggtactgtgctcactgcctctgtgatgggttcaattgtaccccaaacctcagcatcatgcaatatagccttgtaagaaacctgcacatgtacccttgactctaaaagttgaaaaactaaaataaaatagattattgttttatctaaagctgtctttccttcccctgggctcaactattcacccaggagttggggttaccaacaaattaatactttaattctcaaaatgcctattgccttccaagaactaaagttttgttcctaacttaagctcattgtaccagacattcytaaggtgggttcttagtaccattgcaagactgctgaccagccaccccagtggtctgccagrtatgtctgaactccagctgagagtggaaatttatcactcaacctgtgcttmcctctaaagatttgtcattaataatactagtcagtattttcatttccaatttcctttggccacgggattaaatcaccaatttcactttatatgtaatattaaatttgcttaaagcccataaaagcaattatgtttttttcaacaccttggctacatttttgaaacaaattttataggaatttaaaacacttatacacaccacacattttaaaaccatgatagtcagacttgcaaataacagatttatgaaaaaaaaatgaattacccctttattgctgccaagaacttagctcatctctttgggtttttaaaaaatgctttttcgatgacaatgaaatctttgaaacacaaagtacactttctaaattcactgcaagcatttgaaataaacaaataatttggtttatttgatctggcactatgaaaattatcataaaatgaatggtaatttgacctgtaaaaggttggggctacatatctcagggtttggagttttaagactgatgtgactgtaaaactccattatcactcacatgagcccatcaaactttaagttgcaaagcagaagggatcttgctctctctgattagtaagttttctgctctgcaattctttgtcttacatcccctaccagacagcctgaggagtcatcatggggtttcttttttcattacttatagtttttctcctctttagatcttcattgccttgcagtacactaatccttattttcccatgtttctacttctataaaatacattgaatggtcatccatgcaatgatgatgatgataattacaataacattaataatagctacaatggctaaaatttactgcatgcatttctgatgccaggtactgtattaagccatttataccgattatatcattcaatgcccacgagaacctcataaaagaagtcctattattatcccattttaccagttagtagtattttaggtaacagaaacctacagatgtaaacgacttgatgatgaggaagaagagaaggagaaagaggagcaacaacaactcctccttggcacacatgcctgcaaagtccatgagcataccagacttcccagatggttgattcagggctcaatggtgtcccaaaagtcaattctcagctctgcttcctcaggatgggttttacttttgcgattggtgtaggcctctacagcttccagctcacatcatcatgaataccaattaagaaaaagaaagttcacatccagcctctttttttctctttgatctgacacaggccacatgaacatttctgaaccaatccatcattatttccaggggatactgtacttcagttggtcaggcttaggtcatgagccaccctcaaagcagggaatgggagtcggctgcagcaaagccacatagattgggagtagaggaggagtagatccccaaaagaaacccaggactgttgccaacaataggtgaatgaatagtgggaaatgaaagaacacaaatgtccactatatcattttgtaagtgagcaagctgaagcttagaggagttaaaagcaagattcaaaccctgaccatttcactgtaaagtctactttcacartgtaatcttagcaccgccaaatacactattgtayttttattttcccagccygtttcctcatatgtacatatagatgtttagacaatgacatgagataatgccaaaacatagtcagctttcaataaatatcagctaaggtggtgatgaggataatcatacttgccttcctatatttgaatccctttattgccagggaactcactcactgtttcctgtgacaacccactttatctctggacaaaattgagtactagacatttcttccttttgttgaattagaggttctccccttgtggcctcccacttttgactaaggcccttttcttgggcctaataaaccctcgttcctctttcacatgacaaactttcaaaaactagctccgactttcatatctcaccactccttccctttgcacttccctcttttcctcctcaggcataacattcatagtttccctctcagcttgctcactcagcagatgatgacttgtttctgcatccatttgcaagatgtacccagacccccgctctgcttggctgccctcccctgcatgtgctctgatttgcttgcttatgaggactaaaatggatttatcctccctattaatactgtattttccttaatgtaacctaaaatcaaattcagttttttgtcaatcacacaatcacatctttgatttctcttgacttatatttgaaatctccaaatttttaaatataaattgtcttagtatattcagcaatttctgccatactctgtgtttagcaggctttttgtcttatgcaagtacttacttttaattctttacacttttctttcatgagattcacccattgctttggcatgcaaagatcttgttagatgttttttyatctcagtgtatctgcagctcttccaaggttcttgtcacccataaattttatgagcagagccactctggtcttcattttaaaacactgattaaaaagttgatgagatagggccaggagactcttgtgctgtggcaggggtgtttgcctcttagacttgtttgctattatttccttgatcatatttttaacaattgtattatatgcatccatttgcatcctgtgcctgatttcaaaccaaatgctcttttatgcttatgagtgaatcatgagagactttgtccaagggctatgtatttatccctgaaggcaaatatttcaatagttctaagccaatttttgctacctcttattattaatggttatatataagtaatgtttagttttacattaagtttaagtacacatttattttattcaagttgtttagagttattttgtctgttttgtattctctgaattctcccagtaagtggtaattgtaaaaggtcttacttcttacttcttggaggaaggattaaaggtataattggaatgttatcttgattcatacttaaaagttaaggggatagaaaacttgaatatctctataccaaataagacaattctgtcagtattttaaaatcaactcacacacaaaaaaattaaaaaacataccaatttagttttacaggaaaattataacaaatatacaaagaacagatcattacaatctctttaaaactttcccagataactgaaacagaaaaacattctccaccttattctacagggctagtatagccaggatatcaataccatgatatcaataccagacaaggacagtatgagaaataaaaatacaggtccatcttaattatgaacatagatgcataaatcataaataaaaattttagcaaaatgactctagcagtgcttaaagtaaataatagttaacatttgctgagtgcttactatataccaggtactggccttttaacctatgtaattctctcccaatatcttatgagggaaaaactaatgttaagcccactttataaatgcgtaatgacctagttgagtttctcccacaaatgcaggacggcttaatattcgatataattccacactgcaaaagactaaagaggaaaaacatcatgtgattagtaaaaagtatctcataaaattcagtacctctttgctcatgaaaacaaaattcaaactagtaattttggacaaatttcttaacatgattagaggagatatatagatagataatgatagagcactatatatataaatatatatatatatttcactatatacatatagtggaacagtagaagcattcatttaaagtcaggaatgagatgaggataccaatatatctacttctatttactgtggcacagaagccctagcctagacaagaaaaataaatgaaagttataacagaaaggaagggtcaaaacaatcattatctctagaaaaatgtgataattgtctacaatagaacatttaaatattctggctgggtgtggtggcttgcacctgcaatcccagaactttgggaggccaaggtgagaggatcgcttgagctcaggagttcaagaccagcctcgggaacatagcaagacctcgtccctactaaaaatcaaagaatttatctgggcttggtggtgtgcacctgtagtctcagctactctggaggctgaagtgggaaaatagcttgagcccaggaggttgaagctgcagcaagctgtaattgtgccactgcactccagcatgggtgacagaacaagcccctgtctcaaaaaaaaaaaaaaaaaaaaaaaaagtaaatattctccagtcaattttaagacaaaataagacaaatttcagtaaagtgctggaagtgagatcaatttagagaaactagtttttttcttacatactagtcataataaattgaaaatataatattaaaaatattatttaaagtagaaaaatatacaatacccacaggaaatgtagcttttgagaataaaattataaaagtgtattgaaagcaattaaataagaaaatggagaaatacaccgtgttcactgatgggagagtttgatgtggcaaagatgtaaattttcaataaatttagtgaaattttgataaaatagcaacagaggtttccatgaaagatgacaagctgatttttaaatttacaagataaagtgaaacagatagccaagacagtttcacagaaggagaagaaaatgggagttgttgggggagaggaagaggcagtaatttccgtaccagatatcaatatattataaaatcataataatcaagacagtgtagcactagtgtaagataggtaaataacccatgaatagaacagagaagcaagaaacaaatctgtgcatatatggaaactgtgtatatgctaggggaatattgacaatagagaaggacagactattcaataaatggttttgagacaattgtccacatcacagcatgcataaattaatagcagatggaataagacctaaatacataaaacaaatctaagtctcttctttagtaaaattttaaaaatctctcagcaaacaagcaataaaagggaacmtccttattctgataaaaggtatctattaatactaaacaactaaactaaaattatacttattagggaaatattaatgtttccccttgaattaaaaaataagataaggatgtcacttggtgtattagtccattttcatgctgctgataaagatgtacctgagactgggcaatttccaaaagaaagatgttwattggactcacagttccacgtggstagggaggcctcacaatcatggtggaaggtgaaaggcacttcttacatggtggyggcaagagagtatgaggaggtagtgaaagctgaaaccccttataaaaccatcacatctcatgagacttatttactaccatgagaatagtatgggggaaaccaccctcatgattcaagtatctcccactgggtccctcccacaacatgtgggaattatggsagtacaattcaagatgagatttgggtggggacacagagccaaaccatatcacttgggcaatgaatttgttttctgcttaaattatatcaggggtaaaatgtgatgttttgtaacatcagaacctttttagaaaagaaagttgttttccagtgctcccgaataagtctccaaacttgttctttgccatatgaaaatggtctgtaatgccttttcagtactgataaataaaagcacaaccaatgcttagtgcagcacaagttagcatatctttcactcaagaagctgaaaatattattgaagaccctacaactgcagtggattatctgagggtttatagggaagcccttttaaaattttgatgtgaaactccataatgcaatgaacaccattgctatttaatctaaaagtagtaatgtccctttttctgcatttctgaatcagtgatcataataaagaaatatgcctcaccatcaatatgccttttacatgctcctctggcacaagtcacaaaaygacttcaaatgattggaaacttaagtagaaagtctttgggaagaaaatgtaacatctcatcaagagtccaaattccttttttacttgctggcaatgacctggaaaatactgtctagttaattatgataaattcagctcattttttctctgtgtgagacaaatttcaaaccattgcttggtgagcagtctcagaaaaatggagatagaaaattgtcccccccccatttaatatgacagttataatatatgtgatataggatgtatgagacttaaatagataaaatatctatgttttgtacaattctgggcccatagttcatcaatggttaccatgatttctatcatcatcatcatcatcatcatcatcgttctggttgtttttgtcatcaccaattgagtatctgctgtgtaccaggtccatattaaaagactggaggcaggctaggcgctgtggctcatgcctgtaattccagcactttgggaggctgagatgggcagatcacttgttgtcaggagttcaagaccaggctggccaacatggtaaaaccccatctctactaaaaatacaaaaattagccaggcgtggtggcacacacctgtagtcccagctactcaggaggctgaggcagaagaatcacttgaacctgggaggcagaggttgcagtgagccgagatcatgccactccactccagcctgggagacagagtgagactccatttcaaaaaaaaaaaaaaaaaagattggaagcagaaccatatccactcatggagtttcataatctctagggaaatgcttaaccattaaaaattcatgatacaattattcttaaaggaagtggtttttaagttcaccataaaacaagttgttgggaaagaatttattaatcaaatattctaggaaacaagctactaagcaatcttattaagaatattcaacctgaatatttatacccatagaaaactattaaatgtaaagttatgaaaagacaatgcacatatggatcaaggaatagagacgtcttaaaacaggaaaagacttctaaattgttaaccaaatcttggatctgatctaactcagagtttgcaccttcttgacttcaccagtagatgctgctgtgaagtagaacaaggcctgcatagatttggacatttgtgtgctgaactctgaaaatgacttacccacaatggaaaagaatccttacattcatttatttgttcgtatttttgtttgcttgcttatttagtttcaatccactgaaaacaacttggaaaaacattttttaagataactatcttattttcaatataacttcatggtttataaaacacttttttgaaaattatctgcttactaatctttcaacaaggtaggcaagtcttgttatccctaagttcctgactaatttgagactcatagagattacttgacaggcctgatttcttagagttattaagttagtaggtgatggtgccaggatttgaatactggatttctgaccccaaacccagcaaacttttctgctacactccagatttataaaacttgatgcaaggatcaacgataggagtgttcatgttcactgaatccaagaatacatcaatgaacatatacaattaccttaaccaagactttaaccttaggagtgcatttcttaagtggctgaaagacaatgctggaaacatttggccttagtaaaactcagggaagagatttctaatctaagatttgacaggaaatgaaataaaaatcaattataatttcttgtttgtttgcaaatctaattctttgttaaagtgaagtcaatcaagtaattgtaaatagaaagctctacaattctacactatatgcttggtagtagaatgttctgaatatattttaaaggtgttaatacttataagccaatttatattgtaatagacaaggaaaataatatcaactgtgtttagttcatatattatctctgccaaaaaattagctctgctggagatatatacatacatactagagtgaaaaactgttccagtttgcgtgggactgagggcttcccaggacatggaactttcagtgctaaagatgggacagtcttaggcaaaccaggacagttgttcactctacacacacaaataatattatttatatgtatatatatatattacatatttattacacatacatctttcctcctaatagcttgagtcatcttgcacaattactttactatgctgtaatatggtgatgtcgcaataagtatttggtaaatgaaaatgtgtgacaatgtgctaacataagccagcatgctgatacttctctttagatattttatctcagttttgcacatttcttatttcctccttttgctaacacctatatattctcaaagtcattaaatgttattgcttagttgttgttgtttttttaagtcagatatccaacttcctgagaatttgtaaaatgcattttccaagtttaggttatgggtgttttagggagaataaagtgcgtagttgtttttgttgctgttgttgttgttttgttttgcttttttgagatgaagtctcgctctgttgccaggctgcagtgcagtggtgcgatcttggctcactgcaatctccgcctcccgggttcaagagattctcctgcctcaccctcctgagtagctgggattacaggcgcacgccactacacccagctaatttatgtatttacttattttgagacagagtctcactctgttgccaggctggagtgcagtgccatgatctgggctcactgcaacctccatctcccaggttcgagagattctcctgcctcagcctcccgagtagctgggactgcaggtgcgtaccaccatgcctggctcattttttgtatttttagtagaaacgggtttcaccatgttggccaggatggtctcgatctcctgagcttctgatctgcctggctcagactcccaaagtgctgggattacaggcttgagccaccccgcctggctgtagttttttaaattaaaataaaaattactggatcaaaattagattgagtgatcaaccaactaaaagattaaacacgacaaaagtatatttttctctcacgtaaaagaagtccgtgggcaggcagctcagggctggctagatggcttcacaatgaccaggaacccatgcttcttctgtattgttgcatggggtctcctggtctaagatggttgctgaaattccagcccattaccatattccaatcagacagaaggaggaaaagaatcacatataatatttcagcgttggtcagaacatagttatatggctgcatcaagctgcaagtaatgttgaaaaatatagaatttactctgagtggtcacatgttccactaaagctaggattctgtcatttagagaaagagagaaaatgaatatctgggaacaattagaagtccctagaactcctagctagacttactgctctaacagatgaaatttctacttttttaacccaagtattattttattttcttctatttgtttgttcttcaccctaaacatgtaattacttaaaaaaattaaaagttttcttatattaaattctgtcagcatatgagtttgcatttatctcggcctgcaacatctggcatcacttaaacatgtataattcgtgttgcagcatgtaaaggaatttaaatcatgcctaattttctgcttaagttttgggtctagttttccttcttccagctgggagttcaagtcatatagacaatggctagacagggactttgcatgtgcccagtgtgcctagagccttgaattatgtgatctccaagagtctgagactggcctatcagcccctaactacaagtgattttcttagaggcttagcctcgtttgtgggtttcacaagtggaatgaagctatacttatatgatgaacatactcaaaaattattagattcatggaattttattgctgaaaggcactgagtccaatcacctccttttactgagaagawgcagaggagttatgtaacttgtctgacacctagctagttagttacaaaattactcctggtcctattctccaaacctcatgaagaggaaatgtcctgtggttgtccatgccctatctttcagaggacatatcatcactgtgggcccacaacatttcagaatcagctttgtgaggcccttctatcagccctcacatagaatctacaggagaatactagtgtggtggggaaaagttacctccccatccacagtgtgaaggggcttgacctctcccttctragtaaggaagagaatggggtgtgctttcagggcaggagttcttttccagattcttaggtctcccaaataacattcctaagccatgtcttgcagcatcatgtgtatctgaggaactgtgataattcatgtttggtgtttgtttttatgttacacagtacagaaagttgtataagctcctagaattgtcaaatgggaagagtcctagagattcttatttcatcaattccttgatttctcagctgagaaaactaaaacccacagagatgaattgacttggcagagataatatttcttgcttatgatttataggaagccaaacttaaaacaagtctatagttgctcattcctaacaatattaaccatgctgtttacataatagtatctgaaaactaattgcctactttaaatgaaaagagaaaagtacgagtttgctccaaaacatctcttaaatttataattaaatgacgtgagctagttttataaaatattttatttacagtagagctttacaaaaatagtcttaaattaatacaaatcccttttgcaatataacttatatgactatcttctcaaaaacgtgacattcgattataacacataaactacatttatagttgttaagtcaccttgtagtataaatatgttttcatcttttttttgtaataaggtacataccaataacaatgaacaatggacaacaaatcttattttgttattcttccaatgtaaaattcatctctggccaaaacaaaattaaccaaagaaaagtaaaacaattgtccctctgttcaacaatacagtcctttttaattatttgagagtttatctgacagagacacagcattaaactraaagcaccatggcataaagtctagtaacattatcctcaaaagctttttccaatgtctttccttcaactgtttattcagtatttggccagtacaaataaagattggtctcaactctctctttcattagtctcaagtgttcctattatgcactgagttttcagaccttcccaactggcatgtgttttaagtgtgagtttctttctttggcttcaagtggagtttcacaacatttatgaaacatactgagctcctccatgtggctggatctctgtgactccccacccaacaatattcccccggatgtgacaagactctgctcctccggtctctcttatctcttcattgctaagaacactatcccagatattgaagcctgtgagtctcccagagaaggctaatgtttcatcaaagccaccacccacacagcagccattcttttyytggccaatctgcaggattcctccctcaggaacaatgtgacctgtggccatctcaacagtggtagccrccagttcaccatttacccacaaggatgtgagcccttcctctgaattccaggtgccgcacaggtgggtccaccttcccagggaaaccatggcttcagcaaccagtttgttctcctctccacccaccacaaacactatggattggtagctgagatacagctggatttcatatggattcctcttwgtgccataggaaaacaggatggttttgtttaatacatctgtggctttgacccaaatgcaggcactaaaagactcaagcctcattggtctcactggatgcacgcttccaaaaatcttcttggaacgcattgggaataaaatagctgtttcacaacctagagtagcaagaaaataagaagaatattaaagaaaatataaattaattcagaattattctggcattagttatttaacataagaattttaatkattacaattgaaagctatgtgaaaccctacattacgacttaagaagcttccactgtaatctctgcagagcaaagaaaatgagaaaaaggaaagccaattgtcttatccaatgaagcatctaaatgaagagaaagcacgcaaatagaagagccaactagtccaaacccacaaaataataaaagccataactacctccccttccaatttgcatattttctttgttactgcttttttttaaaaaagttgaatcactatcagttaacttcagacaataattctataatttccaagaattcagaacccaacctggttctctctttttgccaccaccaagttcctaaaataataaacctgtgaaattcagtaracctagttcgctccatttagcctttaccaacatgcatttttcagcaaaattctaggatagtgatgttattgcagaatacatttttttttttttttgagacagagtctcactctgtcacccaggctggattgcagtagtgcgatctcgactcacggcaaccttcgcttcccaggttcaagcgattctcctgcctcagcttccggagtagctgggactacaggtgcacaccactgcgcccagctaactattgtattttttttttagacacggggtttcaccatgttggccaggttggtcttgaactcctgacctcaagatccgcctgcctcagcctcccaaaatgctgggattacaggcatgagccaccacacctggcctgcagaatacattttaatacaccaaatgttctcagatatttgtaaactttgcagagtttttagaaaactacctttgaaaggcaacaatgtataataatgatgactaagcttattgggcattcactatgtatcagatactgttctaatcattttgtttgtcattttaatccttatgccaaccataagagatagtcttttacattcctattttacagatgagaaaacttaggtaaaagtaacttatctatgtttacatagctgataagcagtaaaactagagtttgaatttttgcagtctggtcacagaggccacgcccttaatcagcacactacagtgcctcttattaatagaacccctagatttctctaggagggctagaatccagatggtgttactactaatgagccatgcaactttggatgagcaccataatttcctctaggctttagcgttatctaaaaaaggcccttccattctgctcctaatattctgcaagtctgtaagcagcaagtatgtagcacttaagagctgaatagaccaaaaatgtgtttaaaaattctaccttgtccacatgcttataattactatttaagcagtaattgaaaatctttaagagaagtacattctttcaaggggcctggttggagaacatgtttctgctaaagagcacttgggagggggactttcaaatttgaggtggaaagctcagtaagtttccaccattgtccatctcaaggcgacttagccatttgggaagctggagatgctgaaacgaaaaccttttacgtgtccctgggaaagaacaggtgagctctgcatctatatacataaatatatatatatgtatgtatacgtatatatacacacatatatacatatggatatgtatgtatgtatacatacatatatgtatataaatgtgtgtgtatatatatgtgtgtatgtgtatgtaggtatttttttaaaaacacctaaattagggcaggtataacaacctaaagaagatatgccataagacagctttgaaaagcaaactcccagaatggttccagaataactggtaaagagaaagaacttgcagaaaccaaacatccatgtaaaagtgtggtaaactatgtcagattcctacaagtggctcaggggtaggctctatcctgaaaacattaaacaaatatgaaccttatcctttagtgttagggatagtcaaataaaatattggcattcagataatcatataaaagtaactacaatactaaaacacaaaactggctctgtcatgctttgatactttttcactaaataatttgaacttttgaagattttttaaaattaatttttaatgaggcagtgattctattttcaaatgaaattgctaggtacatcttttcttccagctgtgttaattaaaatcaaataaaaatcactgaaaaaaatcaccatatccatgggcatttgatatagtctctataaagtttcaataaagtagtgttcaatcacacctgtaatcccagcactttgggaggctgaggcgggtggatcacaaggtcaggagatcgagaccatcctggctaacacggtgaaaccccgtctctactaaaaatgcaaaaaattagctgggtaaggtggcgagcacctgtagtcccagctactcaggaggctgaggcaggagaatggagtgaacccgggaggcggagcttgcagtgagccgagatcgcgccactgcactccagcctgggcgacagagcgagattccgtctcaaagaaaaaaacaaaaaagtagtgttcaagagggtgcctactgcaatcgaattaagtgatttcctctttaaataagcccaggcagtcaggattgcattccaaagcactcctggattgcatctcagagactcagcttccctctaggctacgctggctatataagttcatggactggaaccgcatgttggctatttttggtgatcctcttttggggaccagggatacccaaaaacgaggctcttaatacctctttaaaatgtcagaaactctcttatgaaatggcttttaactaataggtttttctgattatcaaagaccaaacaaaattaaaaccaggttcttaggaggctaacaacagaatggttaggagccaagctggctggagaccaagagaagataaatcaaagcatatgggtaaaagtattattggatgtaataaggattaacatcttagaattcagaaatgcatccctcttctgctctaactaatatgcaaagatgaagataaaaaatagagtaattcttcggtttttcaggtgcattatatgtacaatgactttacgtggtttgcgaaacacaagacatttcatccattaaaatggctgcagaattctaatttctctcctgtcacattgagaatctagtgtacatttgattttatgctttttctcctctgaagccctatttagtatttactgacaagcacccctcaaatatttaggaaatatgatatggtttctgtaactttaaatgaaacatgctctcattacataaaattctttaactttaaatgaaacatgcttcttccccctccccatccagcaaaagttgttttcttggaaatacagggaaggattctcaggaaaagtgcaagttatattttcttacctaggacactgattttctaatacaatccaaaatgattgtcacaccaccatttcttagaagttttggcatacaaaggagtattgattggctccaaatcttctatttctttcttttaaccatctttagaatgtattattttgggaacccatgtctgtttggagattcatggagtgtcacatgggactttgagaagttgcctgtggtttgaacagtctctctcctgcttggccccaattctctgaatccctggggtggagctgggatcccctacacggattggctcctacacctgactgttccacgctgaatcccaaaccgcacaccctccgacctcccctgtcgcgctaattccacaaaccccgggggctgggggacccctgaagaattccgctgacccttcgggagattagctttagcctcaagtttcttgctgagaatgggtgggcggagaggaggggccggctgaggggctggaaaacatccctaaacgttagcctgggccctgaaatagtgcgggaaaccagagctcctctaaagacagaggcaggataaaattagaagacgtggaaatccctaacggagggaagctgggcggcaagagggatcacggttataacgggccagtggactcctgcagcgcytagtcggatcgggtgtaaggggccctagacgtctatttcaagactgtgatggttacctccacaactctctttagggctccttaggactgaggaatacttttttaaagccaattttcccgccttgtatggtgtgcctgagctctgtgaccgcgcatgcagaaataggggtgtgtgtgtgtgtgtgtgtgtgtgtgtgtgtgtgcgcgcgcgcgcgcgcgcttcccatgaaagcttcccctagaaggttgcctggcttggcttgccgttacgcgcgctcccggaacaaagccgcagtgggaggtcccggccccgcttgcctccttacctgccggcagccagctccgggcagcccagccctgcaccgcgtgcaggtcggctcgcgtctgccgcagctcctctagcaccgcggccagggcgcgccccgcctcctctgggcgctgcgcctccgcgccctccatacgcgccagcctgcggcccgcgtcgcgggtcgcctgcagcagctcgtccagagcactggtcagcctggcctctgcgggagcccccggcgcgcacggcctcgccaggctttccgcgagccggcccagctcctcccgcagcctctgcagctcgccccgcaggacgtcgtccgtggcttgcagcagcatgcgctctctcatctgcgagttctccagcatgatgaagagcttgtcccattccgagtgctcctgaccgcagkcgcacggcgtggctagagtacgggatacacacacgttagcagcccgcccaggcctgccttggatgtgctttgtaaaagctgacctccctcggtggtgccaagttgcagcccgttcctggcattccccttccctttaaggacacctccgaaaaacagcatgtaaatgtctcagaaacgacagaaatcattcattcaggtatagattaagttgtaccctatgaaatcgccggttatgtagctcaaaacagtcaaatattgacgatttgatatgattcaacccattatgtacgttacagaaataactttgaaacctccatctttcttcaagtgcttctcacttttgcataacaagctataaatttttaacttgtctcactggccacaaagtatatgtgtgttatttagaccaagaggtggatatgtagtcagggttagcagagaaacagttaaagygaacttacggtcctcagtgggmtggagtccattgtctatttcgttgtccaaattcacatacatgagatcataatcatccgagttctcggccarcactgcagaccagagagcacaaaacagaatcgcaaggagatgcattgctggagagacgcaaagttctytccacagctggcgggaggagactctcaagtgagctgagtttgagcggaggagagtgagagtgagaggctggagcagagagtccttaataaatgctgaggaaagcctgaatggggatgaatgagtaatgctggtggcactgcggtaacgggagttcccctgaatttggtgggggagggggctgggtgggagagcgagggaaatgtggaagttgcacaatattaaaccgcaaaggtttacgctgcagtcagattaattggaggagggtcagaggggaaagaggagagaaactgggcttctactgttctcctgagaattagctgttgtaatttgaattgatagcaatggggatgaaggaggggtggtaggggagaaatttcagagggtactgaagcaaatcatcatttcagcattttctgtgagctgttattatttcacaaccctttatatatagaaaactttccatgtttcctttgtacactgttttacaggttgaaactgaaaatggtctgattccaagataaaccaacatattaagaatagttatggctctgaaagtcaagtccaatccgagctatcttgtctttaatacttgaggagttgcacctatacttttatagataatttttttttttgagactgaatttcgctcttgttgcccaggctggagtgcaatggtgtgatctcggctcactgcaacctccgcatcctgggttcaagcgattctcctacctcagcttcccaagtagctggaattacaggcacccgccaccacacccagttaatttttgtatttttagtagagacagggtttcaccatgttagccaggctggtctcgaactcctgacctcaggcgatccacccgccttcgcctcccaaattgctaggattacagacgtgagccacctcacccggcctatgacaaacaacacagtacaactgggtaaacctagaatggggaaaaaaagctgggggaaaaaaggaatatacttatttagttatttaggtatgtttcttttcataacttggtattatgtggacattatattattctacaaggtttcgaggcaaggatcatgttttaaaagtaaacttagagatttctgcttctaacaatatatacaggtctgtgttcacatgatattaataaaaacttaaaaggtacagatgagctcccattaaagtaaggggaaaatcccggagccaaagatagagaggaaagcaaaaacaacaatcccatgagctgatgctagggcccctctggcataggagtgaagtgagataggggttattagttctataaccaccaaatgttgatgaccatgtggaagcaaagcttaggccaaaggtggagagttagaagggagatcctcatgaaagccaggaccctcacagggttacctactgtatttcagtaggtacaatcccactctgccctagcacaaagaggtaggaagcaatcatgtctctctttgaactctacaaggtccctytgagtttgtgaaattgggcctgccctcagatatgtttagaattcaaatatatactatctgccactgtgaaaacaaaaaagaattcacaatgatatttgaacatatgaggaagcaaaccactataaatgagaatcagcagaaaccaaaaaggattagacacctctccccaagaactgcatttagttgaaatatcagccaaaaaactagaaaataaatatgtttaaaactactgaagctctaaaagaaggaattggaaatatgagaaaagaataagacattgtcaaaaagaaaaaggctaggtgattttttttaaagaaccaaataaaacttctagaattaaaaaaaaaagttaattgaaaattttaaaagctcaaggcatggattaagtggcaaattaggcaaagctgaaaagaatattaatgaactggaagacagatataaggaaataatctaaaatgtgctgcttttatgttcagtaataggattctaaaatcatttcattgttcaggaggacgaaaaagaaattaattaattttgctttgctcaaaaatatttgttataagtttaaggacaactaccaaatggacataggcatccgaatagaaggtgcagggggaatttttaaagaaagacttgatctatgaaaaaaaaattaatgaaggaggaaagaaaagcacagagaaggataagttaaaagtacaatattatttgctaaaattaaatcaaaatataccaataattaccataaatattaatgaaacacattttccagttaagagacaaatatttctatttgtcatatagaaatattttagtcggggctcacgttcagaatcccagtactttgggaggccaaagtaggaggatcacttgaagccaggagtttgagaccagcctgatcaacatagcaagaccctcatctgcacaaaaaatttaaaaattaatctggtgtggtgatatgcacctgtagtctcagctactcaggaggctgaggcaggaggatcacttgagcctgggaagtggaggctgcagtgagctgtgatcacaccactgcgttccagcctgggcgacagaaagagaccctgaaaaaaagaaaaggagagagagagagaagaaatattttaaaaatccagctatacatcacttacaaaagctatgcataaaacataaagtagaaatgttaaaagttaaaagctttaaattggaggggaggaagagaacacaccaagcaagtattattcaaaaaagctagcatagcagtagtaatatcagtaaaaaatagacttaggcaaaagaggatagttaaattatgatacaaagaaatactttaacaggaagatatctctgaattatctagtaatatagtttcaaaaaatataaaccaaaggttgacagaattataaggagaaatgggcaaatccataatcatggagggagattttaacaaagctgataagttcacatatatcataactgatcattcaaatgcgaaaaaaaagcctgccaaaggatacagaaacttaaactacataacttaaagcttgatataatgaagtatatagagtactgcccagatggtttgatggacaagttctaccaaacattcaaggaacacataatccccgttttgtacaaactgcttctgagaatagagtgttcaggaatgtgctaaattcattttacatgtctactaagtatgataccaaaaagagaaaaggacaatacaagaaaggaaaactgcaatctctctcattaagaatgttgatgcaacagctctaaataaagtattagccaaacacagcaatatgcataaaaatacacattatgcacagcaatgtgcataaaaatatatcataagcaagttgagtttattccaagactgcaagattgattaaatgttagaatagctgttaacttattacattaacagtttaaaggagaagaatcatcatatcaatagatgagaagaatgtttgataaaattcagcactcaaaataatcaaactagaaagcagacaggaacttacttaaactgaaaaaaacataaataccaaaacctatagaaacagatacatatgtaattgtaaatccttggaaacatacttttgaaaagcaggattaacacaaggatacccgtggacagtgactctattcatcaaagtgtgtattggaagtccctgcccataaagtaggacataaggacataaggagaagaaacataaggattaggatggaaagaaatgaagttgttattatttatcatgagtggatcatctacataaagaaaaatctaagagactcaaaagacatattaataagaactgagcaacttttgttggatataagatcaacatacaaaaatctattgctttattaataccagcagataaattgaaaatgcctttgcaaataaagttttcatttacagtagcaaaaatagctatgggatacctaagcaacaatttaacataagacaaagctaattataacaccttatttaaaaacataaaaagatctacatagacagaaagataaattatctccttaaatgagaagactcagttttacraagatgtcagttatgccaaattagtcaatatgttcaatatgaaaaagaagtcccagtctggtttttcaaggatgttgacagactgatactaaaatttgtatagagtagccaagaagagcttgaagaagtaggaggtcaggaagtaggtcctatgggatataatgatttattataaaattattgtaattaagaaaatgtagacttgatgaagagatggataaatgcccagaaacagacccaaacacatatggaaaacctaatatatgaaagaggtgtggcaaatcagaagagtaacaattgactactyaatagaaaaaattatttgtatacaaagaaaaayatataattaaacttcttcctcctatgtaccaaagtcatttccagacagattraagacaactacaagaaagcaaaaccataatgcctttaagagaaaatataggagaatatttttatgamcctggaatacagaaaaatttctaacaaaaaaacctaaaccatgaagtaaaaaaatgaaaacagttgactatattaagaatataattttaaatcaataaatcaaaaattcattcagtagctcagaataattaaggaacttctaaaaattaataagaaaaaatggcaacatcctaatagcatataggcaaagaatgtgaatggccaaatcacaagtgaggaaatcacctataaatatatgaaaagggctgggtgtggtggctcacgcctgtaatcccagcactttgagaggctgaggcgggcagatcacaaggtcaggagtttgagaccagcctggccaacatagtgaaactccatctctactaaaaatacaaaaaaattagctgggtgtgttggcaggcacctgtaatcccagctatttgggaggctgaggcaggagaatcacttgaacccatgaagcggaggttgcagtgagccaagatcacgccactgcactccagcccagacaacagtgtgagactccatctcagaaacaattatatatatatgtatatatataatttgttatatataatatataacaagtaattgggaaatgaaaattaaagcaaaaatattagatacatcccatcagattagcaaacactgatgtctgtcacaaccaaatgttggcaagaatgtggaccaacagaaacactcatgctgctggtgggagtagattgtcataatcttggtggtaggcagaatactggtcccccaaagatgtccatgttctaatccccggaacctgtgaacatgttatgtaatatgcatttcagatagaattaaggttgctaaataagatagggagataatcctagattattcagttaaacccaatacaatcacaagggtccttaaaagtggaaaagggaagcagaagagagaatcaaggggagagatgagatgaaggaacagggatcagagagatgccatgttgctggctgtgaagatggagaaaggggccacaaaccaagaaattcaggcagcctctaaaagctggatgtatctgtctgttttcacactgctataaagatactacctgagactgggtaatttatggagaaaagaggtttaattgactcagttccacgtggctgaggaggcctcaggaaacttacaatcctggcggaaagcaaaggggaaacaaggcacgtcttacatggcagcaggagtgagggagagtacagcggaaactgccacttttaaaccatcagatctcatgagaactccctcactatcatgaaaacagcatggataaaactacccttatgatccaacctcctcccaccaggtccctcccttgacacgtgaggattacaattcaagatgagatttaggtggggacacggagccaaagcatatcactggttaagccaaggaaacaaattctctcctagagcatccaggaaggaacccagccctgggcacacattgattttaacttagggagacttatgtcagacttctgaactacagaaatataagataataaatttgtgttattttaggccactaattttgagataatttctaataacagctatagaaaatgaatacaactgcttcacaaagaaattttggaacatctacaaagtcaactcctagggacatactcagtgctttgccacttaactaactatttggtcaatggaccatcagtgtcacctgagagcttgttagaaattcagacgctcaaaccctacctccaacctgttgaatcaacatctgtgttttaaagatatgcccaggtgacttctaagcacattagactcagaagcactaccctaagaaatatctctcatttttgcacaaagagacagttatttcagcattattgattaaggcaatgaataataatgacaacataatgtctttcaatcacagagagtatatgaataagttgttgcatatttatacactggaataacacatggctgtgagagtaaatgaaggagagcttcttggagatataactcctacaaaatgttgaataggaaaaaaatatgttgcgaagggatgtgtagagtatgatggtattcacataaaattttaaagcatccaaaacaatactatataatgtttattgatacatacgcatgtaattaaagtgtaaaaatacttatggagatcataaatactccctttaggatgatggttgcctctggggagaaaaggaaacaaatgggatgaaaagcaattatcatataaggttaagttttgacaaatctggttggtaggcacaccaatgttccttatattattgcctacatttgtttgatgacttgaactatttcataatttaaaagaaggtattattgactaatggaatttataagatttctgcaaaagttctgcatttgttttttgtattatttgattgaaattcaagtcagctgaaaaatgactaatctggggtttttcccttcaaggctcccagggcctctgtagtgagttttgtacygaaatgccatgcaacagtttcctgtcttagactgcaactacagtcccttttaatgtgaccatttttagcagttgatcagtatgtcctcataactaagttctataatctaacktgggctttacaaattgggtattgcattaaaaaattcctgatcttttaaggagacgctcatagtaaaataaacagaaaacaaaacaaattgttgaaaattaaactattgaaaataaatactgacgaacacaaccttttaaaagaaaactctaaatatttccaacaacttgtattctggggaacatgataaaacctgttttagacttattctatgaactacatgtggaaaaaacaattctcattttttattatctcccaaattcattcaattcattcagttttatccagaatcacgctttcgttaaatttagatattgatattctgaaaattctggccttctttctttaatgatcatatctaaattgtcttttatatataggcatgttcctaccatttaatgaaggtccatatatgtgtaattccttcttatttgattctttctgtgtatggcttctatatacaaagccaaatttaaagtaaaagtagagtcaaaaaaattcttgttcaaaaaatccctagaaaccaattcccctgagacatttaagtacttgtgaggattttgagaaaaaaaatctataccatagagtgataagcagatgttgcccatatgttgattgcagataagtttctatacgttatgtaatagttttcttgaggttttgccattataaatctagttgtctatacatatctttgaggaaattatgtgtgacaaatcagctgaggctaaacttcccttgaaatagtgcagaaattggggatttaaatttgcattactacttcttaaactattcataaaataaggcatagtttctgtatgtgagttgtctaaattatgattctgtgtcttccaggaatgtgaattcattcctttgcactttttttgttgttcagtttcatttaggtccatgattacagcactgcttagttttcatttaaacatcgtttaaattttgtttatcatcaggaattctttattggaactgtttccttctcaagggtgtggtctgattactgtcaaagttcctctatccccatggtgcrttacttagcaaaatttttcattagttaatggtgctgattatatcataaaatatttccttttgtggaatcggattaaatcacattttaatctcagaataaggtaccatgttatttttagcaaaagaattggccatcagtctgtgctatttaatgtgtaagtgcaaatattattacattggtaataatgttatttctgttgctcatggcctgataaagwcatcattccctttattgttcyctcaacaggtaacaccatgttgttgagagtgttacctgctgtgtatgaaaagcagcctcagccaattaatagacacctgacagaactcctggccttgatgtstcagctggaacagccagaacagtaccatctactacggcttttgcatgtagcagcaaagaaaaaacaactcgaggtaaaaagtacattgtatatgtcatggtgcacacaaccaggcatgtttctttgtgtgtgaacagcgtatgtgcttaggatttcctgtctcatacatttacaaatgyccatttttttaagtgaaagcgctcatctacttactctgtttgtataatgagaaactggctcatgaaattatggaggctaagaagtcccatctgtcatctgcragctagatgccaaggaaaaccagtggcatagtttcaattcaagtctgaaagcctgagaattggagagctgatggcataagttacagtctgaggacaggagaagaccaatgttccagctcacaaaatcaggcagagagagtaaattctcccttcctccacctttttgttctattcgggccctcagttaattggatgaggcccacccatattgcaggggcaatctgctttattcagtctacccattcaaatgctaatctcatctgaaataatcctcacagacatacccagaaataatgtttaatcaaatatctgggtgccccatgacccagtcaagttgacacataaaattaaccatcacaggcagagcatggtggctcctgcctgtaatttcaacattttgggaggctgaggtgggtgaatcacttgaggccagtagtttgaggccagcctggacaacatggtgaaactctgtctatacaaaaaatacaaaaattagcagggcatggaggaggcacctgtagtcccagcgactcaggaggctgaggtgggagaatcacctgagccagggaagttgaggctacagtgagccaaaatcatgccactgcactccagcctgggtgacagagtgagaccttgccttaaaaataaataaataaatattaaccaracagatacagtaatgaaaagcaacaaatgggccaggtgcagtggctcacgcctgtaatgccagcactttgggaggtcgaggctggtggatcacaaggtcaggagttcaagaccagcctggccaagatggtgaaaccctgtctctactaaaaatacaaaaattaggctgggtgtggtggctcacgcctgtaatcccagcactttgggaggctgaggcaggcagatcacgaggtcaggagttcaaccaacakgaccaacaccgtgaaaccctgtttctactaaaaatacaaaagctagctgggcatggtggtgcgtgaatgttatcccagctactcaggaggctgaggcaggagaatcgcttgaacttgggagacgaaggttgcagtgagccaagattgcagcactgcgctccagcctgggcaacagagcaagactctatctcaaaaaaamaaaaagaaaagaaaaaagaaaaattagccaggtgcagtggcgggagcctgtaatcccatctacttgggaggctgaggcaggagaattgcttgaacctgggtggcagaggttgcagtgagctgagattgagccactgcactccagcctgggtgacagagtgagactctgtctcaaaaaaaaaaaaaaaaaaagcaacagatttgcgaatctgtggctattgtagaatgttgttaaagaaagtttaatgtcgtcatgcagttctaggaatctgtagtttctcaggtaagaccaagagaaagacctacacttaactttatttgtgaattaatcagcctatagtgasagcaaaggttcatttttcagatagcaaatcagttattgttctttggattcaagtagaagattttaacaattaggatgtttacgattatcagtaatagaacacccaaaccacagtagtttcatcaaggaaaggaatttatagctaatgtgatgggaaaaaatcagatgaggtttggttcaaaaataatgtgaacaaacaatttctctattttgatttctcagatttgacttctaggctcccattttccacaggctttctccctgtcatctccaaataggtgctaggggctctcttsgcactatgcttctcctacatctatcactgccaccaacatccaacagaagtcttgatattctgtctgttttggatgcatgctctacccctagagcttctgttgaactggaggatacacagacagaaactagaggctgccaggaagagggaattygaaatggattctggagggtaccaatgtattagtccattttcatgctgctgataaagatatacccaagactgggaagaaaaagaggtttaatttgacttacagttccacatggctggggaggcctcagaatcatggcgggaggcaaaaggcactccttacatggtggcaggaagagaaaatgaggaaccccatgcaaaagcagaaacccctgataaaaccatcagatctcatgagacttattcactaccatgagaacagtatgggagaaaccaccctcataattcaaattatctcccactgcgtccctcccayaacatttgggcattgtgggagtacaattcaagatgagattttggtggggacactgagccaaaccataacattacatccctggcccatccaaatctcatgtcctcacatttcaaaaccaaccatgccttctcagcagtcccccaaagttttaactcatttcagcattaacacaaaaatccacagtccaaaatcttatctaagacaaggcaagtgccttctgcttatgagcctgtaaaatcaaaagcaagttggttacttcctagatacaggcattgggtaaatacagctgttccaaatgggagaaattggccaaatccaggggctacaggtcccacgcaagtctgaaatccaggagggcagtcaaatattaaagctccgaaatgatctccattgactccatgtctcgcatccgagtcacactgatgcaagggttcccatggtcttgggcagctccacccctgtgacttttcaaggtacagcctccctcctggctgctttcacaggctggtgccccagtagggactctgtgtggaggctctgaccccacgtttcccttctgcactgccttaggagaggttctccatgaaagccctacccctgcagcaaacttctgtctggacatccaggcatttccatacagcctctgaaatctaggcagaggttcccaaacctcaattcttgacttttgtgcacccacaggatcaacaccacatggaagttgtaaaggcttggggtttacaccttctgaagtcatggcccgagctgtactttggcccctttcagtcattgtgggagtgtctgggacacagggaaccaagtccctagactgcacacagcgtgggggccctgggccttgcccatgaaaccattttttcttcctagatctctgggcctgtgatgggaggggctgccatgaagacctctgaaatkccctggacacattttccccattgtcttggggattaacatttgactccttgttacttatgtaaatttctgcatccggcttgaatttctcctcagaaaatgggtttttcttttctttcacattgttggctgcaaattttccaaacttttatgctctgcttcccttataaaactgaatgtccttaacagcacccaagtcacctcttgaatgctttgcygcttagaaatttatttgccagatacccttaataatctctctcaagttcaaagttccagaaatccctagggcaggggcaaaatgctaccagtctctttgctaaaacataacaagcgtcacctttgctgtagtttgcaacaagtttctcatctccatctgagaccacctcagcctggaccttattgtctatatccctatcagggttttggtcaaagctattcaacaagtctctaggaagttccaaattttcccacattttcctgttttcttctgagccctccaaactgttccaacctctgcctgttacccagttccaaagtcacgtccacagtttcaggtatcttttcagcaacgccccactctactggtaccaatttactgtattagtccattttcatgctgctgataaagacatacccaagactgggaagaaaaagaggtttaattcgacttacagttccacatggctagggaggcctcagaatcatggcaggaggcaaaaggcacttcttacrtggtggcagtaagagaaaatgaggaatatgcaaaagtggaaacccctgataaaaccatcagatctcgtgagacttattctctaccatgagaacagtttgggggaaacttcccccattattcaaattatctcccaccaggtccctcccacaacatgtgggaattatgggagtacaattcaacatgcgatttgggagaggacacagagccaaaccatatcaaccaacatgtgtgcacagtgaatatgaattgttagtccaaggttattcaattatggttgtcccatttctttatagtttcactatccaccacttgaaaaaaaaatcaatgcttaagtgaagactggaacatttgtattcaacatacaaattactcaaagaaaggcaagaaagaatagttatatgcataattagccacaatagactgcaagctcctttgacaagaaatgatttcttctttcctctgtatcttagacttttccatagtatctgatagtgctcaataaacattcatagaaccaaactgacaataaacatagaatcaaattaaacaaggtgataaattctttgcaaatggcataaacagagatgggggtaatgaattctactttagaggaaaatagatgccatgaagtcccacaaagggtgtgacatcaggccatatcctgaagaatgcatacttttatgcagatgattcagagctgggaatcttgaatattggagagcagaattcacaggaagcttcaggagatgagaccaacaaggatgaccaatgcctgagcctcactcccagggattttggttcagtaggttcagtagacacaattgggtaccccaactgtgtctttttacaaatacccatatggtgctgctgctattgcttcaagggacaacattttgaggagcaaggctagagctcaggcagaggactggggaattctgtgttactggtatgcactgtcccttttgcacatagagcaatatgttgttatttttgcacgactgtttctttcagtgcactataaactccttaaggtacataggactcttatctacatattcatatgcactccctggtgtagtgctgggttacatagtaggattctaataaaaagttattgaattaagaaatgaacaaattaacaagagacaaaaatagtgaagacatgaagaacgaggaaaagtcatgctgtattctccaaaggggaaaaagtggctcaacagggtcaaggtctagagaagtaaaaaagacaagagacaggyattgaccttggatttggcaattggggctcaccagttgttatcttttttataaaaggcagcatcattgaggcagggtgggagaagtcagtcatttattgtggattgcatatggaagggaaggttaggaaaggatcatgtgagtatggactgccaattcaggaagtttagaaaaaacaaggagagttaaagacacaataagaataaagggattgaagatgtgagaggaaataggagacagaacaaggtgctggaggaagatggggaatgtattccagagcacaaatgagagaaccaattttggaaaggattgaggacagaaaggatgagcaaaactgcagtagagtttggggtgaggagtggagttgaaggattactcgatcacctagagcagaggtccccaactggggaaataactgggcagcttccacttccactgtagagaaggctacaagaggaggagtttcctcagtgctggtcccagcaggcaggggagggtagacaatggcactaatagtgactgagctcataccatataccaggcactatataggtgtatcacagacatctcatttatttcccacaacaagctttttgttttataaatagagaagccaatgtttggagaggtttttaagaacagtggtggtaccaaagggtgacttggtgggtgaggtggcttttcacatgcacttcatctttatcagcctttcaactttcatgtcccccactgaccatcagagtcatactaccttccctaaaaccatcctaaaaccatctgggcctcacactagctgggtcactttcccaaagccagatagatcaggccaagctgcaacacaaacccagtctaattccaaccaatgaaatcttttgacctcaacacactaaagaatcaaggctgtggcttgtgaagcaaatgagagttccagaagatacaggagaaggtgagggagaaagggcagttggagggtggctagacaaaagaaggagagtaaacaaaatgaggagagggtgaactcacattctgctaggtattgtgggtgctgagtgtggatcccagaacaaagaggccagggtttagggagcacctagagtgatgtggatggaccccacccatgccaggatcctacctggggggaagaagttgtaatggggtattgtggagtcccgtttcctgtcacccctaccttcatggtaaagcagcctctccacttgcctccctcggctcttcgtgctctgttcctgctgccagcacccctagaactagagcacacccttgatttcaaagggtctgtcaccacaggtggtacaatacagaaactgcctgattcaccttctccctcaccccttccttaattagacagtgagcaagggagatggaaggaaatgtggagaaagggtttactgagaagggaaataagtggcgacaaccagaaatacagactgaagctttcaagttaagcctaattcatttcaggtgaaataggaagctaactaaggaggttttgactttgtgaaactggaattcaagtagagcttccctgcctgcattaaagcattcctgatgctctgtaacttggaggtaaactgagtgagctctctagggaggggcaatgtgcggggatgcttcatgtgtcctgaatgcccttctcactacccaccttctgtgacctgggatagcatggctttccagggctggagggtcaacagttggcccttgaaaaaaaawttctctacataaagctgactagtccatgagactgtgaaggtagcatcgcttcaacatccacatatcacatatctgtgagctccacgatgtggctaactgagcagatgggtccccttcctccatcactgccctctaggcatcctacttttcaggacactatccttgccagatggaaggaggcagttcctggctagtaatttataactggtacctccagagaattctcaggatccatttacagaaaaaggctgggtgatcaactttccaagtggcctttatgagaatcaagtctataatcttggctgctgtaaaccatgctgtagtctagccaacgaaaggaacagagtttagtaacacatataagcatatctgttgttatccctgggacattaacttctatccccaagcatacagcaatgagtgacaggaagtggcaagggaagccttccggtgatgaatgttcagacacagaggagctgcttttgtgatctgttccctagaggagagaattattttctaggatttttgctcaacagtgtagagcattcctattcacacacctaatcgaggccaagaatactcagaggtcacttttggtattcatttaaaataagaagtcatttgcagaacattaagaagacagagtgctggaatatgtagactgttctgaaatttagagcagaactatggtttttggaatatataatatttttcagtatggtaggaattagtaaataaaaatggcagtcattttgtccatttctagagattagtagattcttaatgctagccaaagtaattaaaagagaaaattgggcctgaagactaattgaagaggaagtgtgtgcccacgcacatgtgtatgtgtatgtgtgtgtgtacataattgctcttttttttttctccttcaacttttaagttctggggtacatgggcaggatgtgcgggtttgttacatagctaaatgtgtgccatcgtggtttgctacacagatcaacccatcacctgggtattaagccaagcatgcattaactattctacctgatactttccctccccccagccccccaacaggtcccagtgtgtgttgttccacccctcccatatcgtatgcttgtattctcatcgttcacctcccacttataaatgagaacatgtggtgtttggttttctgtttctgcattagtttgctgaggataatggcttccagctccatccatgtccttgcaaaggacatgatcttgttcctttttatgactgcatagtagtccatggtatatatgtgccatattttctttatccagtctatcattgatgggtatttgggttgattccatgtctttggtattgcaaatggtgctgcaatgaacatatgcatgcaagtatctttataatagaatgatttatattcctttgggtatatacccactaatgagattgttgggtcaaatggtatttctggttctgggtctttgaagaatcaccacactatcttccraaatggttgaactaatttacattcccaccaatagtgtaaaaatgttcctttttctccacaacctcgccagcatctatttcttcttgactttttagtaatcactattctgactggcgtgagacagcatctcactgtggttttgatttgaatttctctaatgatcagggatgttgagttttttttcatatgtctgctggccacatgaatgtcttcttttgagtagtggctattcacgttctttgcccacttcttaatggggatgtttgtttgttttcttgtaaatgtttaagttccttgtagattctggatattagacctttgtcagatggatagattgcaaaaatcttctcccattctgtagattatatgttcactctgatgatagtttcttttgctgtgcagaagctctttaattagatcccatttgtcttttgcttttgttgcaattggttttgatgttttcatcatgaatctttgcctgtgcctatgtcctgaatagtattgcctcgattttcttttagggttttgatcttttggggttttacatttaagtcttcaatccatcttgagttaatttttttatgaggcgtaaggaagggatcctatttcagtcttctgcatatggctagccacttctcccagcactatttattgaatagaaaatcctttccccctcgcttgtttttgtcaggtttgttgaagatcagatagttgtggatgtgtggtcttatttctgagatctctattctgttccattcgtctatgtgtctgtttttgtaccagtactctgccgttttggttactgtagcctcgtagtttagtatgaagttgggtagtataacgcctccagttttattctttttgcttaggatcgtcttggctatttgggctcttctttggttccaaatgacttttaaaatagtcttttctaattctgtgaaggtcaatggtagtttaatgagagtagcattgaatctgtaaattgttttgggcagtatggccattttcacaatactgattctttctatctatgagcatggaatgttttttccatttgtttgtgtcctctccgattttcttgagcagtggtttgtagttctgcttaaagaggtccttcacttcccttgttagctgtattccaagatattttattctctttgcagcaattgcgaatgggaatttattcatgatttggctctttgcttccctgctgttgttatataggaatgctagtgatttttgcatattgattttgtatcctgagactttaattgcttgaaaacttttattctttacagaggaattgaaatgttgtttgctgtaaattaagttacggcactgttttcagatggccctatcctcaaggtgcacatggtctggaagatatatccatcaatcttcaatgacaaaatgccaaactcgtgaatagactgctatgggagcacagaagaggaagtgactaactctattcaggaaaaaccagggaattcagggttgctgccctaccctgggctacttggtttagagcattctgtttgggccctcctttacttgcacccttagttcccatccactcctttgcccactaaactcagttcaggtaactgagatcttggaattcctttcccaggtatctcaaacctgcttccagagcttgtgaagacttcgtccttgggtctattctcctgagaacaagccatgccgacagttgaccccatattcttgagaggtggcctagaagagcttgcatatgtggactggggtgttcacatgcagggcaaagccaggggtagaaatagaagagaagggatggggcaaggaatgggggctgagagacatctctccctgttttctctacagagtccaaacattctaaattcaaatcaagcatcacagattgttataaaggcacatttgtcagggaggaggatagaacattttatatagcagctgaatatttgtggtgtaagggcctctgcttgtaccctagtgtcaggtcctgcatttgttatggtgggctggaaagaagacttccaagaagtagagatttgagatcgaatttgaaagtatgagatttctctctgtgttcaagccactgtgagtgatcagtgccatgtagctgggtcatgggggaagagtctgcagataggcccatcaaaaaagacactggaatctggaataccacagcattggaattttggccatgggccatgagaaatttttgaaagtctctaagagagacctgaggtaattagatcggagtttaagggctatgactctggtggcagtgaggagcctgaacagaagggacagagacttgaggcaagaaggccagtttggtagctttttcagctgtccatgktttacagcctgaacaaagtccatgtcagcttgttctctgcagccagaatctatattcttagtggctacttggctctcagcaaagcacagcattccctgagtcaggaaggcggctcccaatgaggaagcactgaagacaccagcctaaggaaatgccctatgtttggaaaataaaattccttctaatccaagaataatctatctaaagcccaaagcagacytgtttctcatgtgtggataaatttcaagaaatacctgtgttttctatcattatcataacaagctttaggctattaggaattcagagtaaaaaaaaaaacaacttttgtttaatttgtaaaattgttattatttagtttacattgttcagggcttcacttcccttgctctttctatggattcaactatgcccaggtgtatgtatttgccttgagcttctttctttccttttctctcttctttctttctctttctccttccgtccttcctttctctttctttctttctgtctgtctgtctttctttctctttctctctttcttttctttctttatttctttctttcctttttctctttcctttctctctttctttatttctcttccttccttcattttttctttttctttcctttttaattgttctttacaggacaacagctaaaacccatgctgtgtagcttgggacgtatcactggagtttaaattttaaagtaaaagtgacatgactagaagcacatgtcacaaagaccttggtgttcaggaaacaggacctgaagagtaaggactggcaaatgaaactttatagaatggggcaggaaatgtgcaagcatttttcattgctaaaaacatgaggttaagtatgttgccctgacctggagcagctggctgacacttctgccatatatgccagggacctcgcatggcttctcctgaaggacatacaattgctccctaatgcacaggcagcatttgtagaactgtgcattcatatatgccatttaccagaatctagccctttatttcctccaaaagtactggatatgaatctaaagtttaaatctctatataggataattttagttatctagaaactttcttcttttatgttcttgttagttgttttgtagtaatacatgacagtatatgtttaaacattgtgtacaactctttaactactatagggtgggggagatgttttattcagatgtcactctatataaattacacttaccttcctttgatttattgctcaaaaacttattaactcaacttgtggataagctctgtataaggcattaggtatccaatagtgtacaagatagggatgattctttaccttgtggagctttcaatccagcctgaaaggcatctagagcagcagtaagaaggaagcatgtgaaggacctgctcagggccacttagggtacactgggagcttccacaagggcactatagactgagaaggaagaggagaggagctgagggaggtttcttaaggaaataacwgttcatctgaggcctcaagaatgatcaggagctactcaagcaaaataggggcaacaagaattccaggcagaataaatcacatgagtaaaatcccagctgcaaaagaaaatttagcaagttaagaatttttaaaaaaaattcatcataattgatgtgtgatgtgtagtgggaactggactgcgggaaggtggaccaagtgggcaagagactgaatgtgggaagatggataggagtcaggtatacaaaaaagggcaagtgactgtagggttttaaggcaggaaaaaacaccattgtggctaaagctgagaagagattggatgggcaagactgaagacagggagacctgttaggaggctgttggaataacccatgtgtgggatgcctgggtcagtgatctcagctccatgtcccgctgagagaggccttccctgaacctttgcctaaattagagccctaggacagtctttcacagagccctacattttccctgtatgggatttattaaaatttataattgttcatttctgatgtgattatttcttttactgaatgtctcctttactaaacagtgaatcttttcagacttattgctatccccatcacctacagcttgcaaataggaaggactcaatcagtatttgtgaatgagtgaattaatggataaatataaagagaagggagtgaacagatctgtgggattcttgggcattggaatcaacaggacatgatgattgcttggataacagctgctggtaagggagaaacagtttctagtttgagtagccaggtggataatggtgtcatttatgagaaaaggaggcacttagggccagaaggggtggtgggagaagcaggtttttggcagggggtggattatgagttcaactttgggcagatggtgctgtgtatcagatttggttttaatactggaagctacatttaaagtctaccctactcaaaaaatgacaaatcaataaagtaaataaaacacaaacaaaagaaacaaacaaacagaaatatggatgggcaaatctgtttcacttttgttgttcagtttcccacaggtttccctttctagttcttctattttarccaacaaaacaattcatcaaattatcaatatgtgatgtattaacatagagtctttattccacaaaagaattccattttctcagataaatttcacctttacattcatataagcattaagaatcaagaaaaaatattaagataatgtgactatggtataaatcattttgctttaataattttatcttattattacatttttgtgatcaaaatggaaaattgaagaaaatgtgggagatcttttctgctttcttatttttatttattaaacatttctaaactggatttctccattttgaaggctttgattaaagtcaacaaagatctcctacctacttaaattgtcctttaaattgcagctttcatggtggttggaggaaatgtagcattcccaatgaggaaataacacatcaaaacttgatttatgaatagtaacactgaagcattattttaaacttcactcttcaacagcaaatcacagattaaaaggaaaaggaactaaaggctctgaagattttattgtaaattttaaattctaaacttgggagatttgcctgagtaccaaggagggtaataatcccagaatgtgttgagttcaggtttaatgcaaaaaaagtttgctttcaaaattaattccaatttaattaacttttctctttcttccttctttcttccctcctcctctcctctctctttataggtagttcagaagtgtattcctttcctaattgggcatttgaaggattcaacccataatgacatcatcctaaacatcctcatagagatagcagkctatgagccagtggctttgaacwgttttcttccaatgctgaaagagattggtgagagattcccctacctcactggacagatggcaaggatttatggagctgttgggcatgtggatgaagtaagtttggcttttttctctccattcccctgaattgcactggcacttaatccaacctatttaataggttggattattatgacgtgcaaatttgtcctggaatttctgggagttccaatttctctttgacatacaaatttgtcctgggatttctgggagttctatgacatacaaatttgtcctgggatttctgggagtcccaatttctctttcagtccttttacatggacaatggcctctgaatcaagtagcagggttatgtggaaggtttaggaagtgagtcttttattgctgctgtgtcacctgaagaaggagggttaaaatggagagagcactgaaagattcaagaccactttgcagtaacaacaaccaataaaagagctgtatctcatttcaggttgcaatttctcttaacccaggagaccatcagtaagcacagaattagatttcatagactaccctttaatgagagcccatagctatcatgtcaataagtgcctgggttcagaatgttttcagtcctctgaatgttatttgggagagtgaaataaacgtttgtggatgtttaaaagtactaggctaaatatttgcataatggcatctttcagtagggacaacaggatgccatcagagtttatggggattaagaaagttttcagaaattcaggtttcaaagacatgcatgtctctctgatgatttcatgttgggatttaggatttttatatattaaaataaaaacaaatctataattgactgagagcttttccttgaacccatttatatataatataattagctattcaataagtataaaattgtccaacttttaaaaggaatttcatagttcattgagttcaatcccttgattctgcataagacaaaattaaaaacagaaacattatgtgacttacccaaactcagattgagtgagtaacccagttagaattagatctttggtatcttcagaatccattttcgaattttgtcttaaaatgcatctttggtgctgtttgattatatttcttctgagaattatagtgaaccccttgagtcctgcctggcttcctcctgggtgaggctctttctcctctagcttcccagaggagggcgggagaactgagttcccaagcctgcacctgtcaatgtgaggatggatcttcaaaggggatttctctggtgtagatgtactcttagtataatccctttctatgcactgctgttgggaatgcctcaccacactctgccttctgttaatgctttcccttgcttgtcaccttttctgccaagagaacccactggtatgcctgagtgttattaggccaactttgcctgacagctgtttaactgaatctgctgaccttgcagatctttgcaagaaccaaaaaattcaacctctgaggtgtgaggccatcaaatctttaaaaagtgaactctttctgcaatttaatggtaattctttttgtcacaaatgattcattaatgtatagtaatgcacactggtgttgactaaactcccatggaagatgtaatctgtgaaaaacaaaaaacagtagccacatgcagtataaccatatgcaattaagtaactgtcagtttgtctgaactaaggctgtatccatctattcttgcactgttataaggaaatacctgggactgggtaatttataaagaaaagaggtttaattggcttgcacttccaaaggctgcaacaggaagcatgatgctggcatctgctcagcttttggggaggcctcaggaaaacctacaatcatggtggaaggcaaaggggaagaaggcacctcatggccagagcaggaggaagagagaggggtgaggtgctaccccacatctcatgagcactcactcactatcatgagagcagcagcaagggggaaatccaccctcgtgatcgagtcacctcccaccaggcctcacctccaacattgaggattacaaatcaacatgagatttgggtggcaacacagatccaaaccatatcaaaggctaacctgaaagagaacagttcatttggtgacacttgtatgactctcagtgggtaccaggagaaggagaggtggatctaaatagcctgaggaataaattatttcacagttcaaatttgtttgctttttcccccaaaacaaacaaatctttctggtggttctgattcaccccccttcctgggacccatagcagagaacaattgtagatcagataattaccaagtatatctggatatcaggattacgtgaggagcttttaaataatgtcagtcttggaycccatagaatgcctactaagtcataatctcctgaaaagagtaccagaagtctggatttacgggaacctgtgccagggtaattctgacgcagctatttgtggatcagtatttgggaactccagacagagaatatttaaggtgctttctctcttagatttagaatcaggccttgcccatcacccatcatcctgccctcctccatcaagccattgctaattaatttaataattttctagactattgatatagcagcttagagtagcattggctaagagtaacacaaaaatccaaaaccacaataacttaaacaaagacagatatctgattctcttacacataacgaagtctagaaggcaatctctctagagtgccatgtttcagagacccaggctccttctaccttattgytctaccattcctgagtgcaccagaaagcaatagcttctgtctcatggtccaagatgacactgtctccacccattgcatcagtctttcagccagcaggaagggggaaggggagaaggaatcttccaggccatcaaacacaaccttttgtttacaatccattagctaaatagactaaagctgaatatgaccacgtgtagctgcaaggcagactggagcatgtcacctggatttgggtggtcccatgcccagttaaacaggggacaaaggtagaaagaatgatgaagaacaaacagctgttgctgttgcaggtggtcaattcatttcacatttgtggatctgttttctctcctcaaaaattaatggctttacactggattacctcccgtatgctctgatattatttgattccatttttccattttatttaggatcagtctaataaaattacctataaatgtcaggyaggctcctttgctcagaaataatgctctttcttgattatttgtaatgcctgaaatattactgtaagaaagttattttagccataaagaatgctaaatttcagatgtcccaagaataagtgtagtaatctaagcagctagtaacagagtaatttgagtaaatttgtccaactttctaaataaaaccttgtggagcaatatttctaaagaccaaagacaataggcaagatgtgcatgtgtgtatatctctacccagcctctttccaaaaagaaacaagaagttcctgaggtacattgagaggtgggcatgaaggcagatgcccagtatggggtcttgggtaccaaagtgaaaggaaatgtcaacaaagaaagaaaggcaaaaactgccctggaaaagccccaccactttctatgtggaaagcttggtctatggggagacaatgaaacatgggaccatataaggcatggggattttgggggtgcttgtaagacagccacaggacccttgtgacctctagccttaggatcgtctcccttatcctattctggtctcatctaaaaattgactccatttgaaatttttctctttgacaccaaagtggtcctgtctgttgggtttaggggttcaaactgtcagataattttatttccaggatttaaaagattttggaaatacagaaaagccaatccaactttgagatcctgctccaacttttgtaatgtacaatctctgactgatcagagcatactgactgatcagagcatataatatacaatctatgacttatcagagcatacctcctttgttttctggtttccagcaaactccatggtttgatctttaagaagagcagagtctcctgtgggtttgcaatcttcagtccagaatttggccatgggggtagagacggcctggaatcacacaagttattrattggcttatgcctcaccttctgtgcttgcataaagccaggtgtaagaactgcagggctggctactgggaaatgacagggtgtgcctgtctttcaaatgagtgcccatctgggtgagcagactgttttcaacagcttgatagcagcatcacaatttttccatctatattacattcrgcagagaagagttgtatatataaaacaaaaaccaaaatcctacagattcttattttctctatctcccagattaactcagaaatctttttgcccaaacttaaataaagccatgtttaatartcatatagtgcttgtgtcactgtggaggccatgaatgactcacagaacacttccagggtagagaaatttgcttctgggagaaccgatcaattgttgcccttgaggtgcacctttcagtaaagatctatccagttctttataatgccaggatttgctccatttctctggtatgctcagttgaagtaaattcataaataagaaatagtatttgattaaatatgtccaaaacacagcaaaaatacatgggtcattttgtctttctcaaatgagaaggttgcagtggaaacctttcagacaagagcagaaatgacttcttagtagcacctaagggttcattccccaaacaaccatccagcagtttatataaaacacttaacacagttcctggcatattaaaaaaaaatgcttgatggatttcaactaacaacaacaaagtaacagcagcaatataataaacgaaacctgtctagctggagaggccaacgagagagggaaaaatacaagtgtgagtgtacttcctcacacaaagtcttctgtggtctcatccactgcctatgggttattatgcaaactccttggcatggccccagcttccttctgtagcttcacctcttacctgtccagtctacttcattcccctacattctgactactcaggrttttacacccttccctgcacaccctttactctgacatacgttgagaccttcacagcttattctgcctggatagcttttaccctcttctcctacttatcttacctgacccagctcaaatgttgcctcttctgtgagttcttcccagtccccttaggcaaagttagtcactcccagtctatacttccatagtaatttggttgtaccttaaatgtgtcatggttgtatctcaattatgtcgtgttgcaatttgcaggttaatgtctttttctcctccctatacctctcagcttccaggggaaataaatattatcaaatccatctgaattcatctgtggccataagactgaatgagtacttgagaatactggtaattaagaatttgagggttgatttctcacttgaactttgattccatcaagtctgtctacttattctagatgacataattataacttaagagagaggaggaggaaatattagtgtggagagggctgtatacttctgagcttatacaatctatctctgatatctagcaggtgaaagatgagaataaagttgacaggggaatatggagtcattatacaacaaacatgtgatgagccaaggccatccataatggctgctaggaggtgacataaatgaaagatgatactgagtagattataaagagattttcatatacgaggcctcagcaggctgcaaattggttgaagtacagctccaagaaggagcactcaccactgtagactgagcagtgatcaccaccaaggaactctctgtgcaagaatccattacatgaatgratttgcttacgatgagggcaaaagtaacacrgtgactaagagggtgtgcttagagtcagcctgccttgatttcagtcctgactcagccactcaccagctatgggcaacttacatcacctctcttgactcagtttcctcatctgtaaaatgggaatattattcacctcttaggtttgttgtgaggatttaatgagttaacccatgtggaacagtatttagcaaatagtaaacatttgataaatgycagcactttattactttactcagcattgtccaagtctttctcattgcacttatttgtatacaggctaaaacttgaccctaacagactgaaattagggaggtgaaaactagggaaatggcttaccttgcctctgcttctccaaggaaagcagctgaatgggtaggcatatgtgggaccagtcaaaatcaggagacagaattggaatgaggcaccgtagacaaccacatgtacattaaaggtggaaagcatagctggctacacaatttttcttttttaggaaataactggtgtatgtaaatttttattcctcggggtggaatgtatatctgttttacatttgtatcgcagaccaccattcgtgggagaaataaggataacaaaaataataaacctcattttgtaaaccttcataatttaaaataggccttgttttcttgggccactggaagtacattgctttccataaagggtaggtggtccccacctccccagctatataaacagctcaaataagtttgcagcaattttttaaaaactcttaaactaaatatgaagtggtttaagttaaacccaaactaggttgatgtttctcgtccacagaggaccaaaatagaatgtttgtttccactttagagggttttactttttcattatttccttccctaattagactctcttagccacgcaagtggtctctgctcacttgttaggtattatcgttattatagccctctttcctaacatgggtcaacttggaaaagagaacactttaggaatggcattgattttttttttttttttggkaggccaacttgaattcatgtatctttccatctatttaagcctcaaataagtgaactgaaacaaattttagtttaatagtcatctttactttactttagggtctggtcttattggaaagcacataccagtatgtagcatgcacttcattaccatgcccctcctctgtgccagacctacaaggcagtagacctagtggtagaaacagagacaagatgctttaaaattttttttacaaatgatctcatagcacgtggaaggatgctatggccacttgtttttccttcactacagaccaatagcycgcatctgtgaagaatcaaatagcatgcccctgagtgcagccactgccatcgtgtgtgttaaatcctgtgccctctgccttgtttttctaactagctggaatatgctggccaagcaccagggcgtgttcattacatcctctctgggctcagagtcatggacacttttcaagtaaagaagtgacacacatcttgcccaggttgcatttctgtgacatccggcaggcctacaaaaacactttcaggaggaaaaggaaaagaatgacaaaggcagctgagagccacattactgtcctcatcctggctgttgaataacatcctgagaaatgggagctgggtggatgatttacacctttaaattacaaatcaagactaaaaaaaatctggggtccgttctacaagaggaaggacctgtgacttaaaagcacaatttccccagggatgataaacttagttaaaacattggtaggttcaatgactttggggatacattttcttaaaccttggttggtgccagtggctgctacttaatattataaaactgtcatgaattggggaaggatttttttccaaaatgaaaatagcttttatttttgtttgtattgttaaaaagggtacatgttaactgtaaataatattagtaataaacctcttacaaagtataaggaaaacaaaggcaaactttgagtacatacaaaatatactttcaaataagagtattgatgttgcatatcctctctccctcagtgatatagggtggagctgctgattctttctaactgtaagacccagtactggtgatggggacacagaggagagaaagacatggtccctgccctagaggatctcacaactggggatgaggaagatgtaaagacagataattggaatttaatttggtacttgctgttactgaattttgaactggaccaggaaggaagaaactaaccccatgtgggggagttttaggagagcattataagtttggcttgtaagatgatagggttatgtcaggggaakaggargaaggtatccatggggaagtcaccgcattcagtggcagtcagccaggaaaaggctgtgagtcttctagaaaccatgaagcatttcaagtgcttggagcmtaggatgaataatggaggggagggggagagatgcggctggacagtgggctggggtcagattatgaaaattccatattgattagcagatagttcctgttttcttccttctctcagctgattctaggaacagtactttatttcccttcatagtgcggataagtaaatgtaatcctatgtaccttagcgttcccaagaaactaaagagctggygaaaggacaaacagttcccaaaatacttgcaaatgtagagtagtaaataatggttacaaaagttacatgttgcaaaaattttcaacaatgtcttgtaattattaactgtaatttgggccaactgaccaaatccacagaagacctgcagttccctgtgagctgggacagtttggcaagtcccataacatggctgcacatagaaggagtgtctgcaagaccaggatcaaactccagaaatcggcagcctggtccccgcagacttgatcttcctccttccagaggaggacgatctgactttcctacactggtgtctgtgagggaagtaggtgcctgcctcaagaaagacaggaagccaccacttagtaagtgccctttctagccatgagcctaacaagtgaacaaatctcagattcaccagaaaggacaactgggcattggcagcaggtgagttgaagaggacgaagcagttgctaattccagctcaamtcctgctgctcttttaagatgatagcaggtccttgccctgcctgtagccctcagactgaaatcacttgacttccaactatttccaacagccagtatttgcatttctttgcctatggcttccccaacttcacaagccattctgctaagacacatggcrtatgcatgtgaggaatgaatgctgtcccatggcatcctacaaccagtgatgggagttggygttttgtaaacttccaaaactcctttacccctcaaatgaaataaactctccctagaatttcccaggctactttttgagctgtttcccttctctttctcactcttctgttcccctattggtttcctgaagttttcaaataaatgatttgcacttaaatcatctcagggtctgtctgtttctggaaaccccaatccaagacaaagacatttctaggactttcccaagccattgcaatctgccctgctgtgaatatttgagaacatacatctataacacagagtttagcatctgatggttttctsgttgcatttgcttttcatttatttagtgcatgaatacacacactcccaacccaccataagcactctgaaggaaggaaccataccttatacctcctcgtggccctggcataaccccccctcaagtaattagctcatagcaggtggctcacaggtacttgccaactaactgttccatagagactgaaacttggctgaccatcagtgtcttgtactagtagatggcatctgatgacatggcaggttgtgtttgaggaggtcaggaaaactagagacattgggttccagtcaacagttatggatactggtttttcaggatctgtcggtctccatcccatgtggtccccaaagtgtccggaccagcagcattgagtgttactcagaaacttaaatcagaatccataattgaacaagatgcccaggtggtgtgtatgcacatgaaagtgtaagtagtactgctcctgaggatccaggccctacaggatttatctgctatagaacctgagggagtctagacatgcccgcatatatactacctgcttgatgcatatatgtttccagacacacacacagctatacccaattttctttgcaagacccacttgtttttatgtaaataatcagtaacctttaacagtcataatctttgacaatgtcagtatatacatgaagtcaggaaatatcatgcattacctacaatacagtttatgaatatttatcacacacctgctgtatgcaaggcactgtatgcaagtgcaaagttaaataaaatccaatccctctgctataaaaaggggcttttttattcacttagaaatgatactttactcactcgagcccaggagttcaaggcagtgagctatgattgtgccactatattccagtakcacaataaaataaaagaaaaaaaagatcctttaataggcaaaaattgtgatgcattgacacttttgtgtaatattcttagaattcctcactccatccccactcctgtataaagggagagggtgttcctaaataatggtttacacggaatatcacaggtgggtatgtacaagtcttttctattgcttaagttcttgtttttattttttaatgttatttgatttttttttgtagctcaagtaggatctgaaagcattcccagaactccctataggatttgacacagaggtattatcactatgatgtaaaatcgtgtaacaattgtactctcaaaatatatgaggagagtaattggaagtagatgaattttgttgcaaagccatgactaactatactgtcttgaaattatatttacatttcagccttcttcattatttatcaaaaaagtaaagcctgaatttattttgtagtgagtagggcttaggaacttggtactggtttacatgaacagagctgaagccctctaagaaaatatgcatctaacagttggcttagcaacaatacactatcacactaaaatgttcacaggtatagatcataatattaaccagatggttgctgtcatctacgtgtattcatgtagataacatgtaagaaattacactgagagggtatcttgacatcagtttatttcttgctaagtaataaagtaaatgaataattatttattgctttttaagattaataaatatgagataaatagaaaataaatgtttccataactgttgatgagtaaatgaaagtggtctgggtaatgtttcccaaccttcagtgcagtatagatcctataarggtctaaacatctaacaattcactcagaaaagtagaaaataaacctttctaaccatcttgcttcattgaaatctctatttactatgtgtggttgattttttaaatctctggattagactaaactcctactcctgtctacattctctccmgctcttccttctgctgccttctgctttaagagggcaaacttccttccgctttaggcagcattctcccacaataagggctcctatctcattcaaatcttcctttcttcatccagaagagtttccagagcccaccttctccatgacagctacacatttctaaagcactgtttgtctaccaactcctccttcttgrctagtaaatacaaaataaagctagggggtaagagagwgatagaggggcaacagcaaaagttacaaatgttccctgaaggaaacaattctaccttccctcatcttatgaagtgagaataacctcaaaggcaagatgcatggatttgagcatcccatacaatgtacataataggcactatagatacagtgaagtgactcttctgttcttctattgaaaaatggcaagattaaaccattgttaagatctcaacataaccctatctaaaagtcctaaactgttttactctatttccaccatttacataaaggggagctacaaatgagtggaaacaaatttggaaactgatggttttctccaggcaagcatatttcggactttttcttctgcagacatcctaactaggggtatcttcacaaccccattctattaactgaaatttgcttccattcatttattcacttgttcattctctgcttacttctagaaagcagttaaggcagttcacaaggaatcacagttgctgcgaaaccaaaaaaaaaaaaaatkaaggaaaaatccttgaactaaaatagggagtgttagaaggtttggtgggtaaggtaccagagaaattattactacatcaaactttccctagctaaggaaatcaccaatccaaggcaaggtttacacttttgcaaaatgcatttttccattttattcttctctataagtaatgaaatatacccaaatctttctgyctaacctgtattttgggtgttacatctcaactaccatgaataaaacatcctggctatttgttttgaaaataagtaggtgcaaagaaaaataggcaccttgcatctaattatctaatgagtaaattatgtcatgtaatgagtaaattatggaaagttcaattgtagctgatgtatagttcaactgagttaaatcttaccatattgttcctttttctaatgagctaaaagcatatacttttttcctggcaaaaagttcaaatacaatcagcctytctctttttatttctattttctttctttttggacccataataggcatcattcttcaaaatgatttccatgattgggccagaaggcctgtggttacttttctctttcactcggagattgcacctcatttactaaacagatattgtgtaattaaagatgggctgtttctttgagttctctagaaatttttcaattctaaagtccccagtggtctttcaaaaagtttgtttaattgaagcaaaagaaatagtggggccattgttcaggattatcagtgagaggtcatttacatgaggggactatggcatggtgggagaagaaaatgtggctaagtataattcattctgggtcccttgagcccacacaaaagatttaactttaagaggctaagttcccaagcccctagtttttagagagtaaatccaaactatagaacctctaaatcttttatcaattcataaaataatactatgtttgaagctaaaattagatagacttccataagctttaagattctgtaattatttggrgtcagtgcaacaaaaaaaatgctggaaaataaactcttagcacaaatggagggggatttgggtttttaaacacatacatggccacattgaatgccatttagggaaaaataatttgaaattgaaaaaaacttatttgacagcagaccatgtcaagttttctgccctttaaaaaattcaaactaaagaccataatttattgtctcaaatagcatagcataaagttaagctacctctcatatcctctgatttctattttaaatcctaagtcaatttcattcaaacatctttttgggaaagatatactaagttccacacttaactttagccataattgtttcataattaaaaaattataccttgctttttttctcaagggtggggtttactttagcattctgtgccaaatgcatagacctgaactaaatccaacttatccttaatttttaacatgttacaaaatttaagattcatataaaacaaagaatacatctgttttcatcagctatttctcaacttttattactgggatttattttaaaaaattgtttygcccagacagctttgttttactaagcgtgatttattactctcccatgagcccacaaaaagtgcgtgttcctgaatcaaaaataatgaagaatggaaacttattccttttacaattgacaaaatgatcatttaaaatatgtaaatatgtttaaattctaatagggtttttataatcaatgggtagaaaaatatattcaattaccccaagctgatatacagaaaaattgagacacaatcaaaaaataaaagaaagaattgaagaaagtgacttttgtaatgctattctaaaaatcggctcaaagttggagaattatctacctaagagagagattaacaaggtttttatttatttattttctgctttgttccacaaaaaaaaatatttcaggcagcttgcctcttgatgttctgttaaaagattattgactcttagcttttgaatatgattaacatttgatgtctactttcttggcaagaattttacatgtattttatgctaatattttaaggctaaaatagcattttcttgtctgcgtggcatactttttaaagaatgaaattttttaattgtaaaaatatcttggaatttaaagattactagatagcttgacctttactggcttccgtacttcaataacagcaaatttttgaagaattgaagactgcaatatttttacttcagaaacaggaaaagactgaaaaagactgaggaataattacaaatagaaaatgatatagatatctagatatctaaaataatgagctaaatttgggttcaggtcacaaagaaaagtttaagttgtatagtgttttgatgtaatcacgtaactgcttttaaaggagaaattggctttcttggtgaaatgttgaagatatttcaattctaggtaaagttttttgcaagttaccaaaacactggctcacatttgcttatattgagttggttttggggtcttggacatttctagaacttcccaaccattatcaattctcaatataaattaactgggaaaaattaaagggctatatagcttctaaaattgcttgttttcatttttgtgataattcaaatctttctgcattcatgtttaagatttttgatactcaagtaataataactaatgttgatttaacatttctgtatgccaggcattttttaactcacttttttttaactcactgaagtctcacaatctatgatggtcagtattaggtgtcaacttgactggattgagggatgcctagatggctggtaaagtawtgttttggggtgtgctggcccatttgttgagtgacctgaaaggcatctagttttgagtggggcccagaccagaagtctctgcaacaggtctaaactactgtgcaagctgctgtacctctggggccatatgactcagcagatctagtggtgcgtgaggtatcagtggcaaatagggatgctgtcgggagcctttgggaggtcctcataggtgaatcatagttgagcccgccctttaggattctagagcaaggctctatcatcttctgcagataactccttttttttttttctttgagacagagtctcactctgttgccaggctggaatgcagtggcgtgatcttggctcactgcaacctccacctcccaggttcaaacaattcttctgcctcagccccctaagtagctgagactacagttgcgcaccaccatgcccagctaatttttgtatttttagtagagatggtgtttcaccatattggccaggatagtctcgatctcctgacctcgtgatccacacgcctcggcctcccaaagtgctgggattacaggcttgagccaccgctcctggtcgacaactccttttgagagacagctttggcctgctactgggccttggtagaaactgaatatttgactacagatcaccaaatttgtatgtgacctgaactggctatcatgaactgggtgctttctgacccatcaagacaaaattgggtgtgcactgcagtattccatcatcaaagagaagtggtatgtacgtgaycagggttgagcaggttgtgagaacacaaataagttacatgaagaagtagcttaaatgcccatggtctccactcctgctaccctgccttctgtctcccagcctgtacctatggccttatggggagtttcctgtgattggttgacagaggaagagacgagggcatggtttacaaatggctctgcatgatatgtggcaccaaccaaaagtagacagctgcagcactataggacctctctgggacatgcctgaaggacagtggtaaaggaaaatcttcccagtggggagaacttcaagcaatgcatgtggttktgcgctctgcttaraagaagatgtagccagacatgcaggtatatacatgggctgtagccaatggtttggctggatgatcagggacttggaaggaatatgattagaaaattgatgacacagaacaatagacaagcagagagccaaatcatgaatgaagtcccattcacaattgctacaaagagaataaaatacctaggaatacagttaacaagggaagtgaaggcyctcttcaaagagaactacaaaccactgttcaaggaaatcagagaggacacaaacaaatgaaaaaacataccatactcattgataggaagaatcaatatcgtgaaaatggccatactgcctatagattcaatgctattcccactaaactaccattaacattcytcacagaattagaaaaaactactttaaaattcatatggaaccaaaaaagagcccgtatagccaagacaatcctaaacaaaaagaataaagctggaggaatcacgccatccaacttcaaactgtactacaagactacagtaacaaaacagcagagtaccagtacaaaaacagacacatagaccaatggaacagaatagagatctcagaaataagaccacgcatctacaaccatctgacctccaacaaacctgacaaaaagcaagcaatggggaaaggattccctatttaataaatggtgctgggagaagtggctagccatatgtagaaaattgaaactggatcctttccttatacaaaaattaactcaagatggattaaagacttaaatgtaaaacccaaaatgatcaaaaccctagaagaaaatctaggtaatatcagtcaggacatagtcatgggcaaagatttcatgatgaaaatgtcaaaagcagttgcaacaaaagcaaaaattgacaaatgggatctaattaaagagcttctgcacagcaaaataaactatcatcagagtgaacagataatctacagaatgggagatttttgcaatctatccgtctgacaaaagtctaatacctagaatctacaaggaacttaaacaaatttacaagaaaaaaaaacaaacaacccaattaaaaagtggacaaagaacatgaatagccacttctcaaaagaagacatacatgtgatcaacaaacatacgaaaaaaagctcaacatcactgatcattaaagaaatgcrgatcaaaaccacaatgagatatcatctcacaccagtcagaatggcaattattaaaaagtcaagaaacaacagatgctggcaaggctgtggagaaataggaatgcttttacactattggtgggaatgtaaattagtttacccattgtagaagccagtgtggcgattccttacagacctaggaggcagaaatactatttgacccagcaatctcattactgggtatatacacaaaggaatataaatcattctgttgtaaagatacatgcactaggatgttcactgcagcactattcacaatagcaaagacatggaatcaacacaaatgcccatcaatgatagactggataaagaaaatgtggtacatatacaccatggaataktattcagccataaaaaggaatgagatcatgtccttttcctttgcaggaacatggatggagctggaagtcattatcctcagcaaactaaaacaggaacagaaaatcaaacaccacatgttctcacttaaaagtgggagctgaacaatgagaacacatggacacagggtggggaacaacacacactggggcctgcagcggggatggggcaagrgagagcatcagaaagaatagataatgcatgcaagacttaatacctagtgatgggttgataggtgcagccaracactatggcacacatttacctatgtaacaaacccgcacatcctgcacatgtatcccagaagttaaaatacaattaaatttaaaagaaaattggtgacacagagaaggaaacaacaaacactggagtctacttgaggcgggagggtgggaagagggagaggagcagaaaagataactattgggtactgggcttaatacctgggtgatgaaataatatgtacaacaaaccctcatgatatgtgtttacctatgtgacaaaccttcacttgcacccccaaacctaaaataaaagttaaaaaaaaagaaaattggtgacaaagaaatttttgggaagagatatgtggatggacctgagtggccaaaaactgaagatatttgtgtcccctgtgtacactcagcaaaggatgaccttggagaggaggattttaataatcaagtggatatgatgacccactctgttgacaccattcaggctctttccccaaccactcctgtcatcacacaatggacttatgaacacagtkgccatggtgtcagagaaggaggttattcatgggctcagcaacatggacktccactcwcaaaggctgatctggctactgccatcgctgactgccctgtctgccagcagcagagaccagcaatgagccctctatatggcactgttccttggggtgttcagccagctacctgtggcaggttgattacattggaccacttccattatggaagggacaggatttgttcttactggaatattcttactcaggatatggatttgcctttcctacatgcaattcttctgccaagagtaccatccatggacttgcagaactgccttgtcgactgccatggtattacacatagcattgcttttgaccaaggaactcactctacagacagaaatgcggcaatgcattcgtgatcatggcgttcactggtcttaccatgctccccttgatcctgaagcagctggcttgagagaacaatagaatggctatttgaagtcataattacaatgccaaccaggtgacaatactttgcagggctagggaaaagttccccagaaggctgtatatgctctgaatcagcatctagtatatggtactgtttctcccataggtaggattcataggtccaggaatcaatgggtgaaagtagaagggacaccactcacmattacccctagtgagccactagcaacatttttgcttcatattcccatgacattatgttctgctggcttagaggtcttagtttcagagtgaggtatgctgctctcaagatagtaagttctcatgagatctggttgtttaagtgtgtggcaccttcccacccttgttctgcattcaccatgtgatctgcctactcctgctttgccttctgccatgagtaaagctccctgaggcttcccacagaagcagattgcagaactatgcttcatgaacagcctgcagaaccatgaaccaattaaacctcttataaattacccagtctcgagtattctttatagcaatgcaagaatggactaacacatgactcctctatgagacagatactgtgattaaccccttttaataaactgagccatgcaaggttaaataacttgcccaaggtccatgtctggttagctacagtgccagattcaaacttaggaaaaagcttctgaacccactttataaacaactatattattgcacttgccttctcagacaaataaggcacagctaggaaggctttacatggtactactaccttttcattcctcgaaggtaaaatttgccatattaatgtttatccaaagaaaatctttcacatgtattgacattttgaacagtcgacactttccttgctagtcccttacccatcaattctactttgcatgcagtaagaaagcctcttgaaacccaaatgccggataatatctctgggatggagaaacttaacccatcactcagacagatcagctgaatctaacagaaakgtggtgctagcagggttttagtagctttgtctcagttgtggttctggattttctaaagtggctctaaacccaccagccaatgagagtatttgagattttattttaaggcttaatatctcaagctctgaacaaacaacaaaaccggaggtaacaaaagtcttccaatagaataggaaaaacaatcatatacctgcagtatatagaaatttacctcctccagagtgatgacygctggttaaaaatggcttttaaaacctgatattggtttctctgcaagggaagtatgaagaagaaagagagatggggtaggaaggggctcacagatgctgccaatgttattgataatttcctgttacattacatatatttatatatattatttcgtatgtagcatatattccataatgtcaaagaaaaatacaatcattgaatatttgctatgtgccaaatagtatacctgatattgaaaacagtaatctttataataaaacatkcaggctgtactaagtaacttatttttaaattcattgatatttctggcatcatcagatcatactaaaaataatactaataataacaattcattgatagcattgttttgtcacctactctatgctagatactttacaattattttttcattgttcctcacaacatcatgaagaagttgtgtcagctaagatgaatttggtaatagcatttgcaactaaagctgattcagaagaaaaatatttattatctcctataacaagaagcctggaaaacagggtgggtcccaggtttgttcagaagttccacaacatcatcaagaactcttgataagcttctttctattctctctctaccatcatcattatatttgaattggtcccataaacataccctcacacttgcaaagataactgcccagatccaggtagtgcatataggtacaacaatgtctggttaaggaacaggaatgtgttcttccatctctttttatctgggaggaaaacatttttcagtagtcttctaccccagaaaacttcacatcaggtccagttgcccaggattaaatcacatacccatgccctagtttaaaaggagcctgagaaatagaatagctattttcactttatagcaggctgggggttataccaataagaaagaaggggatagggtgagatacaattagtgataggcaatcaaaagtatctgccgccgaactgttagctccaatctacagatgaagcttaggctcaaagtggttaaataagatgctgtgccttttaaatgcaccatttagaccaagcttgtccaatccacaacctgtaggccacatgaggcccaggacagctttgaatgcagcccaacacaaattcataaactttcttaaaacrttatgagatattttgtgattttttttttagatcatcagctattattagtgttagcatagtttgtgtgtggcccaagacaattcttcttcttccgatgtggcccagggaagccaaatgattgtacacccctgatgtagaccattgatatagtttggctatgtcaccgctgaaatcttatattgaattcccacatgtggtgggagggacccggtgggaggtaattgaatcatgggggcatatctttcccatgctgttctcgtgatagtgaataagtcttatgagatctgatggttttaaaaagaggaattcccctacatacgtgctctctctttgcctgctgccatccatgtaagacatgacttgctccttctgccatgattgtgaaaatggactaatacaaccatttacattcaaggttgatattgatatatgaggttttgatactatcatgaagttgttagctggttgctttgttgtttctattgtgtggttgcaggctatgtacttaagtgtgtttttgttttattatttagcaggtatcattctttcatttcatgtttagaactcccttaaggatctcttctaaggctgatctagtgttaacaaattctcttacagcttccttgtctggacaatattttatttctccttcatttatgaagctttagtatggcggggtatgaaattcttggttgaaatttcttttaagagtgctaaaataggcccccaatctctccttgcttgtttctgttaagaagtctgttagcgtgatgggattgcctttgtatgtgacctgccctttttctctagctgcctttaagatttttctctttagcattgactttggacaatctggtagttacattccttggtgatgttcattttgtatggtatctcacaggcattctctggatttcttatgtgtagatgcctacctctctagcaagattaggaaagtttttgtgaattattccctcaaatatattttccaggtgttttactttttctccttctttatcaggaatgtctgattggtatgtcactttacataatcccatatttcccaaagactctgacctgagtctttggactgcacagtgtctgtgcagccatgccgctggtaatggctgactttatatgtacctggattaaaaatggcatcccgccatcagtcccaggtctgggaaagtgcagtttttcccattgtctttccctcagaatatctccaagagcctctccccaagttagctctagggcttgaaagaaacaaactgctctccctcagcttgggtggctkggatccccagtggaaaaatgagtcacaaaggaggctctctgcctctcatgtactgatgacacaggattcttttggtgctgctttggcagctggaaacctctatggccagtggcacctctgcccaagttttccttgtgaccattgggctggctctgcccactcagcctggcaggctgtgcttgactcacactactggcccagaccccatgcccaccacaggtgagacaggcgtggaacggcaaggggtgtgtgagtgacaaagtacaagatctggccgcagcaagccaggtgcaccagctgctgtggcaggcagctccaggcatcagcagagttgcaagctccatgcaaggctgtggctggaccaggcatgcctcaagcagcttccgctttgggcgctggcatctggacaagaggaatgtggtggtgcccaaaaacttggagatgccagcaaccatggagccccgaggggatgttacagcgtgtcacagctctggctcagggagtcctgaggtctgggcctccagaagggtcgcagctcttttcccctagtctggcaaatgggaacaggtcaccacccacagcttggtgggstggccagaaacatgtttcagcttttatcagccagatgctgtcatgggggctttattccagcattttcctctccaggatctggggtatccttcatgattctggtggagtcccattctccttcttgaattaaagctcacagagctgatctttatgtactatcttgctatttccaaatggctgaggcactctgaaaatcctctaatctgccatcttagaaaacaaaacaaaacaaaacaaaatgaggtgttttttaaaaaatggtcacaaataaccaattcataaccaactccaaaaataaaacaagtttcaatatctccacttaacactacttaataaatgtcttaccaagcacatcaggatccatttgaaaaaggattagtagaaaagttcctcctttgactttcttaaaattacaattctcattctatgagattgggattggattctcattctatgggattggaattataatcgtaaccctaactcattgtcccaaaccaaatggatcttttctttttaaaaattacattgttcaaactttttttgtcttttattgtgagaaccaagaaagtaaaagtatttcagcatatgccagtgctacccacacttttcatattcttctataaacaaccaggttgcaagtgaaaagcaaatgactgtccccagtcttcaatctgcacacctgagttgggtcacatttataaaacaatatgtaatggagagaagaattaatatgtggatggaaaacaatgctcacatggattaggatgattagtaatttgmtaatgaaagaaaagcccaattagtgcaaaggcaataagaaaatctgcccatggtagccaagtagaagggaagataaactggaaaatatgctgaagacctaaaatcaaataaaatttcagctgacctcagtaaagctgatcttgcatctctctgggcatgactgcaaggagtttcatagaaattcatcccctaatgctttggaaaatctttttccttttacagaagatccacaaagatctgaaatccatcaatggattggtccatctatgtaygcatttctatctatctatctatctatctatctatctatctatctatctatctatctatctatctatctatctgcttacctatccatctatttacctatccatccatccagctctgtgattttatattttcaaatttacctacttgctaaaaatgtctttgaaagcactatagtattgatttggggttacaaagtcattcacagatgtgcacagagtagcaaaaaacttcagttgtccccagctgaggttgaacaaagtgatgccctgctgtcttggttcagctctcatactgtaaacaagtatctattcttttcatggcctctttattgccacatttttcttatcttcatgcttttttttgtttgtttttggtgatttcactgtttaaagtgtcccccaagtatagtactaaagtgctctctagtgttcctaaccacaagaagactgtgatatgcctcatggagaaaatacatatgttggataagttttgttcaggcataaattaccytgctgttggccatgggttcaaatttaatgaatcaacagtatatattaaatagctttaaacagaaacacacatataacaatgttatgtatgaatcagttaacaaaaatgtaaccagaggcttgcaggaaactaaccctgaatttcctctagaagcaatacttcagtattgtctaattcagggttgtaattttatggaacatagctacttgttattcccaaataacaagaatcaacatattatatatggtcatccctcaatatctgaggaaaattggttccagaacccccgtggataccaaaatccaaggatactcaaatcacttatataaagtggcacaggacttgcatacaacmtatgcacatcttcctgtgtgctttaaatcatctctagattacttataatacctaatacaatgtaaatgctatgtaaatagttgttattctgtgtttctatttgtattatttttatcgttatattgttttctattttttccaaatattttgacctgcaattggttgtatttgtggatgtagaaccctccaatatggagggccaactgtatctgtatagggaagcatatagagtgatatatcatcatattcacctgcaatatgagtctattgaacagagtcctctgagttgaattttctacctgcctacattctccagaggagggtggtcaactgtcctgatttgcccatgattaaggagtttcccaggacaagggacaagaggcttgcagttctaaaactgggaaaatcttggggcaaagaattgctcccccagtaccagagtttctcacagccaaagaagcattggggtgggaggagagtctagtacaaacccttcaactcttggtctggagctaagtctcttcaattaagaaagagactctcatggaataaataygcccccaggcagttaagcatcactggccacactcaggcttttgaaggctcctaagaaaagcctggagtcactctggcaaagttccattgagagaacattaacaaaaaactcatttgctttacatttctaatggcccttgcaagtgtatctttgatgtgtgtagagacttcaaagagttgaactatgaagaaagattgtgtttaaatcaaatggtgtaaaatacaaatgcccgggaaatgcaatattttcattcaggcaactaatatattattatttttttacatttgtaaagtgataaaagacaggggagagaaaaatgtggattatagggccaaatccacatttcctacatcagcaaattctcaaattctcagagatttaggactccacatagaccagtgattctcctttggctgcacatctgaatcatccaaggggtttaaaaattcctatgcctgagctccacccatttcaataaaattgaacaggaattgggaagcaggagagatttacttggcattagaatagttttaacagctttccaggggattctaatgtgcagccagtgctgagaaccactcacaaggaggacagcactgagaaagaacatcaggaaacttctgggttcagcagggaagaaagaatgctatcatcagctggtgacgtctaccacaggtggagtacagaaaggagggctgcagcctacagagctgccctaaatggtttttatcagccctagtgatgtggaaacattcaaactctggaatcagatgaatcttgatttaatattggctctgccacttatagctatattatacctgtgcaactttagtgaagttactatccctctttacatcaatatcctcatctagatactcattttgcaaggtcattgtgaagattaagttaaaatgcatatgtcaagtaccagacatacagtggatgcttagtgaatggaaactattgttattatccagacccccacattttcatgtttggccattttctgagttgtgttctgtttttctgacaaaggatagcagagcacctttatgaaactggagtagtagtattaaaaaaacaaaataataaaaagtgaaaaaaatggccaatgcaattttgcaaacatataatctagttcaggggtcaacaaattactgcctgtgggccaaatccagccacatccactaatttacttattgcttttagctcttttcccacaacaagagaccatctgacccactaaactggaaatatttactgtctgttcctttagagaaaatatttatttgactcctgatcctgagttcatcaatactcagcatggtccatggacaccaagaccttttcagggaatctgtaaggtcaaagctatttttacaataatactaagacattatttaccattttcactgtgttgacatttgcattaatagaacaaagcaatggtggtttaaactgcaagtgcctaggcacaaaccaagacaagacagtggcaccacactgtactcgtagtcatattctttaccaccacacgtttgcaggacaagaaaaaaagagccagtttctcctaagtcagtgtttctcagccttggcaatattgacattttggaccaaacaactctcggttgtgtggttgtcttgtgcattgtggggtgtttggcctctacccaccagataccactagccctcccattctcctagtcgtgacaaaaatgtctccagacattctccaaatgccctctggggaggaaaaaaatcactcctctccctttcttttccccactgcctccccctggaaaccactgaattaacctgatgaagcagtagaaattattaattttattaaatctcaatcctgagtacacatcttcttaagtttctctctggctaaatgggaaggattcattggcttggcacttatgctgctgattgaaatacagaaattcagtggttatcttaagaaaaaaaaaccttgtgttatttgcctatgtgccaaactaaccacttttttttttttttttttttttttgtggaaccatttttacttgaagtaacaactaatgaacaatctatgattatttgtttggggctgtttggtagacattatccagaaaatgaatgaagtgagcctttcatttcaagcaaaactactgatgctagtatttgctgccagtgatacaatttgagcttgcaaatgaaaattggagttttggaaaatctattatctgccactgtgaacttgaaagtttcccaatacttaaaagacttttctgatgagatcagtggtgaaaatagtgaatgcaatgttttttatattatataatgaaatgcatcaaactttggaagatatgcctaacacagtaaacccatatttttccaaatgactaatgcttaatatttcaaagtcatgcataggtaaaagatttaatcaaagtgcaagacagaccagtggattttaatgtaataggatacaaagttaattaaagtcacatatcacaactaacctttgagaaactacttgttgagttttggtgtagcgtccaagaagaatattcacaattatcaaggctattttgaaaatagtcttcccttttctaacttcaaatctttatgaggccagatttaacagatcaaatacagaaacatatgagaatatagatgtcatctattaacaagttactaaagaaatttgcaaaaatatagaggaatgccagtcttctcactaaattttttgtttttgaaaatgtgattttttaatgaaaatatacattttaaaaattgcctattttaacttccaatatggccaataccaatagatataaaccagataacaaaaactctgggatctttgatcattttcaagagtgtaaagcggtcctaaaaccaaaagatttgagaattgctgatctattttgtatatacagagtatttataatatttatataactaaattaaaaatagttaacaaaaaagaccacataactctgatgatgaatgagatgtaggaaaaaggagtggaaaaatatgtgcataggtcatttagtttttttttttttttttgatgggaggagctggcagtatagcaagtgagggtctagatgtagaaacagggagggcatatgtggccttgagcaagttagtctcctatctgtgcttcagtttcctccttgttaaagtggcaatgattctagtacttatagcattatttggaggattatatgagtaaatacctgaaaagagtatagaatatgcttggtgcttagagtaagtgccctctctgggccagctatttttgtttaataataaacaatgaatttgtgtcagcagggataaggtcagacccacaattaaggcttacaggtgctgaccctacccctcaatggggtgactgaaagcaggaaaatccagtcactagccctcagaggcaaaatatcatgaagctgagaaggaaatcagaatctcctaacccccttcctgccctaatattacactttctaatccaaaatcacatctgttacccctgtgaggtacatggatgtgctccaaggtttcagaacaaatgatgtgaggttggcttggtttcatactttagttccagagcagttataatttttcctgttcctgcactgtgattaattttcccttcaactcagttggctgccagcgatcattcagaattatgttgatttcggcaaatacccaaacaacgaccttcaccttttaaaagacacatgctttaaagaaggggcttgcaaatttttatagtgagaaggattcttaatgaaaccatggggacacttattgcataagcaaatgaaatgtttgtgaaacggtttttaaaaattctaatgaaaaatctacttctgaaagtaaggaagttacctcaaattttaaattacatcttagtaggacaaacagcatataaaattcagttcctgtatcttcctaccaccctatatcaagcaggataaatttatggtaattgttttctaaggttactgagaatgttgagtttagagtctgaaaccttgccaaattcaaatgtcgccttctctctgagatgtgtcctamgtacactatttaccattggctcccccttctgcttcattttcctttgaggcacgtttctccatctaacacactatacattttacaaagatattttgtttattgtctgtctgcctcattattgtggcaggaatttttgtgctttttcttcagtgatatgttcctgacttctagaagggggtctggcatatggtagggaccccccacatccagcttttacctttaaatcaggaatagaaaatgtcccttgatgcattgcatatcatgaattcacacatggagactttgaattaataaatgagtctatgttgcaaaaaaaaacaaaaactgttggatccaagagcatttaagtattgttctgcaacctggcaattgtatgacccaaaatatgaaacagggtctccaggaacatattccaggggtcttttattttcattcatctaacattattctttgatgaatagatgtctttagcttcaactagctgtccagctcatgaaagcacaagcctctgtctcacatacccatacaggacactgtgccctagtggggtttaaaaaataaataagggattgatggcagaagtaccccatttaccccaagagatatgttccagtgcaactgtrcatggaatctttgaaaatcaagtaccaaaaatgagggaacttcactacttaaatttgttctgtattaaatatttattgtaaagcacagaattcctttgtaacaacatactttatttataaggtcatattttgatatataaggttttcttaaatcagtaaattgagacacacacactgggtgtagaatccacaggctcaatttagtgccaggttgatgactgatgactgagaagtagctcctttagaagacttgactggcacatgtaaccattaggaaattataaataaaaggtgagggggattgtgtgttctttaaaagcaagggcatcctttcattcacctttgttatctagagtctagtaaaagcatattataggcatgccatacctatttggtgattaaataaaagcatgagtaagcaaatgatcaaatgcaattaagtactaaaaagatttttggctggacacggtggctcacgcctgtaatcctagcattttgggaggctgaggcaggaggattacttgagcccaggccagsctgggcaacacggtgagaccctgtctctacaaaaaaaaataaaaataaaaaatagctgagtgtggtggcacacacctgtggtgcacctacataggagactgaggcagcaggatagcttgagcccaggaggtcaaggctgcagtgagccatgatcacacctctgcactccagcctggtcaacagagtaaaactctgtctcaaaaagatactraaataaaataaaattaagatttttaaagagtctataatgcagtaaaaatttacacaggagtcactggagacagctgcatggaagagttgcaccttgaaggaaattaaggcttcaaatgctagcacaaagggtaaataagaattcctaacgagaagagtaatctagatctgtgcaccagttagtcagaaggattgtgagcagcaacttccagtatatatttatttatatttatacatatgttccactatactaacaagaaaaaattttagacatacacaaaaataagattttaaaagaaaagttaaaggtgaaataagccatattttaaattgttatttattaatggtatatcattatttctattgggcacaaatctacatttcaaataaccttttcaataattttgaatattgaattttttggctaacttccagtcatgtcagattagatcatgttgcctcaaaatatggctaatgaggagttttaataggtataagagatgtgtcagctaagccattttcttatttgctcatgcctacattattcatattgtccttaatctttcattctttgaaggaacttaaatgactgtgaaagttagcttggttaaacctagataatataatctactcaatcggccaagcatataaaaactgtaatacactgaaagatgcttaaagttaacaagtcagtgagaaaacctgcagcaaggaaatcaacctagcacactagtggaatatgcaaccatcaccccgacagacagatggkttaagtgtgccagggtcaaggctcactttgagaccatggaccgtacctgccccgtgcaggtggagttagcagctcacatagttgtgagaggtgcatgtgtggggtctcatcatttatgatggttgagaggttttgacctggaaagataggttaatgagtatgtttgcatattagtctgtcctggaaatcaggaataaattaaaaatctcaaagaagcagaytcagaggaactatgaatgaaactgattattcaacttgagctagctcyctgagtcagctccctatagaattatcatctgctgctcatgggactctgattttttcttttctatttattaattttttttttctgagaccgagtctccctctgtctcccaggctggagtgcagtggcacratcttggctcactgcaccgtctgcctcctgcgttcaagtgattctcgtgcctcagcctctcaagtagctgggattacaggcatgtgccactgtgcccggctagtttttgtatttttaagttgagatggggtgttaccatgttgcccaggctggttgcaaactcctgttctcgatcaggagttccaagccatccacccacctcagcctcccaaagtgctgggattacaggcatgaccaccatgcctggatgattttcttctaaaagataaacctattttcttcattgtttttggtaggagagagccaggagctgcctgacatacctggtgagccaactggccaacrtggagcattcgtttcaccatattctcctgstggagattaaaagcatcaccgacaccttctcctcaatcttgggccctcagagcagagacatsttccgcatgagcaacagcttcaccgccattgctaaactccttacccgacaactggaaaataccaaggctggaagtggcaggtgagcaagagcttctgtgtacctcagggagctgctgtgcacctgtgggggtagaatgcagacagttaagcctctctaacttccaaaggaagctaaaacctgtatctcaacagaraataatatctgtataaattatggcacttgccagaatctttcttctaaatgtgtgaaaaccagaatgtaacaaaacaataaatttaaaaggttcacaaaatatggtaaargaattagaacatagtgcaagtaatattttatagcacccgtttatttactcaacaagcagttaacaatttaaattgtcatactgaatagtcraacatagcttactatgtatcaggaagctagacatatatagagagataatagcaggtttcttgtattcaagaagctcactgactagtatgagataaatatttaagtgcataatgggagaatagcagaatggccraaaggttatgcttatcaagatgagttcaaggggcatggaaaatacagagatagagtatgtacttctgcatcaaagggagaggggtgggaagttgttatcagaagagtttcctctgaagaggtgatattttgaaccaagtagtgaaagatgaccagatttcaccaggctgtcttttgggcagcatttgaaaaagcactttctggaaacagaagtcattttgtatgactagggttatgttacaaggaaaataacattaggagatgctgatgaagtggtaggcagggaccagtggatgataggctcaacagagtggactaaggagttcagttttaccctctaagcagtgaggagtgattgtggagctttgtacatggcagggtataatcagtccagattttaggaagctcaccctggccccagtgcagaggatgtctcaggaagaggcagatgagccagatcaagtgagggaagagcagaaaagtgtgcataggtgttggccatgaggaaattattgacgattgaggtgaggaagctgccattggtgtggctagcagaaaacagggtgatggggcttgcagagagagtggacacaatgcacaaactggccttttcaagaagcttgtctttggaaaaaatatacaaggccatgcaaggttgagggaggggttttatttgtttttgctctggtttgaatagagagaaacttaaaaagctttatgacctttagaagttacaaaagccctttatgtatgtaatctcatttgatcctcatgaccattctacaaggcaagaagggcagatgtcacttactcctactttatagaagaagaaacagaggctcagatactggttaaatatcttcccaatgttacacaatgactaaatgacagaggatggactcgaccccatctccataattcagatcacaggcaatggaaggtgctcagttatggaggagggtggggcccatttgagactagtgtcaaattctgtgggttttttggaataacaaatgatgcatgccatttccagtgtgaaacaagaattccatgagaagccatcttgatagagtagtgagcatttagtcatttgggtctactttatgttcagcatggtgtagagcctggaggtcctaagagatataaggtactatccttaccatcaagagtcacagtcagaggatgtgatgtgctaaaagtgcatacaatgggctatggtgaaaaagggatgtactgaccagcagccagaaagtcgaatatttcacagagaaggtaaaatttaagttcatttcctatttattatcttccatgtgccaagcatttctctagacactaggtcaagttgcacagaatgaacgaaaattccccagataagggtaaaaaggataccacaaattaaaaaaaatagcacatacaaagatacaagggcttaataatatgtgctcagactgaggaaagataatttgttcagtagggcaggaaagtaagttgaaaagttaggtcagaggcagattatcagaggcctttcatgctgtgttagaagcaagggtttgttctgtaagcaacatggaggcttggaaagattttaatccagagaatgatcacagctcttagcacaggaattaacagatagtaagcactcaaatattttcaccaaatgaataagtaaatcacgagtaactaacatcatgaagcattgaattaatttggttggagcagccagttggcaagagacaaagtgagaggtctagacaaaatgatgagagcctaagaagtcagggcagatcattatattagaggacacaaaattatgaggaagtgatcacctattggaggtggagtaagaagaagaggggggtggatgaacacccagagatatgtagcttgaatgaccgcatagaaatggagatgatgctgataaccaagaaaggagttcgcrggagggaagccaacctgggacsatctcttaacccctacacacagagaatgtaatctgaccaatagtgtcatcaaagtcaataactattcacagaggtagagtcggtaaattccttttctttcaacacaatgagtttgattgagcatataaaaatgtgttgtcacctggtttgatatacagatgcctattacaagggtttcttaaccctggtattattgatatttgggctagataacactcagttgtgagattgccatatgcattatagaatattcaccagcaatgtgctggcctctacccactagatgatagaagaagcaccccctttcaattgtgacaacyaaaaatgtctccaggttttgctaaatgtccccaaggaaacaaaaacctcccccacttgagaatcactactatatatatatatatatatatatatatatatatatatatatatatatataccattcaaaaatagcattttcatagacccataagttaactggcaatgacctgaacacatggcagcatccaggagagtcaaggccagyatcattaaaaagatttgccatttatatgcacccacaaagtcgctgttggccaattttaatgacgtggtttcagaagtttggtttacagtctctgcagctggtatttgagggagccattctgtgctgtatgcacagctgaactgtgtgtcttctccaagccatggctaacatgtgccatgagtgaaagtttggcccatgtcctggccagtgctcacctattctctattttccctatggacacaaggtttcaagaggccagttgacatttctgagattatatatgtgaaaagctttatataaagagaaaaaatattatataagtgtgttacataggcatcttaacaggaaaatatatttttaataagtaggcctgtattagtccattttyatactgttgtaaagaactgcctgagagtgagtaatttataaaggatagaggtttaattaactcacagttcggcatgsctgggagacgtcaggaaamttacaatcatggaagacrgcaaaggggaagcaagacaccatcttcacaaggcagcaagaagacgtgccaagcaaagcagaaacagccccttataaaaccatcagctctcatgggaactcactcactatcacgaaaacagcatgggggaaactgcccctatgattcaattacctccacctagtctctcccttgacacgtggagattatggggattataattcaagatgagatttgggtggggacacaaagcataaccatatcaaggcccaacccaattagcaatgaacaatttccccatgaaaagaagaatttaggagatatgtaggtaggaagaaaaaataaggtcccactatgaaaatatgagtctgcatgtatgagaatgcattttaaatatctttttttttttttttagtatttttctgaggtgagagggcaggagagtaggaaacaaagaaagggcaaaatgaaatgtaaagagatgaaaaggtcaccactcacctcctaccacractgccatcatcccccacctcaacctctctcaattgaaaatacttctctcagttcaacccctcgctgtcaatcttcttctaatcgattgtaattattcagtgggaatctctaaaccctcgtgtggacagccagccttttgtctgaacggctcatcctctctggaatggttgctaaggcttctctcccaacatcttttccttgaatacccttcattgtgaccatttaacttcagtcattttaacctgcccccaaagcagaaaggtctgcacttttgtctaaagcatgcagcaaaatctgatccttacaattaaaggggaaatgaataagtgaagrgagcttgaaagaaaattaaagatgataaaattcaaaacagatgtcatctaatttacaaatctgacatgtagcccagcaggccagattttagacttcaggccaaaactacaagattatcaaaagaaaaacaattagcatcctagaaagaatggaaaactgaagcagacaggaggctttcttgtgccaaatgactgaataaattragtgagttttgttagaagcaccaggtgagcccacttgcacttttcctgctcctgttttagaaagaatgtttatatgtaaataataaaccaacagaggctaaataacaggacagccaagcaaagcatttatattttttaaattaattctgaagaagcaaaagggtacaagggctattatgcattgcaaaggagaaggtgtcaggttggagaagagatctatacctttcaataccgtgcaagtcctatctacccttcaacatcaagttatttgtctgccagggcccagttgaagctggggagggagagggtgagctctgggcacctctgtaactggctgagctgagcagtggagtgatcattgcctagaagatgcctttgccaaatgaatgtggcgccagggaggctgctataatcaggcaccatcagaatgggggcaatttgtcacaggtggtcttagtaggaggttaggcacaggccccagttggggatggaaactttgagggatggaaattgtggagagaaagcagcagtgggagataaatatgacaaatgagaaaagatagggagagaggatgatgatggcaaaaagcagaaggggagacccaaggaaaaaaggagaaagggtcctgacacaggcctggggcagaggagggtagaggaaggttacagttccctcagatccagcctgcaaacttcagccaaagccgtgaaagtcatgggggaaaaagaagttgtttgtgtaagaaaagtttaagacaaagtgtgtgattatagtttctccaatcctctggcttagttacatgaatgttgcgttttttttgttgttttggtagtgatggtggtagtgattatgagattttatgcttgctcttcactttaagaatcaggcctgaaaacagaaagggataatgaaagcgaaattatagtcaaaactgactgaataggtgtaaatctgactttggtataagtgaaaagagatgatacaaaggagggaaggaaataaaacaatagcacatgcaggagaatraagggaaaatagggtaactcaactatattcaaagaaaaatgactccaggaaatctgtcttccttggagtggctccagaattccatttatccyacattccatgcaatgaacatcaaagaaatggagtacagcaaagagacatatttgatgtattgtgtggccctaatgtatactcaagcaacacagcctgtaaagaaccttttcaactacgaggccctttgcaacctgtcattccagagttcccatcttgacatcctgggagtcacatcagaacctaactctactgaaataacagtaatgcacatgcttagacatcatgtccccaagacattgtccaagaccttgaaagtaatcgctcttcactgagtccacaacacaaactgcagagaacagggggccaagttcttctctgcaactctgcaaaaaattctgcatatgtaggcctgatcaagctttaaaccagctcttaccacatggtagctcctgtgctaggagctttcccctctgatttgtttaatcctcacaacaaaaagtcttttcatatgcatcgggataatagaaacttcatagtagagcgtaatagagtaaaccttgcagacaggcaagaacaaagtaaaattcttgctgtgagtccatggtaattcctggagggccagtaatacaaatgcccagacatcagttcattaagtttctcttaatttcttcttttaatctagtccagtgaatctcaaatttcaatgtggataagagttacagttttcacagtatttcatggataattcaaaagaatattaaaggaatgtcaagggtaacttttgcctattcctccccaaagaggtaccccactaacctttaccatcaccttctagaatgccctctttgtgcctctcttcccattgaaagctggcattcagaaccaagactccagtttggtactacttctccatgaggccttttccacccaccatcacacatagtgatctgtgctttcctctgagctcccacagttcatacaacctttccacctcccagcacatgccatcctggcctggagtattaggtgtccttctgtgtccctctactcttccacagacttgaagagctagtattcacagcccatgctctatggaaggaaaaataaggtcttaaagtgttcacaagaacttccacatttttaggtaagacatgttcgtacaaagagaaattaattctttgaaagcagctgttggttcagggaaggtacacgagtcagttcagaaccataattaaaaacatgggacattctggtcagcattgccccctgcttaggaaaagctgactataattttgccccaccaaggtaaattttaagaatgaaacaagagttttgataggaaacgagtatctcttttcaatctagagaggtctatggtgatcacttgtgtaaaaagaaaatcataacagccatttgtggcagtagctgtggctgttgttactcctctgtgcatggaaaaggaaggaaaggcttcggttttgggcccgtcttcttactgaagaggttaagtctgacatgtggtaccatttatgttccagctgttattcatttactccaccagttgtcctcccttaacgcagcatttagggtgatgtgaaggtctttaaaggcatttcaggaattcatctatcagcacgagatgtaggtaggagacattgttatcagctttggagacaatgaagcaggcccagggagtgtgagacctcagacaggctggctctgccatgtaaggacacagtagggtagagactcgggcagccccagtatggagtgcgggcaatgtaatatcagcttcatggggaaccaggtccattttctgtaacatagcaatgttcaaaacacagggcacacaaaaaaagaaagcttttcatgaggcacccatgcgctggcttcccatttcaagcaagacagagaacaccaaagttctagcctagggaatgaggaaaaagggtgtttgtgggagaagaggtaagaggaccttgaccctctacaacccacgtgagaggagggccagggtgccagctggtgctcagacacttcttcctggaccctgatgacctagctattcactattttggttccccaaatgctccctattcctttttagtatctgtcataattgaactttaaagttgccatttgcatgacattttctgagttttgaacacctttttagtttgtgttaaaagagggtgccaaaattcatttttccaattaatacaaagggttgctcccgtgactatatatcaactctattctggtgtctgattcccacaggatgttattcagagatatcagattgtaataactcttcttggttaccgtgctatatcaccagtgccctaatatgtattacttattcctggggtagattcagatgtaacctgaatcacacctacttagaggaagtgtgcagagtggagtgttaagtgagagctctggaggcaaacagttggatttaatgttggtttagctaagtgaccttaagtgtgcctcagtttcctcatctgtaaatggagttactaatagggtcagcctcccttgattgtgtgagaagcaattcatgtaccagatttagaacagtgaagactatacatagaaagccctctgtaaatgttaatgagtagcattagcactttgttacaggtgtgcattataataggtgttggcatatccactagaccagtgcccatctgcaaactgtttcttatcagactgtgatgaagcgattgcagatattaaaaataagaaaataagaagttagaacttttatagcaatttaacattgctgtaatatccaagtacctgatcagtggacgttgtatgtcttgttttattcattgcgtttctctagtagtttatttttgctatttttacaaaaatattggtctgtgacatgaaaatttaaaaaaaaaatagttctttactacagtgagtttaaaagctaccgtattaaatgttggatacagctggacccagactaagtctgagagctctctttaatacctaatattttattccctaaactttcttctgggacctaaaggaaagagatttaataaatgaaaggtgatgaacacacaccagtgtggccatggttgagatacagctactctaagatgggttacagttgaggaaaaatggttcttaatattattcatattcatcataaagcaaaagataggcttttcattagttggcagcctgaaggctgttagataaactttgctataggtaagggctgaattctaggtagactaggaattgaatcacagaattttatgtaggagttctatccccaggtcagttattgatgtgtttttgattaagtatatcctccatttctgggtaactatgtttctatcaattaaaattgggttacagtatcatatttgagatgaagactatgagaagatgtatcaaataggaaaattttaaccatttttcctgctcttccagtgtcaaatgccaagagtgacaatgtcttagctctttaatcctcatggccagaccctattgcttgctcctgtgcccagacgataaagtcagcctagacaaagaagagcacattgccttacaggtctccctcttgattgacagtgctttgatgatattcctactctacgttttttacagtcctttataatttacagagtgattttgtaacttgtgttatatctgggtggcagttcattaggatggggcggccgtcttctgttaaggctactgctcacctgatatgcccagtcgtctcaggaatctaaagattcggggtccatctgaaccagtatctgccagcagcaaaacccgaaaatgtacctttacctcggaatgtatccccaaaaggataaaaggcaaagcctaccaactccaaataatccacagattaagtcttaccttactacagaattagtgaaaccctcagcagccttgcttgaggaaaaaggcctctgccctggtccacttcagattctcttatttcattgtctgggccatcgcttctcaaaatttgaacgtgtcactggacacctggggaccgtattaaagtgcacattctgattcagtagatctgggatcagaacctgagattctgcacttctgacaagctccaaggtgatgctgatgccgctggtccagggatctcactttgagtaggaaaagcaggggctttgcactttttgctgatcccttttccktgtcttattctctcccatgttggttaaataactgaaaagtgagcaaatgattgggcatctgaattagaagtgtcccttccttgtatcatggcttttatattttcattctaatttcaggaaattctgtctgcagttgctcagaattcatatttcaagtacagggatttatttttaattggccatttctatatcccagttcttgtatgctcatggagtaggagagtccctctcttttagtacgcactgtttaagatactgcagtaagaggagggattttatagtcctccctggctttgagcaggaaaagcatatcttctaggattggtaacacttgcgcaaacctccttctttcagtgtcaaatgtccacattaagcagcagccactcagggttttaccatgccttgaatttttcatgcccattctatgtgagcaacactgtcaaatccagtatcttatacaatgctttcagcaatctgatgatgtaatatcaatcccatttttatataacaaaaataaaacttagagtccttaagagttttatagcatcactaataaacatgaaattggagttatgaacctaagcttttccccataagattctgttcagtcagtttcccccacaactgtctccttttgaaaactcttttaaaattttgtgtaaatgaagtaaaccatggagttatttcattttagcagagttctaccattggcatgatcacattctgatccccacataactaggtacctgcccatctctgcttttgcccactgagcaggtcagaggcagaatagataccaagaactgagtcttattgttgtcctttcccttaacattccagcttaggtgttccagcagcattatttattgcagtcccaaaacagatgctagcactgtgaagttgggggatcttctctatgatgactgatgacccaagagattactgaagagtaaggaacgtagcattctaagaattcaggactccaatgtggatttagtccattgcattctcctacttctcctttaacaagcttaactctgcaggagtacatatcctggacatggaattgtaggccaagatcatcaaacattaactaatattatttttctttgatttaaggagccaggaagagaggctgccaatctttccaccccctgccagctttatagtctcatctcccsgcttagtgagagcagcgagcagcccaagggccaatttgtttctaagggaagtccccgttcacacaagagggaggtaattaggcctccccctgggaatccctagatgtacttttaaaaactttgctttggcaacagagaccagaaactgttcagactagaaattatctgaacctcttgtaatgtggtgtgttgagttaaggccaagttaatatttaggggattatagaactctggcaaagatttctgtaaaattacctctggggtcaaaagtgacaaatggaaaagaaataacaaccccctaagtgagcccaatccactggcccctgcccccaccactctatgagtaaacacatacaggacccatggatctgccagcactttcacatttgtgatgtgtttccttgctctaggagggaagcagaagtttatctcaggaaaagatcttggtttttgaactttttgttcaaaaactttgtttcgaacaaaatacttctatctttttatattaaattttaaaagcaagaggaaaagaagtaaaggaaagggaatgtttatgataaacccaaaccctctatctaccatttcctgaccttccaatttattggaattgaaatttgtcctacctccctgccagcaaagttctgtggcatgcccaggtggattgatggccagaaacagaaagttccctttgacccatctggagaccttggctgcctcaatgacttcattaccaccccagtccactgacttctgtgctstacaaatctaaatcataaaaccaagggagattgtgcagaagagaaagtctttgcggtgagaattctcatcagccttagatctagagagcatttctttatcccagacattttattgttgcttcttcattcttcatatttgttcccttgcaaattactctttttgcctctactcttgctccctgcttctctccacatttcatgtttaccaaatagcactgtgccatccccaaaccctgaagggccaggagaagtggccagtctctcatgggcatctggtagacctcaggaggttttttttttttttttttttttttcattkggtttttgttgttgttgttgttatttgtttgttttgttttttgkgttttgkggkggttgttgttgtttagaggtgggtggcaggctgacttcagacaacaatgtggtctcagttcacttattctacaaaaattccaggtcctgtgtgtgccaagcactgtgccagaccagatgggttgtacaggtccctgcccacagtgcagcagggatttatcccagagttgctttgccaagtctaacaaataaaaatacaggacacccagttgaatttcagttaaataacaaataatttcttagtatttttagtataataattgtagtcaagtataatatatwtttagtatatttcactagggatatacctacacttaaaaatacttactgttagccaggctcggtggctcacgcctgtaatcccagcactttgggtggccgaggcgggaggatcacgaggtcaggagattgagaccatcctggctaacacggtgaaaccccatctctacgaaaaatacaaaaaattagccgggcatggtggcgggcacctgtagtcccagctactcggggggctgaggtgggagaatggcatgaacccrsgaagcagagcttgcagtgagccaagatcactccactgcactccagcctgggcgacagagcgtgactcagtttcaaaaaacaaacaaacaaacaaacaaamaaaaaacttattgtttatctgaaattcagatttggctgagtgtcctgtttttcactgagaatccttacccttgaggcacccaacctgccctcttggggtcagtgagtgtcatgcccagcatctcatcagagtaatgctataaagcaacttgaacatgaaggaaggctgcttccagctactaaagctctgatgcatccaggctgcagggcttgctaaccaatatctggtcactggagacacaggcacggaaaggggcttaagtggccatcccctcctacagcctgacagtaataaaatctaacatgtgatgactgcttgttatgtgttaggaacactgcttcatgttggttctgtcatttaatcattctaccaaccccgtgagttaagtacagttattatctgcattttatagatggtgaaactgatataaagagtacaacaaacaaaagaaggatttccataaatatgaaacttttttaagaataaaaaactgatccaataaaattrtcttaggacattttctataatctatgaaatttgaagtttttttgaagaaaatgtgattattgtaactkatataagccagagctttagacagaaagaaaaaaattataaattcatgagaaattttcctctaacaattcatatgttttgaagtttaaaaatstgtatagtcaggcacagcggcacacacctgtagtcccagctactcagaaggctgagataggagaactgctagggcccagatgtttgaggccagcctggaaaacatggcaagacccccatctctaaaaacttaaaaattaaaacattaaaacatttatataatgctcaatatctaatacttacattttgggttacaagttatgctttacaaatttttaagttttaatgaccccagctatagaaatatttgaaataaaggcatcttttaattttgaagggtgattaggttccatggaaccagagaaatattttagtttcatgactatacatgaactaatgtggatagaaaataaatactccccaaaatttcttgtgtggtaagtccattagattttttaaaattaaccttggcaatcatcatggtttgtaaaatagcatctagagatagcattatcttggtttcatttgtaatgggagtaaacatttagaatcttctggctataagatgtcaaagcctcccatctatttgactgtagccaatatcatatatrtgtcagaaagaaaaacattttcaagcctagcctctattcccacatactgattcttgcaatctaccaatgtatattttatttatgcatggtatgagtagataaaaattatgtaaagccatagaaaacttataaaattatgtaagaaaaatggttttaaattgtatcagcaaccgcttattaaacaataaacaattgccttgttacctaaaagatgctggttcccactttgaatcatcagcagctgtccctgggctggacctacaggtgaattctgaccactgagggcccataatcatgaaccctccctcaacgccaggactgctstcctctctgggccagccagaaaaacttcactatccaaccctgctaacgcagtgcttcaccagtgtccaccgcagatataggtgccagaatgggtagattataactgaaaaaattagttaccagcccttctgcattgctttttcctaaaaagtagtgttttttgttgttgttgttgtttgtttttgttgttgttgttgttgttgtttttgagacagtttcactcttgtcacccaggctggagtgcaatggcgcgatctctgctcactgcaacctctgcctcccaggttcaattgattctcccgcctcagcctcccgagtagctgggattacaggtgcctgacaccacacccagctaatttttgtatttttagtagagacagggtttcaccatgttgagcaggctggtctcaaactcctgacctcaaatgatccacccacctcggcctcccaaagtgttgggattacaagcataagccaccgtgcctggcagtgctttctttctttctttttctttcttktttttttaaggatgtttttcctctcactctcattcaggtattatgccaggttcactttggcccttagggaaaaataatgtttgaaaaagccaagatttttctctaagtctgggccctttcctcaatgtcttggaaaaatactaaagacagccaagtaaatgcacacagacaaaccaacaaaatcattagaccatcttggtgaatatatttctagggattattatatactgtaataaaaaataaatactttgtctctgtcccgagttcatggcatacagctcctaaaccctcagaatctcagattgatgggtgtcttttatatgctaatgagatgactgttggcagggacccctagatttcttgaggattgggtctggtcacaggaaggaccaaggcatgattacactgttggaactttcagccccattctctatcttaccctataactcacccaaccccartctctggggaggggagaggggctgaagatcgagttaaccgccaatggtaatcatttaatcaatcatgcctgaataatgaaaccgtcataataacccctaaaattccaagaacttccagattggtgaacacattgagttgctgggagtacagcgtacccagaaagggcacagaagctctgtgccccttctcccataccttgccctatgcatctcttctactggggtgtttctgagttgtatcctttataataaacccaataataataagttaaagtgttttcctgagtcctatgagtcattccagtgaattattgaaccatgggggtggggtggtgcaggaacctttgtagccaagttgaacagaagtgtaagctggggaccccatacttctcactggcatctgaactgggggccatctgtggagtctggggctaattccaggtcgttagtgttaggattgaattgaactgtaggacacccagttggtgtctagagggttggagaattagttggtatgagaaaaaaacccacatattgggtgtcaaaagtgtggtaagtaaaaataattccttttatccttgttttttaagaaaagaattaatactaacaccatacgttataaaaatggatagtggttgttgaataaaaattaaagtagctgtaggccagctcagtattagaagataaataagggaagataaatgcatgctactttcctataattactcagcacctcagtgaacatcagaaagctatttctgcagcttatttgtaggtgcttattctagctaaggcactgttagccctcagaggaaatccaaaattataccacacatggcccctgctttaaaggaagtaattttaatgacccacaaagtggtttataaactctactataaaagatatttgggtctatattaatatcgttcacagaaaacctctttcttccaacatcttaaaattcagaaagatatttctccttggaaggtataagagttatactgattttttaaaaattaacaaaaccatgagtttatacagtgcatgtgaaatgttcttattctgtaatttcagtacaaacatatcagcacatgtaaattttttagaaaatatctggcacacatttcatgtgaaagacatacatttgaagaatttctaraaaagaatatggtacatgagcataaaaactgctttttattctttgaactcttaaaaagcatttttaatacaaagttcacataaacaccactgtttctaaatttctggcagaacaagctgtagaagcaatttcaaagacctatgcctgcagtaaatacttgttaaatgaccaatgaaaaaaattatcaggcaaagcttttgcttctgagtgagaggcagttaaatagagaataacactgttctgaagagtatatatgacctgcatctaatgcaatgatttatattcctttaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtataactcgtttggtttgttttttaaatcatacacttcatgttcgctattagctttgttatcactctgttatggggtgttttttatatatcttttacccattgccacccaaagtgccatccttacatgaatgaaatatcatccacaatgctctcattatccaaagaaactcactattttaaatgggtactatgaatggaaaacaaatctattgcttatatgccatatggaaaatactgtctcttgatttctgatgaaaaatcaaaagcaaaagtagacaaagatgaaaaatatgtaagtctactattttgcagccagttttgccatgaaattgatttttaaactttgtttttggaggtgacttagattttcaaaggtttggtttattacatcatttattggtggtatacatttatcaggcctgttaatagtttcacactccagaggaagtaactttttgtcccaatattattattatttcttttccktgtcagtgaatggtaacacaacttctttaactttccctttgtttgaactctaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgycagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaaggtaagtgttgtgtacttcccaaacctgagaaacttcaggagtcactgcaaataaacaaaaagctcaaatcaggtaaattagcatactcttttctggatcttttgcaaaatagatcattttttttaaataccttacattatgttagttttttttttttttttcccaagaaaaggttgatcatcttgattcccatttgaatctacttgggtgcacataagtccactgactctttgatttttgcaaacctcaagatatattatttctggttccctgtccccagaattcacaaaaatcctggaaagaggtctgtgaccctgaagccggctctggggtaggggttctgccagagacatttcccaaccacataatcatgcaagaaagtcatgcataacattgaatatcagcttccattcagctactgtgttccaggcactgtgttaaaagtactcaagattcagctataaaccaaacagatacaattcctgacctcttagagtttagagtatagatgatgatgctcaacttaggatgagactatgtccccaaaaacccattataagttgaaaatgcacctagtttaccaaacattacagcttagcctagcttacgttaaacatgcccagaacacttaggacactagcctacattaggcaaaattacctaacgcaaagcatattttataataaactgttgaatatctcatgtaatttattgaatgctgtactgaaagtgaaaaatagaatggttgtataggaactcaaagtatggtttctactgaatgagtatcactttcacaccattgtaaagtcaaaaaatggtaarttcaaccatcttatgtcaggaccatccatacacaaagaaaagggcacaaccatagtcaggaggtggcttaaaagaaagaagccagtgagaggttgagctagtcagaaaacgaagggcaaagtaaaaaaataaaaaattttaaacaggatgtcaggggccaggaccttcctcaggcacacaaattagggtggcaccaataaaactcagtaaaggctgggcgcagtggctcatgcctgtaatccaagcactttgggaggctgaggcaggtggatcgcctgaggtcaggagttcaagagcagcctggccaacatggtgaaaccccgtctctactgcaaatacagaaattagcaggccatggtggctgacgcttataatcctagctactcgggaggctgaggcaggagaatggcttgagcccgagaggtggaggttgcagtgagccgatatcgcaccactgcactccagcctgggcaattgagtgggactctgtccccccacccaaaaaaaarataaaaaaattaaaaaactcagtaaaattttaagtgacagcaagatcagtaacagtgtcttactgagtcatagtggaacgtaaggcaaaaggaataattagtaatatcaatcctgtccctaattacaattttgatattttgttcatcatacattatttgcattaattttaattctaaaaaaattatatatcttgattactatatatttctgacactcctttacattttgtgccgtagtccttcctggacctaggaaaggaaatgtgtttgagacacgggtcctaaaatgccatagtgctagggcagactcacttttctagtagtgggttgaacaagtctggatagctttaaggcactctcaggctcataatctttacaataacaattcttaggcagcaaccatgttcttcccttgagatctatgtgatggttctagcactctggcatgatctgccatcttgtaggctacagccctcatagaaaaagccagacagctcagcctccagaaagaaaaatagytgaagaatagcaaatccaattcatattcatctgcccactggctatcaggtttaggtactagaagagcccttttttccatattctactttctagcccttttcccacttcaaatcagaggaaagagtgtgttctcatgctaacaaagggaaagggggattcaaatgtttagtgataacattataatattatttagcatgtctgttataatctgacactttcaaaagtgtttgcactaactttattagccttcctaaracttttaaagccattttaatggtgacaataaaagattgcttatattcaaatataagtattagataagtataccagggcttggaaatagctaaaatcaataaaattccatcaaaatcaacactttacaattgcctactttgctaataatctgtgtatctattgcacaagttggagaatttaatataagagagattaagtgaattccccagtttgacacagggagtcaatagcaaagataaaggtaaaatagtgggatttttcaaagttgatctaaagcattaaaggtttactatgcaatgagttttagtcttgtggaaatgtgtgagaaaatcctgcagatttacctcaaacttctacttgtcaaaaacaaatgatatttcttattgccttgagctattttaggagttaaaattacagatggtccctgatttatggtggtttggcttatgattttttgactgtacaatcgtgcaaaagccatatacattcagtagaaaccatactttgaattttgattcaaaattcttcataacaactagctttattatataggctttgtgttagattgttttgcccaactgtagacaaatgtatgtattctgagcacatttaaggtaggctaggctaggctatgatgttcggtaggttaagtgtattaaatgcatttttgatgtaagattttcaacttacaatggggttatggggacataaccccatcataagtcaaaaagcatccgtagtttgacaattaactagttaactttgcttttttttcccaaaaatgttgaataaattcatcatctgtacttaaaaaaaaagaatactttcttttgatactgatgtttcctgccagggatgacctagataacctaggactgagtatgtatttttttagtkgacattttggaattcattcatactctcggaatttcctgggcaattccttgcacagagatatgtgtgaaggatcaaaaatttgtatgattcactggtaatacatccgctgagaaagagctcaggctgattgcaggggacacattgttattacttcagaagtactgtaaattattcagtgacacaccagcagtcatctggctgacacaattttgcttgttatcmtaagattgctcaacaatattacctttctttccttaaaatcttatttaaaaaagatttaggcttaattgtgttatgtttgatgtgttttttatawaaatgcaacatatttgatctttcttgatgaattatgcatagtagtcaagaagcaaagagaagaagcataaaaaccacttctgaaacatttaaagttaaagggacatatagccagcaggaaataacaacaaagtgttaagaaaaattttggactgctgttacaaagtccatacgctaggaacacgacaaaacaacctttgaaagaaattcttttgatgttaggttggtccatatgaaaaaactgacattagactgttttgacatataaaaatatcaatttcatatggttccacataatacttcagtataaactatgttaaatgaataggaacctcactggtcactgtatagcagaattcggtatgagttgaatcagggtcacaaatagcattcataactccagtcagccatctattgttgcataatattgatcacactgggaacaggcaatagagtataaatagatcagtaagaatctatcactgtgtctggaaaaaaatgtcaaaccccaggtcttattaagtttgggtcggcagtgtcattttggatatgaaacagcctgttattcctaggtcagtaattcacttctgagccttgtaggtctctagtatttgtgcaggtttaccaaccacttaaagttatgtattcataagcagagcaatggtctaatatcactggctgattgtatttatttacaagactggaggaactgaattcatgtgccaaagggcattttaaaaatccgaatcattggcattcatttatgtgaacaaagctgattagaggtcaaaaaaacacacacatgatattgtaataaatccttggaaatctggcccataactgaagttctataaagaataatataaaagcttacaagaacctatcaatgttactttgaagtatttcctgattgggtgaaaatacatcccatctgtagagtgtatcagcaaggctgacttatagaaagctaatttttaagctggtaatgtagtcctttctttatagacccacacaagttgatttttcttttttgtttttttcttttcttttttgagatggagtctcactctgtcaccaggctggagtgctgtggcacaatctcggctcactgcaacttctgactcactggttgaagtgattctcctgcctcagcctcccgagtagctgggattacaggcacacgccactagagccagctaatttttgtatttttagtagggacggggtttcaccatgttgaccaggatggtctcaatctcctgacctcgtgatccgcccatctcggcctcccaaagtgataagttgatttttttcttaaaatgagattaattattaatatcaattagtgggcattgttttcatggttaatgacaaataaagcctccttactgaaaatgtgcatgtagtcaagtccacctcagtgttggtgtgactgtggggtgctcacatcctcctggtccagttggtcccatctgggggatgttgattacgcccatccacttaatgcttctggggaaggtttcttttttattttttaatggattagtttaatcatgggattaggataatttatccatgaattgaagttgtaaaatttggagccagagaagaattttaaatctttttcacacaatttgagaaagaaaaacagcaaataggaaaatgttaccaaatttcctggagcctcattcattaaggtggtctcttgggcccctgttagaagggcacttactagggaatacttttctagcaaacttttcttggtgctttgggacttttcttggattaccttacttacctgctcccacctctccaaaaagtgaattttagttgacaaaggcagacataacagcgactggtttctatctttactttctcctaccacacatatcccaatcccagtcatctgcaacagcccgtgaaacacatccaaataacaagaagaaatgaagatttacaaatccttttgaaaagactctctgcaaactgctctaatgagttracatcagaacactgcccttgtacatcctcagccaagagtaggtgcaagactcgggcgtgtaacaacaaatcactgggaaggatgtcacctacttgcatccatgacttaacatgttgcaaacttccaaaagaagacataasataactttatttctcattaattatatttttaaaagctcttctttaaaataaagaaaaagcttggtttcctttgcacatttaaataaataattaaagaaaagtgttctggccggatgcagtggctcatgcctattacataatcccaacactttgggaggccaaggcaggcggatcacctgaggtcaggagttcgagactagcctggccaaaatggcaaaaccccatctctactaaaaatacaaaaattagccaggcgtggtagcaygcgcctgcagtcccagctactcaggaggctgaggcaggagaatcgcttgaacctgggaggcagaggttgcagtgagccgagatcacactgctgcactccagcctgggcaacagagcaagactctatctcaaaaaaaaaaaaaaagtttcttacaatgcagatggacaaaggagtatgttgtttgtctgcatgtctagttaacctgttatttatctacagatgagatgaatattcatctgactagaaaacagtgcaaaataaaattggttgagcacatgcacactcttaggacattttgtatggagatccaggagcagttatctgactgaaaatgaaatctgtcatctcaaaccttgaaatgcctaattcccctaatatagtatccaccttaggtgtgtctctaatagatttaaagggaccttgctaacaaatagaggcaaaagtaaatacataaatggagcgaaaatgcacaggagtatatttcaatatatctcaccctaaaagtcaccacattaaaagaaaaatgaggagatgtgggtggtgtaaaagcagttgttttctgtggcatatttcatatttttaaatatatttttgaaatgtattattrttaagatagaagggtatatagcaatatactcttatatccacagtcagtacttttatcttttttgagggaagcttatactcagagattattatcagtcatccattattgttgtttggggactgtctttactccaagggatgcagtgcagtataaaatggtcctgagcccctgacagtccccagcagaagagtacattccaatccagtttgccacaaaccaaatttcagtaaagtgaatgttattcttccatttactttcattatgaaactggcagtatatgccctgtagggaaacagagtggtccctggatgtcatcaaatctcatttaaaaacagagtaaacagagtaaatccatattttttagctctgttggtgatgaagagttggtagccaggaaactgaaaagagattatatcgctgggtgaagggttttgwtaagacagaggaaaaggtgggggtggaggagggtagattatttcctcctatttgctccacaacaaccatcaaatttcaggtgacggaggatttttaaatatttttccaaaatcataggcaattacatagttagcaattgagagtccaggtatttgataatttagtaggaaatgatctgtgttacagttcattttcagagaggtgcatatttacagcagatgagtccaaagctgacagagtctacttggattgaggcaaaaagagctgagtaaaagacagctaattcctatgtctacatttttaccctgttcacattagggactggtgaaaaattataaaacacagggttttgtttttttgttgttgttgtttgtttgtttttcttataaaaagattcagttggcccggtgtggtggctcatgcccataatcccaacactggaaagccgaggtgggtgagttgcttgagcccaggagttcacggccagcctgggcagtatggtgaaactgcttctctacaaaaaatatgcaaaaataagccagccatgatgtgcacttgtagtcccagctgcttgggaggctgaggtgagagaatcgcttgactccaagaggtcgaggctgcagtgagcggtgactgcaccactgcccttcagcctgggtgacaaagagagacccagtctcaaaaaaaaaaaaaaaagagtgagagagtcagcaaacttttaaaggtaatttgctttacagaaaatcatcatttttcagatgaaaatatccacatcaattatcccgcagccattaaaatattacactggcattaaaataagccacaaatgcaggaaatgtaaaactgtcaaagaaactctgagagtgtgattctgtttctcatataaaaccctgtagtttatacatgtaagtaaaaactactttttacagatgatcacttcagtttagatgtttgaagaaatattaatctgggaagtaatgccttacatggctagggacaatgacaggtgactgtgtctccccagtgagatttctaagcctcaacgcacaagaatgttgtcatctacttagctggtatttgtgctcaaatcacctggtgttgggccaggcagggagaaacttagccagccacccctagagttccctggtctctcaaacttgagggatttgttagtgatgcctgaaaggttcattctctggatatgctttggagacttgcctggcaacagcagagattgccatgctcatttatgccttcattcattcatcagccaactcttcttgagaacctggcagtaccaggcacgctgctgtaggcaggggatacaactgtgtgcagaatagacatggactctgctttcttggaacttacataatacgtagttacaaagtgagatgatttatctgcagaaaaggaacacggttctgtcagaacctatcacatggaatctgccctaatctgggggtcaaagtagcttccctggagaaggaactcttgagaaatgtgaagagtaagtagaggtgtgggagctgaagagaaccgtctgtcctgtggaaagaaggagcacagcctactccagggactggaagttggccccctggggagcagtgaagtgaagtgaggaggaggatagttcaatgtaggcagggatctgggctctatcctgagagaaaagtcagattgaaaacatatctccctacctgcaatgtggagattagtctgtagagggggctagagactccttaggaagcaaatgctattctacaggtgaatagcagattcattcattcattcaacaaaaatttgagtccctaagttttgctaggcactgaagatatagcagcaaacaaaagcaaatctctcccttcttggaacttattctgtgggatgatatggaccaagaacaaaaaatatatagaaagaataatgccaaatagtgacagatgctgtgaaacaaaacaagttggaggggggataaagaatgggattactatttaggtagagtaacaggggaaggtctctctactgaagtgattttgcaatggagacatgaataaggagaagcagcaaggacggaacagtaaatacaaagccatgaggcagaaggacactttatgtgtggcaccctagattagggtggttggactacaggtggtgagaagtgttcactccagatatatttcaaaggaaagctgtcagcagtgctggtgggttgggcctaatcacccaatggatggatgagacagataagactagaggaagaatgtgtggggagatacaaatcaagagcttggttttagacacatgaattttgagatgascactcattcttttttttttaattaataaactttactttttagagaagttttaggttcacagcaaaattgagtggaaagtatagagaattcccatttacctcctgtgccccactacacacacaacttcccccactgtcagcatccctcaccacagcgacacattggtgcaatcgatgaactcatagtgatacattrtcatctagagtccatagtttacactgaggtttactttggtattgtaccttttatgggttttgacaaatgtataatgacctgygtccgttattgtagtttcaaacagagtaatttcactgccctaaaaatctttcctgttctgcttcttcatcttgttcattcttcatccattcrttctacaaaatttttgagtgcctactacatgccagcacactccagggacttgcgaaacaccagtgatcaaaataggcaaatatccttgcctccatggaggctgttctagtgggaaaagatgtatgataaataatagaaatgataaataagtaaaatatgtaggatgttacaaagcgttaagtgctatgataaagagaaaaatagagccagccaagaaaacccaggaaaaaaaaggatttacatatatgtgtatgtatgtacaaatttggagggaggggggaaacttctagaaggatacacatcaagcagctatcactgtttttctctgaagaatcacactggggctgagtgcagtggctcacatctgtaatcccaacactttggaggacaaggtgggcagatcgcctgagctcaggacttcaagaagagcctgcgcaaaatggcaaaaccccacctctattaaaatatccaaaaattagctaggaatggtggcatgcctctggtcgcagcttctcaggaggctgagataggagaatcacttgagcccaggaggtggaggttgagccaagattgcgccactgcactccagcctgggcaacagaaccagatcctgtctcaaaaaaataaaaagaaaaataatcagattgggggtgcaggcagagaagaaagcgagagggagggggaaatttgaacattttaatgtaaatatttctgcaaggtttggaaatttttaataagaataattggcttcagtaacagagatgcaggtaacttggaactaggtaataactccagatgcccagcgtcctatctaaattgggttccagtcccacctctgctgcagggcaattctgattccttgaacaggttacttcatctcrttggtcaccacttcctcacacttatcccaagagtatattacagagccatgggtttgcaagctctgctccctatagaggctccagagacccttttttcctccctttacctgccctgcaaacagaacaaccctgatgtagctggcttcacacactagccttcctgaagaatgtttaaaccaagaattccacagcttaaagaaacttgaaaaacactgggctggataacttttaaggtcctttatgctctaaatgcaattaatccctagtgtcttatggcagagctggcaaagtataaaacattagttattcagccaaggtttttttgttgttgttgctatcagcctcaaacaactttattactaattttgtatctccaatgtaaagtaaaaaacaaaacttttctttcatattaatttcctgtcctttctctagacatctgcattcatcagtttactacagttgggagaaaataagccagattgttcatagttgtgaggtttgtctcactatttgcttggatttattcattaatatgtatcaaacagcacataaccaaccatgatcagcaaattaatgcattgtgtctgtcctgactgtttctattctaacagttttgttcaccttactcaatagaaagttatctatttcaaacaatacgtgaagcagcctataaaaatatataataaagcaaaaagaatttttactcaatgtagaggggaaaataaacatagagaaagaaaatgaatccagtagttgagttatttttcagaaacttatccctggaaatattcacaattgctatatgtggtttgaaatttacttctgagcaccctagtggtcatagtaaggagggcaacaatattggtttaaaaatctacagtgtccataaataaaagtgtactaagtgctggtgggagtaggggaagaaagctgtttatttggctgatgaatgctgttctcactaaagccagttcatcaaaataggtgtttatattatgcaacaaacatacaaccattaaacataacaatagagcaattattctaaaccagaggtaattttgtctcccccatttgataatgtctagggacatttttcattgtcacagcttgggagtgggtgctactgacttctagtggatacagcccaggaatgctgctaaatatactacaatgcgcaggtcagcccgccaccccaaaacaaagaattaatccaaaaatatcagcaatggttgaaaaacgctgcaacagatcctcgcttcttgaaatatggtccatggaccaacaacatcaacatcacctgggtacttgttagaaattcagattctctggcttaccctagacctattgaatcagcatctacagttccacaagactgccacctccaaccaggtgtttcataacacattgaaggtaagaagcactactacagaaataagaatttccagtagacactagtagtagagaaaagacaatgaatttgtgattgaattaatggactcttcatttaatgatcacctattaattgaggagatgggccaagtgcggtggctcacgcctgtaatcccagcactttgggaggccaaggcgggtggattgcttgaggccaggagtttgagaccagcctgtccaacatggatgttcaagtgatgttcgtgaatnnnnnnnnnnnnnnnnnnnnnnnnnnnnnnnttttattaaaaatggggttttaccatgttggccaggctggtcttgaactcctgacctcaggtgatctgcccaccttggcctcccaaagtgatgggattacaggcatgagccacctcacctggccatatataccaccttttctttatccattcatttgttttgggggacccgggttgattccgtatcttaactattgtgaatagtgctgcaataagcatgggggcgcaaatgtctcttcaatataataatttcctttccttaggataaatgcccagtagtgggattgctgtgtcatatggtagttctatttgtagatattgagggacctccatactgttctctatactggttgtactagtttgtattccgaacagcatgtaagagtactcttttctctgcatcctcaccagcatttgttattttttttctttttgataatagccactgtaactggggtgaggcaatacctcattgtggttttggtttgcatttctttgatgattagtgatgttgaacattttttcatatatttgtcggtcatatgtatgtcttcttttgagaaatatctgttcagatcatttccccatttttaaatcagattgttagatttttttgctgttaagatatttgaattccttgtatattcttgatgttaatatcctgttgtatgaatagtttgcaaatatttattcctattttgtaggttgtcttttcattctgttgattgatttcctttgctgtgcagaagctttttagtttgaaataatcccatttgtttatttttgcttttgttgcctgtgctttagaagtcttattcataacatctttccccagacaagtgttttgaagcattttccttatgttttcttctagtagttgtatagtttccagttttacacttaggtctttgattcattgtgagttgatttttgtataggataagaggtaggagtccagtttcattcttctgcatatggatatccagtttttgcagcatcatttattgaagagactatcctttttccaatgagttttcttggcattttgtcaaaaattaattggccgcagatatgtggattaatttctaggttctctattctgttccattggtctacgtgtctgtttctatgacagtaccatgttgttttggttactacagctttgtagtattttttgaagtctggtaatgtgatgctccagctttgttctttttgcccagaattgctatggctatttggggtcttttatggttccatgcaaagtctaggattttttttctatttatgtgaagaatgtcataggcattttgatggtgactccgttgaatctgtagactgccttggctagtatggtcattttaatgatattaattcttctgatgagcatgggatgtctttccatttgtttgtatccccctaaatttctttcatcagtgttttgtagttttccttgtagaagtcttccacctctttggttaaattgattcgtaggtggtggtggtttgtattaatagctattgtacattgcattgccttcttgatttctttttcagctaattcattgtttgtgtatagaaacactaatgatttttttgtattctgcaactttactgagttcatttattaattcttagagttttttggtagcatctttaggtttttctatatatatgatcatgtcatctgcacagaggactatttgacttcctcctttccaatgtggataccctttctttctttctttctcttacccatttgctctaagacttccagtactaggttgaataagattggggagagtaggcatcctaatcctgttccagttcttaaagaaaatgctttcagtttttctccattcagtaagacattaactgtgggttcgtcatatatggcttttattattttgaagtatgttccattgatgcctagtttgttgagagtttttatcatgaacggacattgaattttctcaaatgtttttcctgcatctattgaaataatcatctggtttttgttcttaattctattgatataatttatgacatttattgatttgcatatattgaaccattttgcattcctgcaataaatatcacttaatcatggtgtattatcattttgaggtgttgttagatttgatttgttagattttattgaagatttttccatctatcttcatcagggatattggcctgtagtgctatgttcatctgggataatggcttgtagttttattttyttgctgagtccttgtctggttttggtatcagggatatgctggcctcacagaatgagttaggaataatttcctctgctttaatttttttgaagtattttgagaaaaattggtattaattcttctttaaaggttcagtagaattcagtggtgaaggctgcaagggggtgctgcagggccatttttcagaccttgagtgtgggtgcctatgtggccaacctgctggcccaaggggtcagaggaccacagcaatggataaatagctaaaatttgactggagtgtggaagggagagcacggaagtgcagcaggggagtagagatgcacatgtggtgattggaagcccaggagggcagcgtggaggcaccaggcctctgcagccccctcttccttttatggattggatctgcctagaatcaggagggacttcccatttccaggactgttgatctaacaatctgatttaaaaatggggaaatgatctgaacagatatttctcaaaagaagacacacatatgaccaacaagtatataaaaaatgttcaacatcactaatcatcaaagaaatgcaaaccaaaaccacaatgaggtattgcctcaccccagttacagtggctattatcaaaaagaaaaaaaaaataacaaatgctggtgaggatgcagagaaaagagtactcttacacgttgttgggaatataaactagtataaccactaaagagaacagtgtggaggtccctcaatatctacaaatagaactaccatacgatccagcaatcccactactgggcatttatcctaaggaaaggaaattattatattgaagagccatctgcacccccatgcccctcctgcttgggggcaggcacacagtggtttagtcagctcaaggcagggttctccatgaacgggattgccacactgttcctttggctggaagtgcagagcatgaggtggtttccctgctacgcaagaccagaatcacagcgaatccccagcccaggctccacacagctgtggctaggtggaatgaagatggacccccagtgtgggacaggtgcagtggccactgacccccagaggagggcgcactccagagatgtctggtctcaacgtggcgcccagcggcagcagcttggctcacagagggtgggtagcggatggagagtatacactttgtgttcctaatcagagcaatgcagctatgtgaattcctggcagttctacaaactgggcttagggtttgagaggactgtaggattctccagtagtgaggactgtaggtgttttggtggcaataggggatgatgcggatcttctgcttaccttttcctggaaatgggaagtcccacctgattctaggcagatccaatccataaaaggaagagggggctgcagaggcctggtgcctccacgctgccctcctgggcttccaatcaccacatgtgcatctctactcccccgctgcacttgcctgctctcccttccacactccagtcaaatcttagctgtttatccattgctgtggtcctctcctgttgggagaaagagtgccaggcatccctcactagccctcttgctccacctcagctgtgtgatggcccatgtttcatgtagcaggcgctggtagcattggactttgggccatcttctctctacatctctctgaatctacatgattttcttctatttatttgaaaaataaccttgaatacgcttaaataaacatgagttttttccccaggaaatgtagacagttaagactattcctatgtctcaatcatgtctttctactgaatttttattttacagtcacattagttcatatttacaggtacaccatgggttttttttttgttggtttttaacagtttttaaactgttataaacaggtgagcaaactgtaaaagaaacaagacaaatatagatatcctttgtattcctacagtatttctattgtacagtttcttagtaattcaagtatcaaatgtacattgaatgcttaagatgttattgtttctagaaattttatgtttaactttgcattccctggactattgtgtattttgaatttatttgcaacagcaaataataaagcaattcaataactatataaataaaaggatttaattcaaaatttaggctaggcacggtggctcacacctgtaatctcagcatgttgggaggctgaggcaataggatagcttgagcccaggagctctagatcagcttgggcaacacagaagagaccctgtctctaccaaaaataaatttttaaaaaatccagctagtcatggtggcacgtgctgatggtcccagctacttgggaggctgaggtgggaagattgcttgagccaggaggttgaggctgcagtgaagtgtgattgcaccaccacactccagcctgggcaatgaagtgagatcttgtctcaaaagaaaaaaaaaagtatttaaggcactaaaatatgaggacatttccaaaacaagaagtaaaacactgacatattaccatccctggtcagtgaaagtattatctaggaatatgtttaatataaattaaaattccttagtgggtaagagaagccatctaatttcaacttagaaactggtctttcaaacatttggggcttaagaaattcccaaatgcttttagttaagcattactattgctaacttttgaactcaagcacatttttaaggaaatgtaatccacatatttcaaattcatttttgctttatctaccagggtatactttgtaagatcttctgattcctataagatattttgctgataatagaaatcttatcaagaaatgccctttggagatattaagaagaggcctatacccagactgccataatgatgaccttactgacttttttttaattaagttctagggtacatgtgtacaacgtgcaggtttgttacttatgtatacatgtgccatgttggtgtgctgcacccattaactcatcatttacattaggtatatctcctaatgctatccctcccccctcccccaccccacgacaggcccgggtgtgtgatgttccccttcctgtgtccaagtgttctcattgttcaattcccacctatgagtgagaacacgcagtgtttggttttttgtccttgggatagttgctgagaatgatggtttccagcttcatccatgtccctacaaaggacatgaactcatccttttttatggctgcatagtattccatggtgtatatatgccacattttcttaatccagtatatcatttatggacatttgggttggttccaagtctttgctattgtgaatagtgccgcaatgaacatacgtgtgcatgtgtctttatagcagcatgatttataatcctttgggtatatacccagcaatgggatggctgggtcaaatggtatttctagttctagatccttgaggaatcaccacactgacttccacaatggttgaactagtttatagtcccatcaacagtgtaaaagtgttcctatttctccacatcctctccagcatgtgttgtttcctgactttttaattattgccattctaactggtgtgagatgatatctcattgtggttttgatttgcctttctctgatggccagtgatgatgaacatttttccatgtgtctgttggctacataaatgtcttcttttgagaagtgtctgttcatatccttcgcccactttttgattttgatggggttgtttttttcttgtaaatttgtttgagttctttgtagattctggatattagccctttgtcagatgagtagattgcaaaaattttctcccattttgtaggttgcctgttcactctgatggtagtttcttttgctgtgcagaaactctttagtttatttaggtcccatttgtcaattttggcttttgttgccattgcttttggtgttttagacatgaaggcgttgcccctgcctatgtcctgaatggtattgcctaggttttcttctagggtttttatggttttaggtctaacatttaaatctttaatccatcttgaattaatttttgtataagatgtaaggaagggatccagtttcagctttctacacatggctagccagttttcccagcaccatttattaaataggggaatcctttccccatttctggtttttgtcaggtttgtgaaagatcagatggttgtagatgtgtggcattatttctgagggttctgttcttttccgttggtcgatatctctgttttggtaccagtaccatgatgttttggttattgtagccgtgtagtattgtttgaagtcaggtagcgtgatgcctccagctttgttattttggcttaggactgtcttggcaatgcgggctcttttttggttccatatgaaatttaaagtagttttttccaattctgtgaagaaagtcattggtagcttgatggggatggcactggatctataaattaccttgggcagtatggccattttcatgatattgattcttcctatccatgagcatggaatgttccatttgtttgtatcctcttttatttcgttgagcagtggtttgtagttctccttgaagaggtccttcacatcccttgtaagttggattcctaggtattttattctctttgaagcaattgtgaatgggagtttactcatgatttggctctctgtttgtctgttattggtgtataagaatgcttgtgatttttgcacattgattttgtatgctgagactttgctgaagttgcttatcagcttaaggagattttgggctgagatgatggggttttctaaatatacaatcatgtcatctgcaaacagggacaatttcacttcctcttttcctaattgaataccctttatttytttctcctgcctgattgccctggccagaacttccaacactatgttaaataggagtggtgagagagagcatccctgtcttgtgccagttttcaaagggaatgtttccagtttttgcccattcagtatgctattggctgtgggtttgtcataaatagctcttattattttgagatacgtcccatcaatacctaatttattgagagtttttcacatgaagggctgttgaattttgttgaaggccttttctgcatctattgagataatcatgtggtttttgtcattggttctgtttatattctggattacatttattgatttgcgtatgttgaatcagccttgcatcccagggatgaaacccacttgatcatggtggataagctttttgatgtgctgctggattcggtttgccagtattttattgaggatttttgcgtcgatgttcatcagggatattggtctaaaattctctttttttgttgtgtctctgccaggctttggtaacaggatgatgctggcctcataaaatgagttagggcagattccctctttttctattgattggaatagtttcagaaggaatggtaccagctcctccttgtacctctggtagaattcggctgtgaatccgtctggtcctggactttttttggttggtaggctattaattattgcctcaatttcagagcctgttattggtctattgagggattcaactccttcctggtttagtcttgggagggtgtatgtgtccaggaatttatccatttcttctatattttctagtttatttgcgtagaggtgtttatagtattctctgatggtagtttgtatttctgtgggattggtgatgatatcccctttatcattttttattgcttctatttgattcttctctgttttttctttattagtcttgctagtggtctatcaattttgttgatcttttcaaaaaaccagctcctggattcattgattttttgaagggttttttgtgtctctatctccttcagttctgctctgatcttagttatttcttgccttctgctaggttttgaatgtatttgctcttgcttctctagttcttttaattgtgatgttagggtgtcaattttagatctttcctgctttctcttgtgggcatttcgtgctgtaaatttccctctgcacactgctttaaatgtgtcccagagattctggtatgtcatgtctttgttctcattggtttcaaaaaacatctttatttctgccttcatttcgttgtgtacccagtagtcattcaggagcaggttgttcagtttccatgaagttgagtggtttttagtgagtttcataatcctgagttccagtttgattgcactgtggtctgagagacagtttgttataatttctgttcttttacatttgctgaggagtgctttacttccaactatgtggtcaattttggaataagtgtgatgtggttctgagaagaatgtatattctgttggatttggggtggagaattctgtagatgtctattagtccacttggtgcagagctgagttcaattcttggatatccttgttaactttctgtctcgtttatctgtctaatgttgacagtggagtgttaaagtgtcccattattattgtgtgggagtctaagtctatttgtaggtcactcaggacttgctttatgaacctgagtgctcatgtattggatgcatgtatatttaggatagttagctcttcttgttgaattgatccctttagcattatgtaatggcctcctttgtctcttttgatctttgttggtttaaagtctgttttatcagagaytaggattgcaacycctgccttttttttgttttccatttgcttggtagatcttcctccatccctttattttgagcctatgtgtgtctctgcacatgagatgkgcttcctgaatacagcacactgatgggtcttgactctttatccaatttgccagtctgtgtcttttaattggaacatttagcccatttacatttaaggttagtattgttatgtgtgaatttgatcctgtcattatgatgttagctggttattttgctcgttagttgatgcagtttcttcctagcctcgatggtctttacaatttggcatgtttttgcagtggctggtagcagttgtttgtttccaggtttagtgcttccttcaggagctcttgtagggcaggcctggtggtgacaaaatctctcagcatttgcttgtctgtaaaggattttatttctccttcacttatgaagtttagtttggctggatatgaaattctgggttgaaaattcttttctttaagaatgttgaatattggcccccactctcttctggcttgtagagtttctgccgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtcacgttctctgtatttcctgaatttgaatgttggcctgccttgttaggttggggaagttctcctggataatatcctgaagagtgttttccaacttggttccattctccccgtcactttcaggtacaccaatcagacrtagatttggtcktttcacatagtcccatatttcttggaggctttgtttgtttctttttacccttttttctctaaacttctcttgtcacttcgttccattgatttgatcttcaatcactgataccctttcttccagttgattgaatcggctactgaagcttgtgcattcgtcatatagttctcatgccatggttttcagctccatcaagtcatttaaggacttctctacactggttattctagttggcccttcgtctaatcttttttcaaggtttttagcttctttgctatgggtttgagcttcctcctttagctcggagaagtttgatcatctgaagccttcttctctcaactcgtcaaagtcattctccatccagctttgttccattgctggtgaggagctgtgttcctttggagggggagaggctctctgatttttagaattttcagcttttctgctctgtttttttccccatctttgtggttttatctacctttggtctttgatgatggtgatgtacagacggggttttggtgtggatgtccttcctgtttgttagttttccttctaacagtcaggactctcagctgcaggtctgttggagtttgctggaggtccaccccagaccctgtttgtctaggtatcagcagcagaggctgcagaacaacgaatattgctgaacagcaaatgttgctgcctgaatgttcctctggaagcttcgtctcagaggggtacmcggccgtgtgagctgtcagtctgccccyactggggggtgccttccagttaggctactcaggggtcagggatccacttgaggaggcagtctgaccrttctcagatctcaaactccgtgctgggagaaccactactctcttcaaagctgtcagacagggacatttaagtttgcagaagtttctgctcccttttgttcagctatgccctrcctccagaggtggagtctacagaggcaggtaggccttcttgagctgcagtgggctccacccagtttgagcttcctggccgctttgtttacctactcaagcctcatcaatggcaggccattgattcccccagcctcactgctgccttgcagtttgatctcagactgctgtgctagcaatgagcgaggctccatgggcatgggaccctctgagccaggtgcgggatataatctcctggtgtgccgtttgctaagactgttggaaaagtgcagtattagggtgggcatgacccgattttccaggtgccgtctgtcacagcttcccttgcctaggaaagggaattccctgaccccttgcacttcccgggtgaggtgatgactcaccctgctttggctcacactcagtgggctgcacccactgtcctgcatccactgtctgacaagccccagtgagatgaacctggtacctcagttggaaatgcagaaatcacccgtcttctgcgtcgctcacgctgggagctgtagactggagctgttcctatttggccatcttggatatgatttcgaccttactgactttcgaaggaaaaagaatctttttctggttttagtcatactgctttccttccatctcagatgtaataacaaattaaatataaataaaaatatcttgacacggaatcagctggttgtgggcaagtttcatgcagaaagatgtgagcaggacacttgactctttcactttaggtaaggctggcttggaataccacaaccataaaacagtgaaggggtttaggcacaatcagtgagtcaaggggtctaagaagaattccccttctctttttcaatrtaaattctacaacctcgccacccgaccttcttgagcagaagcctgaaataatttatattagcagtgcattcctttgtgttcccaccctctatcactttcctccagacacaagggtctgatgttctccagacagatgaggatttagagacacgggagagtacaaagggaagtgtgaggttgaggtgtccccagtgaatgggtcaatatcataagagcagtggagccctcagctacctttgccctacttgtccagtgcagggcccagtgcttggcaacaacagcacagggtgaggaacaggattgccacctttggtggatggctgaccagggcacagaaatccatgcagcaacaaatctggccagggccaacccctgcagccagcagaggccttcccatgtcataagtcactgctttcacagataaatgacctttgcagaatatttccttgtcccctaaaatgctagacaagcagaagcccagggcactagaacaatattctcaggccgtgggggtctcaggtccaggtgggacagaaacagcccttggagcctgaatttgagatgccttgtttggttttccaataacctccacttttaggagtctggcttaaataacccagttatctcacatacctcatgggatacctactcagagtgtgcagagggtgggttggagtcccagggccagaactagagtggagaaccctaaccacaataactgagaatagaagcagtcagcaccaaggttctgagtcaatatccttgcaatatcactgtaggctctgaaccttcttgatgcctagtgtctggcacagcactaggcacaaagcaagtgctcaacacagtgcagtgcagttcagtgaattcacaaatgaatcaacaaatgaggagcaagggacaagtctgcccagcacctgacttaatagagatgtccataycatcaatgtgcagtcttgagcttgtgactgaatcacwatctttctgtggactttaatattgcatgtgactttttacttatagttagggtgacagcccttattaggaaaagttaattgtcttatgatgcaatataaaagtttgaaaacccacagagactgccacaaataaatgatatctgaatctcagcattgaaaaagaaacagaatagttaagatgttaaccatttgctgggagtacatgcatggtattttcaaacatttgatacattgaagaaaacatagaattagtgaaaattgatttccaagatgcttcacyttttaatcatgatggggaaaatttaggtttgaaaaatgtggaatagtttagaagtacaatttaaagatctaagctagcaatattcaatgttttaaataaattagcttattacagttattcataaaggtagagaagtgcaggagtcagtccatcaggaggggtggtttggaacatggactccagtagacaaggccttggtttacagatttaacctttgaatctataataatggctaattygttgcatatttgaggattaaatgagggaagcatccaaaaaaatatgactttcttctaaaagctcttagtacatttactcctaaattgaatcagcattcacattataggaactatttatcatagacattaattgcacattcatttttatctgtagaaaaatatcaggaggaaggatgatacgtaacttgtccccactgcttccacctccagcccacccrtatctaggaaagccctggttgaggaatggacctggtaaagacctccccagaacataataactattctggggaggtgctatttcatattattcttcaaaccagagtggtaactgaagaaaaaaaaattaactgccaatttttctatatccaatgatcttcagacacaattcttattttctgagtattttacatctctgaggctatcacctaaaatctttttatgtataaaataaacttagttgatcattttatccctcagaaggctagcccactgcaataataacttggtgacagttgaaaggctaattgaatctattataacagcacagctcaattctaatccatttcctggtggaaaaaaattctagtgaaggtatttttccccgattataaaagtataatrttccctgtaaaatattggaaaataggaaaaaaactaaagaaagtcatccttaatcttatcattttaccacttttagaaatgatatgtatttccttccagaatttttttctgtgttggaaaatattttgaccttatggagcaagattattttttcaaagatgcttcactttttaatcatgatggtgaaaatttaggtttgaaaaatgtgcaatagtttagaagtacagtttaaagatctaagctagctatgttcaattatagctgcctttgctacaaaattttatcaggataaccttttaaattaaatatttttgttgaaacactggaaacaacagtcatgttaactaacattttcttaatttaatatgtaaagaaatgccagatttctctttataagtaacatttatcgcactgctatatttgatatctagattaatacctttatttaaaaggatattcttttgccatttcttggtaaaatatatttctttatatataaatacataaatttatatacatatataaatatataaaatgcctatggcatttcctttgacactaaaactaagcgtaataattccaaaaattttagcatttttcaaacaagtttaaaatacagaaaaatgtttatattatgtcttacaatattattcactgttaatcaaattacgttctagagcagaggctggcaaacttcccatataaaagtccaagtagtaaatatttttggacagtttgtgtggtctctgttgaagctgctcaattctgccattgtagtaggaaaacaactatagataattcataaatggatggctatgactgtgttccaataaaactttgtttaaacaagcaagcagtgagtcagactttgcccatggacagtagtttatcaacccttgctctagattatatttttccacattcacctggagttttgtgttagatggagtgtaggggtttctgatcctccatgcgagacttctggtaaacatagctgattgaacatgtttatctctactagcaataaaaccccacttaaatgataataaaggaaataaaaggtatacgcttaggggaatggagaagaagacagcagacagagatgaatcaacacaatgttgggcagagtgaagcagatgcaagagtgttcactgamctagcggtaagcagtgcccaggtaataccattgtggtccaagagaggtgccatataggaagcattttatccagttctgctgaggtcttctaagcatcattggaggggcagcaaatggttcctcagtaatgctaggttataatctgatgcagtcactgtctgagttggcacccttagctcatctgtaaaactcaaagtaattggttttgggggaaaggggccctaactctaactgtaaatatattggtattcagasgacttagacaagaatagtgccaacaataactagcagtttaacattcactgcttttactgctattaagctattctgaaaccctttccctctagcctgctttctaagacccaaaggaaatattcgcagtattttcagtcactcttagtactcattgatgaggagctatcatgtaaggaaggagtagaaaatgagaagacaagaaatgccagaaggaggattctacgatgctgatttgcatgtcagggtctcggtccaggaaggaaacagcaggcagagggaggctggtagccatggtgcctagtgggctatgtagtgactcactccaccgccctgcatgagtccagcaaacaaaggcagtgtgttaggaaatggtgtgcttgattgtaacagatgcaaacttcaagggtcactggagtcacatataagaggcttcactaactcggagccaataactcccatctttttcccagcagaatatttggagaattgatgagaaaaaaaaagtacgcatagttgactgatttcttttttgtagagatggacactttttgtactctattccttcttctgtcccacactagacactatttatattcagatcctatatgctgtattcaaaggggaaaacatttggtcttcttgggtttttactaccactattccatgattgtctttcctttgatttgactacctttcttcataataaatcttcctgtcttctccctctctttgttgttctcctttcctgtctcagttttctgtatttgcatttccttatcccatgcacattcctttccttcttgtggggagttgttttttgttctttgtttttgagatagggcctccttgttgcccaggctggagtgcagtgatgcaaacacggctcactgaagccccaaccctcaggctcaagccatcctcccaccgcagcccccaaagtagctggaactacaagcacaggccactacacccagcatttttttttttttcatagagatgtggtcctactatgttgcccagtggtctactgtatttgagaatgtcaaagaaaaaaacacctcccaatttcccagtgccaacacactttgggctttttgacagcagctttttggagataatttcattgactctgagcattataatattgatgaaggtgatagataattttaaaaaggtgaacaaattattttatttaatcctggtgacaagtctgtagtgtagttagcactgtcctcattttatgaatgagaaaatagaaaggcgaataacctgtccaaggtaatatggccagtagaaggcagaatcaggacttggccctggctctatgatcttgccactgcttctttatcccacactgccttctcggacatgccattctcatccccacctccatgcctttacccaaactsttgctcctctaggtgcccgctattttatttatctaggcctagcattcatcagggctagcctatttcttactttctacacccccgtgattcccagtacttctcatttggcacttgatcatggattgctctttttaaatattcatatacttctgacatctcttttttaagctgtaaaactctgaatctttttatagttttaacactcagcccaatgtctcatccttggtaagtcctcagagtatttgttaatgatggtgatgctggtagacatttccccagtgcaggataacaaatgaaatcaaccttcctcaagcttaatggctgttcatgttgttacagcagctgcattaatgacaagtaatctgtaacatttttcagaacttgtactctaagagtacaattagccacatgaaaatgccttcctcagaggcttccagtcttacctgtagcctgaagaactgaatttccttaagactagaattattttctaaaattggctttcaaattcatggtatatcccgagaattggctgcacaaaattagttgctttctattcagtaacacctcatttagcagcagtgactgaaataaaatgccccctaactttctcatgtcagccacatgatcatgaagtcaacagggaatagacggttggcatcttaggaaagtcaggcttagttagtagttgctaaaggccacttctaacaggagcgtcaatgagtttgatacacactacgtggagttgatatacactatgtggaggtcctatataccctgcaycaacatatcggacataataaacctcctggtaaatacatataactctcccatgagtgttcttctratgcctgatggtggccagcccagaaggtcttagttcagaactgccaaccagagagagcaatgcaatgggtgactcacatatacatgatcttaggcttatccttccttcctctggggaaaaaaaaatgtaaacggacccattttagtggagtttattaatagaatttcctaaaattttctgtgccctatatctggttactgttatgcattttgcagagttgcaaagtaattggtagcacatggaatggtacctgcaggggatcayggcttgcctgccttatttgcctctgtacaacttttgataaatctgtgcttggaagagccaagtgtttatttctaccatatgggcttccactgactcagtgtgaccacaaagtggctctgtattgttgccagaaatcaactacattagtgtcatgcaaatatatagagaggtatgtgtgtgtatttgatttaaaattcatgtaaattccaaaattactttcatgtctagaaactgtgctaactcctctgaaaatatcccagattcctttctgatcatgttgacattgactactttgtattcttaatgtttggacatctaacttgtatttggcaaccatcaagagtacctggtaggaaaaagttgaggtcttccgagtgaacttcccctggcggattttgtgatcggataagcactgcaaaacattcctcatcccagaactgagtgacactcatcacttattggaaggtgcattcttcctagggrataccaaaaattcactggagaactaaaagtatcaatatagtcatttaaagataagttcaattttcagttagtttcataatttatatttttcattattcctactttgggaagtattactggccaaattcctggaaatatcagaaacaacattgaaatcaatccaaaaatatgaacagcattgccacaataacacttttctgtaattgtaagcagtcagccacccaatcagaaatgatcctgatttgagtattgtttgtaagcactgctcctcatctgtgtgtacaatcaggtgactggaaaagtgatggcaaatgtcactcttcagattcacctccttcataattaatatgacagttttatttttaagtttggacattgkaagaataaggaaataattattttaaaatatatgaccattccttacaagttgaacacagaattgccatgccacccaacaattccactcttaggaatatactccaaagaattgaaaacaagtgttcaaaccaaaacatgtacttgaatgttcatagctgcactattcacaatgaccaaaaggtagaaacaactcaattgtccatgaatgaatgaggaggcaaatgaaatgtagtatattcatatgatggaatgytatttagccatgcaaaaaaaatgaaatactgatgcatgctacaacatggatgaaccttgaaaacatcataataagtgaaagaagccagacacagaaggccactcattatatgattccatttatataaaatatccagaataggcaaatctatagagacaaaatgcagatttttggttgccaagagctaggaggaggggaaatgaagaataattgcttaacrgatgtgggggttccatttagggtgatggaaaagttctagaactagatagtggtgataggtgtacaacatcataaatgtacttactgccactgaactgtacactttaaaatggtcaaaatggtaaattttatgttacatgtattttactgcaataagaatttgttttaaatatatgactacatattctgtgataaactccatacttaatatgcagcatatcctccacaaataaacacatacaattagtgtaattatggaatggtctgggttaacccttctatgccagcagtagccgcaagcaccatgtactgggcagtattttaaatgttttatttgaccctgtaaggtacatattactattcccaaattgtgaaagtggaaactgaaatatagaaaacaaaatttgcttaagatcacataactggcagacctgagatagacctgaaatttgagcccaggttgtgtagcagcatggtgtttcctattagcccctgtactgtgggctgagctgaccttgtcctgtgataataaagcttatgtacaatggaagtgtgctctcagctctcagaacaatgttgataaagtttcagaccttaaagaacagaccattgttattcaaatctgcaagtacaaccatatttctatttatcttattatttatttgcctgattatcattgaacatacacaaaccatgaaagagctgcaagaagtgtaattctctctcagtgcaaatttactgtgctatgctaggctattgccctggccagaggtgtcctgcggtcctctgcagtcatcttctgttggaagaagagttaaatccaatttctcaaatatatcccsctctccctgtctttcattcctggtgctagatttagtaagtgaagtgaggtttggttgaatcgtaaagcagagtcttggccacaaggcatgcatggggctgaaagaagtaaagaatatcataggcatacgcaatgggggtaagaagtgttgtatgagaagagactaactagaatagaatgtcagtctcccccaaggatcaccataccacctcaaatcacactgtcctaggagtgtggctcacttgcattggataaacagagcttctgtattgccgaactccagacggtatcacttacactgtggcctgtgggaataatgtccctcctggactcatgtggtggaaagcctgtgtggctgttagcaatggccctgcagatgagccccagcatcctatctgaagggatgaaattttcagggcagcaagagctccaggacagatgcagttcttggctgcaagtcatgtttcatccatccagcaagatccattcaggtgaacacaggatatccatgcacagggccaatctccggataggagagcactagcagcagctaggtaggattcagaggtggcttctattccaacaaaaggatggggtgggtcccaccaggatagaagaatgaggacccatagcttactgtttatgtatctccatctttgtttattcccaacccagactatttccagcctgttaacatagtggcctcggaacctcagttaaccaccaggcctgcctcccttggttctggatgtggctggggcaaaacctgccatgggaaggagattgctgctcttgataggtggcgagggctggcataagcaagacaaggctccatgatccctacagctggagcacgtggtctttttaggctccttactgaaacttagtgcttgagctaccccttgcctttttgccatcgaaatcctgagaaagacccttcattgtttatcccatttgctgctacttctatcaacccagaartccagtccaggactcaataataatgaagtgttttatgatacagttttttcatacagaacaatcccagttactatgtggctgctcagatggttgcgtgttcatgaatgtggaaggccctctcctgggggcaacagctcaacagctttctgctaagagatttcctttgagcaataagctatcatacagtgcagatgggttttaagtatttcaactattttcaagcaggccctgggtcataaatgccttcatcttgactttctaatttccagattccctttcacaagagagggttctcagtgaagcagaaaaattgactatagaggtcttgctaatctcaaaacactttatttaatttcaaagtgaagttgttatgatgtaaagaatagggaaaattgaactgtgagcttcttcatgcttttaagagtttgggatctaaagacttgaaagaaaagaagagctttctgagttgattccattgcaatcctgtctattaaaagagagaccaccactcaaagtccattccagctctgggacataagattttgaactgacacctaacatcagaattcctccacaaggcaaatttctgagcttctagaggttctggggacaataagacactcctacagcctctgttgaattaatgttgccttctcatcccgaagttcatgctaccctgtggaccactgggaaatagtcagttgaggcagaggtaattcaactctattaaatttttactttagtttttcgatggatctttctgtttccttcaataggacaaaatatataaccagctgtttccaatttactgctagaaggttgagtttctggaagctgaataacattactagtcattattttatgacttttcatctgagcagcagtaagaaagtgaaagtaaaactaattaatcagaaatagtaaaaaaaaaaaggcaactctgtttaatattaattatgatgattgatgtcatcatcattggattttaggtcacataaaaatgaaataagttatacatgaagacaacttgaaagaagcaataaatgaaactaagatttcaaagatatattgacctctatcatgtaaagcatgaatttatagaaaaataattttatgattatgacatttgcttttactgtagatgttctggtttccatggctaacctgacagaggcaatttatttccttgrgttgttcttcgattcctgttgccttcagttcaggtggttcccactggaaaacagtaatatcttgagctgggatttgatgggtcaatcacttgggcttctctcaagagaggtttgggcatggatgggaatgtgccacataactcattcagttatacgataaagataaaaactgcaataaataccaaaagcaaattatcaacaagtctctacatacagaataaatgaaagtgatatataatttataagatttaaatcattaaaaataaatgggtataaattaaatycctcttcgacttaaaaggggggactaataattgctgcttcatctaagcataacctatgtaagctgcagagtataacgggcactagagtcaaacagtctagatttgtctggactgccagttgctagccatgtgaccttagataaattacttgacatctttgagcctcagattcttccacaaaactggaagtgtctacttcattggcatgagtattaaatggcaatacacacataaaactcttagaacattgcccagtacttaaaaactartcaattaatgttagctttttttatcttcctgccacgaagctttgaatagagcaaaatatcaagcctttcctgagcttcctggtggcattcctgcaacatttctgtgcttctgagcctcaaaacgacatgtacatcaaaagtctcacttgcacatatcttaacagtcctaggactttggagacgctcagagagcaagtgatggtttcatgcattgttatgaggttttctttcttgctggaccttctacttgtgccctgtccccagagaaatttattctcattgtatagaatgggattttggcttacacatcattattagctgtgtagtaagttcattttaaaataagcaattaggtgaacatttcaggacactgagcaacctagatgccaagggtcattatgcagtctctttcctctaattaaaatagcattacagcaacattcaaacatttccacctggcctagggatcctttttttttctttttccatatacaatagtagcagtaacagtgatcatgataatgaacattattaaacacatgctctgtgccaagcacatgtctgtctgagagccttacatgaattaactctttatgctcacataactaactcattccactttgtccagcactttcctagtgmcagcactggaagacttgcatttcaggagccactctaatctcaggcaaatcgggatggccggtcaccctaaacaacacttagaaataggagctcttattagtgttcccarttgagccacagagaggttatgtaacttgcccaaagacacacagctggtaaataggaaagtctcgctccagaatctgtgttcctaaccaccaccttggagaagaattgaactttggataagggatcagagaagttggctttagagtggcttctgagaggaagggctctttgttccctctctcagggcagaaacattgcttgtgagagcatccaaggctcttcaacacctgatttgaataggttaatgggcaagtcgtactctgttctttaatagtaacataaagcagcaagcaggcacaagtttttaacagttttcatataagaaatttgcaagtctatatgcaccaagggacactacataccactgtgtgttatttgatttcgccctcacatgcaaaccctcaacgtcctcctacagctcactccccatcctctaccctttgctgtgtgactcttataagtgtttctaaagttccctgattctttaggacaagatttctttctccacctgagtcgtcttcttcactgtaccatagttttattctccatgattactttttcacttattgtaatattataaaatttattttatattacaacttagatttgcagagaaaatgtgccatcattatgtctagagctgatcaagagcaaccaaccactgggtagtgaggaagaaaattaagagtccctgcctaaagttaatcccaactgctcatttgaatggtactttaggagacaatctttcctttggataaaaatgttctttctctcatctctcctatgcttatctccctaaggtggcatctgggagcattaggaagtggctcctgctcccttgtggtggtggaaagcattaatgtccctggataggggtgtggtgtgtcttcttgcctgaaggataatggttttttttcactctacacatgggccggtccaggggtctcccttgccaatctgacctcatctcagtgcccactggtgtgagatgcccctcttgagtcctggcttggacaattctctctgcagtctactgtgcagagccacaccatactccttgcctcactatggtgaattctctgaaatgctgaccagcaagatcctcagctactactggctccactctactccataacagaggaaagagtgaccatgaaagctgaacctcagagattcctttctgtctggcttcaggagctgtgcttttaattaagttggctaccctgtgttggtgctgagggccacctgggagtgaatcttcagcggtgaccattgcccatggtgttaccataatgtatctaatatacttctccttctccaggccaaagcccaaatgtgagggaagtcaggacccacttctgatggctttacacttctctgtctctctccttctctccataattttccttgccagaactaaaacctgttctcttttacttgttccattctatattctcctacctaacaaccatagaactgaccaagctgtcaccctcttcatactacaggtcctacaatgtatatcctccatgttcaggaatgataggctaaagggaggtaaggaaatttagaaaattccttcttgagacaaaagcctcacttgcaaggctattatcttgctgcataacycaattttggcagttaaaaaaattaattccattttactyttttggtactyctataactgttgaatatctactctatcaccattcccaccatcactcgacagccagataggtggagacttaactggattcaggcaaaggctatgtactcagaaggcaaaraagaaaaacatatttaaaatcataaatgttagccctgttacatggtaattagtgagacatcatttaaattgtttgcttaaatcccaggatacaaaagtagtgctcaaaaatcacttgcattcctatacaccaacaayaggcaagccaagagccaaatcatgaatgaactcccattcacaattaccacaaaaagaataaaatacctaggaatacagctagcaagggaagtgaaggacctcttcaaggagaactacaaactgctgctcaaagaaatcggagatgacacaaagaaatggaaaaacattccatggtcatggataggaaaaatcaatatcatgaaaatggccatattgtccaaaataatttatagattcaatgctattcccattaaactaccattgacattcttcacagaattagaaaaaactattttaaaattcacctggaaccaaagaagagcctgaatagccaagacaattctaagtaaaacgaataaagctggaggcacccaatttcaaactatactacaaggctacagtaacccaaacagcatggtacttgtacaagaacagacatacagaccaacagaacagaataaagaacccagaaataagactgcacacctataaccatctggtctttgacaaacctgacaaaaataagcaatggggaaaggattccctattcaataaatggtgctgggagaactggctggccatatgacgaaaattgaaactggaccccttccttacaccttatacaaaaatcaactcaagatggattaaagacttaaatgaaaaacccaaaactatcaaaacccgagaagaaaatctaggcaggaccattcaggacataggcacagrcaaagatttcatggcaaagatgcaaaaagcaattgcaacaaaagcaaaaattcacaaatgagatctaattaaactaaagagcttctgcacagtaaaagaaactatcatcacagtgaacagatgatctacagaatgggagaaaatttttgcaatctatccatctgacaaagacctaatattcagcctctacaaagaacttaaacaaatttacaagaaaaaaaaacaaacaactccattaaaaagtgggcaaaggacatgaacagccacttctcaaaagaagacatacatgcagccaacaaacatgaaaaaaagctcaatgtcactgatcattagagaagtgcacatcaaaaccgcagttagataccatctcacacaagtcagaatggctattattagaaagtcaataaaacaacagatcctgatgaggttgtggagaaaagggaatgcttttacactgttggtgggagtgtaaattaattcacccattgtggaagacagtgtggcaattcctcaaagacctagaggcagaaataccatatgacccaacaaacccattactgggtatatgcccaaaggaatataaataattctattaaaaatatacatgcacgtgtatgttcattgcagcgctattcacaatagcaaagacagaatcaacctaaatgcccatcagtgacagactagacaaagaaaatttggtacatatacaccatggaacactatgtggccataaaaaaaaaaaaacaagatcatgtcttttgcagggacatggatggagctggaggccattaccctcagcaaactaatgcaggaacaggaaaccaaacaccacatgttctcacgtataaaaaggagctgaattatgagaacacatagagggaagcaacacatactgaggcctgttggagggtggggaggaggagagagagcatcaggaagaatagttagtggatgctgggcttaatacttaggtgatgggatgacctctgcagcaaaccaccatgccacatgtaacaaatctgcacatcctgcacatgtacccctgaacttaaaaatatgggcacagtggttcatgcctgtaatcccagaactttgggaggctgaggtgggcggatcacctgaggtcaggagttcaagaccagcctggccaacatggtgaaaccccatctctactaaaactacaaaaaaattagccaggcatggtggcgcatgcctgtaatcccagctactcagggagtgctgagacaggagaatccttgaacctgggaggtggaggttgcagtgagctcagattgcaccactgtactccagcctgggcaacagagtgagattctgtctcaaaaaatacagataaataaattgcctgctttaacaaatagcactttttcattgtatatttttaaattatgtaagtaatacataaatataaactgataaggagagaattaaaataatacagaagtatatgaagtaaaatgtgcatgctcctcaccccactcccacttctcaatatgaaagtaatcactgtcgatggttgatctataactttacagaccttttcttatgcttttatatatgttttcacataacaatacaaaatttttatttttttcctcaaaatcagggtcaaagcataggtctttgtacacctatggcttgtatatttctgaatatataattaccaaatttgtgttattaaagtaatcacttgcaaaagaattgttttattctctggataagtcaaaacaaaagcatccaacatgcccatttgacaactggctggatttttgccacaatggggaaatgagcatagtacttttgctctgggtagggacgtcccacacatatgyatgtgatatagccaggggcccaccagctgctgtaaagggaacacatatttctcaactaatactgttgtaaatagaacttagtaaacactaggcaagtcctcttttccattacctacgtgtcctagattctcaacaaatgagagatttggcagtttttccttcagtgcaggtcagttcaacaactcacacttctgaacaccttctacagaaccgagctctgaaaacatcaaatgattaaagcagtgtccactcatgaataattatttgatgtaatttcaaacagttatttcaaattcattattatttttgagaatctaattttgtttttaccttaaaatatcttttcttctatttactccatcaaagttatgaaataattgctgttctattcaaaacttctaaactttaacttggaggtgaggaggaatagagttttagtctaaaatactaatatattttacaaatcacatggaatcaaagttttacaagtggtccacactggcttgtgatgccttcttccatttttttcagtcaaaagcaatggtattttaaagtaatgagtttgttctgcactttttccccaaattggaacttatggttgacttcaaaaacatactttattttacctacttttggaaagctctcatcagacaaattaccagttccattttcttctacttttttttcctgtccaatttaggacattcatacaattaaatgacagtattatttattcattgcgtcaatgttttgaattttttgtctttgaaatacaataaagaagaattaaatggaaaatgaaggaaattgcttcaagggttcctgtcacgctagtgtcaagtaggcagaagaaaactcctcctgttgtcatctagcytgtcgtgagtgccaagtgcaagccctcatagccctgagcaaatgtccagccctgctctggacagccctcacagacacatttcttcacaggcctctgtaggccattagtaaattgtagaatttcagagataaaaatttcatttctaatacgaaatttcctcaaaaaatctaaacatagaattaccatatgatccaacaatgccacttctttgtatataccaaaaagaatttaaatcagagcctcaaagagatatttccatactcatgttcatagtagcattattcacagtagccaaaaggtatgaacagcccaaatgtccatcarcagaaaaatgagtaaacaaaccatggcatatacatacaatggaaaataattcagctttaataaagaaatgaaattctgacccrtgctaccatgtgtatgaacattgaagatattatgctaagtgaaataagccagaacaaaagaacaactattatatgattctacttgtatgaggtacctagagtagtcaaattcataaagacagaaaatagagtggctggttgccaggggctcaggggagaggaagatggggagttacggtttaatgggtatagggtttcaactaggaaggatggaagagttctggagatggatggtggtgatgtttgcacaacaatgtgaatgtatttaatgccagcgaattgtgcacctaaaaatggtttaaattttaaaccatattatccataaagtggtaaattatataaaacgtaaaacataaattatatgttttatataatttaccacaataaaaaatcattaccctcatggagctcacaatctaggagagaaagttaataagcaaattaaaatgtaaaaatcatttaagtagatgagctttttttgtttgtttgtttgtttgtttcattctggatcagcttttggtctgctcccactttaaagataagaaactcaaggacagagaggaaaagaaacacaatctacccataaaactmtgtccgaatcctcagccaatgctctttctattgaattatacttctttttgaggtacttctattacctctgttttatctgagccattcactcatgtactagaaagagaataggctctggcatctgggttcaaatttcagctcagctgcttcctggaagtttgatcttgagatttcctcttcagtaagatggagataacaaagcctgcttcataaagatgaaatgtaattggttacacttacatctgggtacaaagtaaggagtcagtgaaaattagttcctttcctaaatctctcaaaatggcttctctgagtttgttgtttatttataagctatgttcagtgtgtaaatacttatagtctggcagtttcagcaaacatattcatgtgtttgagcttttataaatcattgtagaaatacagtttctacaatgctcagttgaacaccctgggaaataagccagatacatttatctgacctttatttcactgggagggaaatttcaaaggataagttttgtaaagaattcaaaatgagacctaatttattctttttttccaaaacataaagccaattctttgatatttctactagctattaaaaaatcaaagccatattccatttttaatcttaagacacttatctctaaaccaaaaaatatatatatataatggcataggttatgagtggccacctgagaaataggttataagtgtctagtctcccaagaagaacgatgtgtttctcagatactgtctagtgaatgccttgcaggaataamggcatataaatggcatcgtggaggaggagtggcagaagaaacaaagaattccaaaatgattcttaaagattttgactcaaagaagaccaaatattcttgtatttttgtatcatgtctttaaatttatttatctgtgtaatatatttggtattttaacacataacacattatattgtataattacttatgttcatgttaactttagtctttataaagaccaaaccaaatcctttgattattagaaaaagaagccacattccaataaaaataaagaaactactctcagatttggttgaatatggaaagcattctatatttaagacagcatgacttctctcttcaacatttagtctagaaaaatgaataatccttttggcatcaattatacaattatataagtaatatttcaatgactgagataaactaaacatactatctggaattaccttaaacatttatgtttatgtgattgctttcagggttctctacacctaaagtgcttgtttctctcacactttaagttcaaaatcttgatcatttttcaaagtatacctcaaatatctccttctccatgaagcctccccttgttccccagtcagaatgagttgcttatttctgtgagcagtcattattatgtgtccctccattatctcataaacttaaaacaacttataaccattgttrtaagttcagatgtttctcccatttggctgcaagcttcttaagagcaggaccatcatcatggcccctattgctctcaacacatatctgacactcatccattcattcattcatccaacaacaatttattgcattcctgctgtttgatactatggaataaacaggagggaaatacaggaaaaattaacaactaagtcttaatgtcatggggagaattttgcaagccaagaaagctctgaaaaaaataaggataaaaatattggtacagaccagatgtactgaaagcattcacagaagccttatatcacagaactgatgtatttttatagccagtgtatatgcttctaagttaagaatctctctcttatactactttgaccattttatgtgatctgagactcctgtgggttgtgtataaaaagctggtaggctcagagtgagtgaaataaatctaatcaatgtttattttcaaaagaaaacatgaattggcagtaaaaatttagagggaggaaaaagacagaaactattttttcatgataaaggcctaaagtccaacttacaactctcaagctaactacatgaattcttggaaaagaaaacttgtttccttttgaaactttccattaaaacaaaacatattgctatctcaatatatatgttacacttagatttatttcaaataccattttttgtatgtgctcttgagataataggtttcctatttctttaccataaattaaattcaatttttccgagcatatgtgccaacttaaaaaaagtatatcattgtcaaacaatttctgatagggcaattttaagttgatawtatgctccattctattctcccaggtctttctcagtgccagacctcctggtcttgtccactgaggcttcaagcactctttacatctcatgattcattcgcccacagaatacagacatgatttctgattttatacaagaacrctgtatgttcaacttaaatctttttaatttcctgaaacaattaccttcacaaaaactagtcctcttctgtaccaatgtttcagaatcacagaaagctattaattattaacatttctgtatatatctctaacttgccctgtcacattattgtttggtttccaagaccttctcctctaatctctcattggccgctctaagatttttcaaacttttcctgaaagcctgtcacttccttcatacctgacctctgatagagcacagacaagtcttcctcccccattctctagagaattcaacaacactctgtcttaggtggggactgactctgtcgcccgtactaggatccttatcagcttttattattttgtttgtttgcttttagagacgtggtctcactatattgcccaagatggccttgaactcctgggctcagggattctcccactcctgcctcccaagtagctagtattaacaggtgtgtgccactgtgcctggcttttctcatcgactttcaactaactctagtccatttccattgtaagagtagggcatactggatcactgaatctattaattttctttctttctttctttccttttctttcattctttctttctttctttctttttttttttgttttgttttgtttttttgggacggagtatttctctgttgcccaggctagagtgcagtggcatgatctcacctcactgcagactccacctcctgggctcaagcccacctcctgctctgccccccaagtagctgggtctataggcagatgccaccatgcccagctaatttttgtattttttgtagagaaggggtttcaccatgttgtccgggctggtttcaaacccctgagatgaggcaatccgcccaccttggcttctcaaagagctgggattacaggcatgagccaccatgcctggcctctattaattttcaaaacatttcacttaaaatgtcagattaattctgaaacaaaaaataccccattaactatcagtatgactctacagattaaaaaaatccccagtatagtagcgcctaaaacattccaacatggtatcagccctgctgagttccaatcctggctctgccacagattgagcaggcttgagccattttttctggatctctgagcatcattcatcattcatctctccagacattagtcatctattaatatttatctcatgtgccaaggttataagagggaacaacacagtcacagtggttcactagactggctttctaatgtgctgttacctcatctttataacagaaataatacccatcttgtagggtaaaattaaatgaagtcaaacacataacacatgtggaagtcaattaattataatgtttattatccagtacttaacacagtgcctagcccatagaatctcaacccatatttgcttcattcattcatttattcattatttctttctctacacatggtgcctcaccacctctacaccactcacccactacttccttgtccctaaaggataatctcattaagactcccagctgaaatccttcaaggcgagatgaccttttcaaacccgaccagtacagttcacaggaagctacacctcagccagagttattttggaagctatctctgaggcccctgcacaaccaagagaacagcatccatggttcatggcaagtcatttactacccagaaaatgcctgggttttcttaatccatttgtttatttttcccaggttatcacttcaaggtatcccatcagatgaaaatgatatagtatctcccattttattggtgagagggttttccccccatgggagttgctgagtcttcaaacattgttaattaaaacaataataataataatttaaaatctttatttaaatctactttccatgaaatggatcccctctcaaatatatagttgtttgtagttattagctcacagtttgaaaactgaaggatattttataaaggcatttgtgtgttgaagtatcaatataaagtgtaactctggaaagaccataacgtttaacgctatatgtatttgtttctagacactgtgagaagttgtgtagcaaagttgttcttcacctgctccctgaagggtcattactgcctatacagtaagtccagttttattctcatcagccaagaacctcagccatggatccagatcatgtttctatttcagcaggtttgtataatttgtgttcatcaggctctttaatgagcttctgggatatgggcttataatcatttttattgaattattctttggccagagttgatatgtagataacagcaatacatacatatttcattaataactttaacctcggttttttatattttaggatagtttccttataaaagaaggaattattaatcagttagccaaacatattaatgtcttaaatatccttagctttaaaaaagaagaatgaaagggaagatatctttggttaaacaacagcaaaaacagcgtatttgggagaatagcttcccttatgtagttctagccttgatttgtctagtcttccaatctccagttaatgttagtgtcagtatatcctttttgacattgttaagatactggaatgtctcttttttctatagaatatatgtacataggtgaaattatgtaaagagcaacttacaacttgagaatgaagaatttgatgcatagatgttagcatcaaaagagattcttatttgaaaatagttatctcggatgcactaaactttcacataaaatttgaatgtagattataaaatgttagtaatagaaggaatcttaggaatcatttttacagataagaaaatgaaagggcagaactcagatcgtctgacccctgacccagtgatctttttattgtcacacatatgttgaaaaataatgtatttttatttttaaaatgcattattttatgcagctagaagcagggagggtaaaggcagaaaaaacaaaatgcaaatgttataacacggctgaaaagccaaatgatatgacactttatttacttctgttaataaaatatttccataatatctcctataaaaatcaccaagaagacagttgtatttcattataagataaagtcaagcttattgggaaataatgaattttaatgctgaatacattataataataaagtagaactatagcaattaagaaaagagacagattggacatgccttaggaatactgtttttttctaaagcgagtcttcttaggaacatttaataacatctcatagagaacaactcacattttggtgtgaaccaaattgtatgtgaatacaaagaacagcattgactgtctttcgttttcttgaaataacgaccttatttttcttctattttgcttatatttttcacttagttttcatcagtggttttatatttggtttcatctttggctttgttctaaacagttgtcagttttctgaaaaaaaaacaagaaatcttgatgggtttttttgcccctcagtattattttattgattttgtctgattctttgtctttctctttaagcaaaatcaccaaaaagtatctgtgtatgctatgtttcttctgtgttcattttacggtaatggtttctttctwtttccacacttatgatattgtgtcattttctgcctgaattctggctttcgggtaaataaaaatcaaactttgacttgatattaataattacaacctgactactcttgtgcattgggccaaattctttccgttttctgtcaactacayatatttataaagttcccaaattcacagattccagtctaaatgctcctgtttagattgatgattcattaaatcaggttctgttgtttaaatgaaaaattgggtgcttcatcagttttttataataataatttatcagatgtattcacattatgggttatgtaatttatctattgctggctcttaaactttttaaatctgtggatcactaacttgagcattaagatcctccatcttttcccattcagtactagaaatagtttattttgataataataaaatttttctggaatagtatttattaatcttcattcactaaatagaagctttgtacatacaaaccacttagtctcatacaccagtgcttagacagtcattgacataaaaagaacatatgatttcataagccaatctcattattttattatacattatacataaaggatcctttatatcacattgtatgtaggtaaatggtattttatacctttatagatgttctatacatttttttaaaattgttcctttgaattgaaaagcttcttacatttataggtataacactatcacatgtaaatgattattagacacatcattgattagtaaatatacaaacacaacttaaaatcttcctttgaaaagtttattttcattggcttgaatgaaatatatgtaaatgtgattttctttatgttcacattcttactgatcaacatttagagaaattatcttaaagttttaagaatattcatctattatacattttagaattaaaactgtttttgtgtcccccacacacccactcatactgttcatatttgattaatttcataatgaacttatttaatttctattcttaatgatctactctgtataaatagacttgatttttgtactctatttgaattttattctttaattcccagatctttgagaaaataaatatgaatatttatattaaccatgttccagttaaagaacatccttgggaaatcactgagataaacactatattacaaaggttaggcatatttatggagatcattatcaactgccttgaaaatactatgaaataattttaaatttctgttaaaaaatgaaaatcctgaaatatatcatatgtttgatctttttcgtttaattttttttttttttttttttttttttttttttgacggatcctccctctgtcacccaggctggagtgcagtggcatgatctcggctcactgcaacttctgcctcccggcttcaagcaattctcctgcctcagcctcccgagtagctgggactacaggctcccgccaccacgcccggctaatttttttttatttttagtagagacggggtttcactatgttagccaggatggcctcgatctcctgacctcgtgatccacccacctcagcctcccaaagtgctgggattacagacatgagccaccatgctcggcctcgtttaatttttttaagagaggtggaggtcttgttatattggccaggctggtctcaaattcctggtctcaagcgatcctcccgcctcagtatcccaaagtgctgggaatacaggctcattcatcatgcccaaccccatatgttcgatctttaagacagatctttttcttgtttcatttaaaattaaatcatgttaaagttcaaaccaagcctaaacagtgccttgaaatcaatcaaacaatactattgggacaagacatagtatattctgtttctgtctttaatgccctttcagagcctgtttcctgaacccctgtccattcagagtcattctgtgcaattcctcagagctctgtgggagaagacccaggcagggggtgctcacagctttgaaactgccatgatggagtccacgtttccacagcagaaggtaaatattcctttccttggccatgttacaggccaagatttaagattgtcttgaaacagtttcccttttttttagcaattaaatttcatccttctttcgtttacctttcttttattattatcataaaacacttgtaagaaattattttcacgtggtatagtagattcagaatagagtggtaccagtaaacaaggacattgccctttgaggtctgtatactgacacaatacagtttcctagaaccacacaataactgcatgcatagtatgaaatagaaaagattttacagctgggtgtggtgacttttatctgtaatcccagctactcaggaggttgaggcaggaggataatatgaggccagtagttccagattagcctgaacatcatggcaagactccatcttaaaaaaaaaatgttggccgggcacggtggctcaygcctgtaatcccagcactttgggaggccgaggcgggcggatcacgaggtcaggagatcgagagcatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccatctcaaaaaaaaaaaaaaaaaaaaaatgtttttttttaattagccaggcatagtagcacatgcctgtagttccactactccttgatcttggtcttcctagctccagaactataaaaaataagtttccattatttataaattacccagtctcaggtatttgttatagaagcacagtgactaagaaagaaggcttgaactaaagttagaagttataggaagattggagagctattaagaaagtcaaatcaacaggactgacagcctgataagaaaaatagaagaatccaggatgactccaggtgcattgtttggctaactggatgataatatcactctgaaaatgagaaatcacaaaataatctgatggagcagaagaagataaagcattctggtttacatatttcaaatccaagctgtttatatggctaactaggtggtggtggtggtggttaaataccaatgtgggcttcaggaagaaagccatgactggagatatggatttgggagtcacaagctagcacttactgtcatggcagaagactggattgctcaagggaaatatgtacattgagagaaaagaatggttattaatctcttctagtaaatattatcagcttctctcttttagcccttcccaaactcgaatattctgattattcttattttgccttttagatagcccagtaataagtattggatgcttactgagcaaaccagatgttctgagaataaatgatcatggtgtctgtccttgttttactgttgaaaagggagacaagcatgccaatattaaacaaattcataatacaaatgagtagcaaattaagtactccagaactggtctcttgtgaaactaacataatatttttaaatgatgaagaattctaataatatgaaaaatgagcatgatttatcagaagtttatttgtaatgctctgtaagacactaaagacatatgaaacgattgcatcactactttttggcttgtgtttaggaattcaacatgcagtattaaaaataaaggaaatgccacaattgcctcagtgtagagtaaaatggaattctttgtacatttcattcaaattttcaactgttgcatcatatttgaagacaatgcctcaagttctcataaattttttattgctaactgtattttaactagaggcaaccagtaaattaaaacctggcaggctrcttcaaatcctaagagattaaaaaaaaatacttggcaaactagttttgtgcatactcacaagtatacttattcacatttcttgtgtttcatgctaataaacatttctctaagggaaaattaactgtaaacaaaatataaaattttttaaagttttataatttggtttgttcatgagtaatagaaaaaactttgatatctgcaatgtacattatgtggcaaatttatctgcccaagtatttctcaagtagattttttccgatttttttgaaatgttctctgtactaaattcaaaatagctgtaagaatggtgcaaagtctgctttattttcataataggtgccatatagacatacattagtgatttgaaagagatggccatgtgtgtatcggctgcagtgacggagtttcactgcagcgaaatgcacacaagaaagaaggaagaaactcctaatgcctgagtatctagaatataacattctggacaatatgaagagaagtttgttattgtggttgctttttaatagaatcttggaattttagaactaaaaattatcagtgagatatctattaaattgcaaactgcttgagggcagggattttgctgtattgaccattgtgttgccagagctacaaggtgcttggcacacactaggctctstaaataatacatatcaattgaagaagtttaaaaattctatcattttctggatgttaaaatcggaagcaaaggaacttgttgaaggtcagtggcggaactagaactgatacacatacccttgcgatatcagggttgtcacaaatgaatccggtacttccctcctctgggcccaggagaggatcacatttccctgtctactgaagcaaggctggccatgtgacttgcttcagccaatgaaatatgggaggggatatgtgtcactccaagaggaatcttttaaaagccagtgtactattctctgcaatttctcttttcctctaccatgatgatgatgattgtaggagcaaaagttgaaattgagttgccagaagatgaaaacagcctggaattctgagccaccacatggagggcttctgctctagagagccacccagtcccaccacacrttttgtatgagaaagaaacatctgttgttttgttagaaactgaaattttggtgttagttatagcagcgtaacctgcctttcttgattcatacacctatcagagtagttaagcatgttggctctgaatcacctggctttaagatctgctgtgctccttaccagctgtgtgtcctttgtctctgtgccccagtttctttacttgtacagtggagataatattagtacctacctcatagcactgttttgagacttgaatgagttaatacagagctctcagaacagtggccacacattgtgatctctaaataaatgttagctaatattctaatccctagccagcaccccacctcaaataacacaaattcaaacccgtcttacatacattaagggaggttgagagtggaggtaggaagatgaacctgattgataatctctcaagttattgtacttttctactttgatcagaccaacattaccagaaacgttttccaaatttcaatcatgaattttcattataaaattcaatcaaattcagccaggtgcagtaaattcagccaggtacagtcatgcctgtaatcctagcactttgggaggctgaggcaggcggatcacctgaggtcaggagttcaagaccagtctagtcaacatggggaaaccccgtctctactaaaaatacaaatattagccaggcatggtggtgccttcctgtaatcccaactactcgggaggctgaggcagaagaattgctggaacccaggaggtggagattgcagtgagccaagatcccgccactgcactccagcctgggaaacagagtgagactctgtctcaaaaataaataaataaaataaaataataaataaataaattcaatcaattatcttttgcaaactatatatcaatctcacacaggcatcaaaatgtggaaatgcttatgtaatataatgctaaaatatttttaatatataaaaataaaagtttaatattagtgaacttagtaaaatgcatgaattcaatagttcaaatttttaaaaattatcacttaaatgacatttgataaaatccaacaatcactttactaacacacattttgtataaaaattttattaatgtctgtgtcactaattagactgggtttccatgagaacatatgcttgtcattgtacacccagcacctagagcatcgcctggcttactgttgacactcagtgatatgtgttcactgaacaaagtgagtgagcactattactaactagaaatggaaagatgtgttcttagcatgataaatatttgtctgataacaaaagaaaaactatgcctagtggtgaacaactgaagattttttattaaaatactgaaataaaaccagaatatccactataatctttataatttagtattgcttgaaagcatgagccaacatgagaatataagctccatgagagcagggatcttgtctccttgtttgttacagaatccaggatatctaaagagcatgcctggctcatactaggcattaataataataataataataacaacaacaacaaatagaacacaagacagaaataaggagtatactatttgaaataagaagataaattcaacattacttttagttaatatgaaaatacaaggaacactattagaattaataataataattaactttactggtcatttagaatgtgccactaattgtcctgttcatttaacatcaattagttcacttaatcccaatgacaacactatgagatagacagcattattattatcatcttacaaatgagtaaactaagtagaagaaagattaattttctcaaagtcacagagcaatggagagaaatacacttgaatgaacagtgatattaccacgttcctgattggaaatagcaaatatgacaaaaatgttaatacttcctaagttaattagcactttaactgagttccaatttaaattctaagagaattattttttatctcttatgaagtgatggtaaaatacagccagaaggataaataggtgagactagtttgaaaatttttgagaggggcaaaaaaaaggacattccaaaacatttaagcacactataaaacctacaattattaaattactccacttttatggaaagaattaatgcagataaatggaacagactagtccagaaaccaactcaaatatatacatataatcagttaatgtatatatacaattgtttagctacgtatgaaacgaatcctttttaaaaagcctacataaaagagaatgatatcaaaaccctagagctaattttgtacatacagaaaaaatgtaaaggtgtttgctataattagaaattaaacaaggatacctgtcatcaccttcaaaatttagcattttacagtgatcctacccaatgcagggagacaaaagcagttaagtataaggattaaaagaataaaccagaaagagaaagagatagagatgagagggaggatgagggaaagagaaattatttatagacaataagattatttgtgtggaaagttcaaaagaatctaacctttagaacttatayaaaagatccataaagttatttgatataagatcaacatataaaatcaataacaaatctatacgtgagtaataactaaatagaaaatgtagaaaagcatgccatctataatagcagtaaagactataaaggacctaggaataaatataagaaaagctgtgaaactctttaatgataaaaaattttttaatattaatgaaaaaaattttaaagacctgaattaatgaaaagatatgatcttttcatggtcaagaacaaccattatcatataaatgaaaattttctcccaaattaaaatgtaattacaatttcataaccaatcctaatgacaacagacttttctcatggagtttgacaaactggtcctaaatttagaataaacaaaatcctaagaaagactgtgggggaggaaatttttatggtacagaaagagaaaactcatgtgattatttccacagggataaattaatggtaaataataaagagcccagaaacagtcccaatcatatatgaaagcttggtaggtgatagaagggggattacaaatcagcgaagagaaagtaaaatatgttttaaataatgtaaggacatgtaacttttccaagctgaaaagataaaagtagatccttcacagacaccatatagatcaattaactccacataaattaaaggcttaaatgtaatcaatgaaatcttataacaattagaagaaaatatcgaaagttatctttatagctccaggataagaaaaatgtgacaatacaagtcttggcaaagatgtgaaaaagtgggaatgttcacacactcttgatggaaggaaaataggtatacctgtttagaaaaaagaacacttaagaacatatatatatatatagtcattaattagactcaaaaatgacagctagattactgttaagatgggtgagtaactttatttctgaagtcttaattccatttaaagctgatcataaaaatgcttaaatacaagaaggtttttgtattacagtatataaaatgtgctaatactactcagctattaaaaagaacaaaataatgtcttttgcagcaacttggctggagcaggaggccattattctaagtgaagtaagtcagaaataaaaaaccaaatactgtattttctcacttgtaagtgggagctaagctatgagtatgtaaaggcgtacagagtggtataatggatattggagacttggaagctaaaaaactacatattgggtacagtgtacattatttagatgaagggtgcactaaaatctcagacttcattcatccatgtaaccaaaacccacaaattttcattttcagacttcttaaagagcaatctgctctttataatataatcagtggttatattataatttcatgtgccctatttttctgcagttctatttctagatgaactcttacatatgtgcatcagaaaacatgtacagaaatactaactgaagcattttttgcagcaaaaaatcaggagcaacccaaatgtcccttgatagaggaatgtggaaaaaaaacgttgtggtatagtcatgttatacaggcaggtaaagtgaattaattagacctatatgtaatagcatgggataaatcttgaaaatatgatattgagttttaataagcaagttgcaaaactatgatatgaatactatgatagcataaatgttattgtataaatttttaaaacacaccaagcagtgttatgcattatttatacatacatatacttatgataaaaatacactatatttagaattatacaaaattcatgatgaggttgcctttgggtaaggagaaagtgaggaaaggaaggaggaaaatgttaccggggaagggaattaaggagatctcaatttcatctgtaattttattgttaaataaccagaagcaaaatattagcatttgttaagtctggctggcaggtacatgggtatttgttaaagtgtcttttgtagatgcttttctgtctttgttttttaaatttaatttaacctgtaactaatgtcaaagagtaaagaattggtaggtttgactacataaaatataaagtctgtaaagagcaaaaccttttatgcacaataattttaaatgaaaatatttgtaacaagcatgaaaaacaaagtttaatatccttaagctactactataagttcatgaaaatcaataatcaatgaacgaagaacatgagcaaatacttaggagactgagtccgtaaaagatattcagccttattagtaggcaaagtagtcaaagttaaaataagttaccctttttaacacattttttaaaatacaataatcagtgctggcttgagcaagagttaaggcactcacacgtttctaagttgaagtgtaaattatttcaacatttctaaaaagcaatttagcaatgcagttcaagagtcttaaaaatattcatatcctttcacacagtgattccacttctaagaatctgttctaaagaagtaatctgaaacatgtacaaaacttaagataaacaaacacaaaaagtattgcagagggatttataaatagcctaaatgtctaaagataggagaatgaaattattatacaaccatataaaagaatattttttgtaggtctagtcctgaatccaggtaaaagaatatttttaagacagatagaggccgggcgcggtggctcacgcctgtaatcccagcactttgggaggccgaggcgggcggatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagacagatagatagatgaaatagagagataggaagatagatagatagatagatagatagatagatagatagatagatagatagatataacaatacacagtgagagacaactatttcctggctctctctgctgagagaacaaaaaatattaaccaatcctgaaaagtcatgtttatgagacatgtttaatgatatgaaacacacttacagtaaataccatatttcagggtacaaaattacttttataaagaatattatttggaggattgcccattaaatcaaccaaaaggaaatataataaaatgttaatgatatagctctagttgatgggattagcattttcttttctctatatatttcttttataatcaaggaaaaaatattactttaagttatattgccttatgtaaatgagcagtttacttgaagaaaaatagattctaagataattaatttccattataaaataaggattttagaaagatggtggagaagcagttgatttattgaagaaatgagaaagaccaccatggagcaagtagagattactattaataatttcgtttcagtgcatgtgctacccaacacttcagagggaatggcactctgattatcagaggaccagagagttgacaaagttgattgaaggattactaaagggccagaatttcagaaagaaaaggcctttattaacacgtgttccagttaccaaagcatagggaaatgttgtatgctgcagaaatgggatctcaaaactatgtcccttacagaaaaaataaaataaaataaactacattttctgctgaagtaaaatgtgccccatctggctaacatttggtgatttgttttcagtccacattgctacaaacacacttgatagttcccaggataactgacaggagtgtcaaggcataaataaaactgaaacactaattctgggtggaacccaaggagactttctgatgctcccacaggcttagatctagtgttttgggttaaagtgttaatgtgcttgagtatataaatgcataagtaagtaaataaaaggtaggcctattatatataagatgtaacagtatgtgtgtgtatatatatatatatatatatatatatatatataaaaaatataagatgagaaatttaagtctacatgtgtgatagaaatgacaagtgctgtggaaggtcagtctccagaagagccgtatgaatatatgttcaagagaaccttcctttcagggcaagctagaggggaaaggggtttggaatttcagaaccccagtgggggcggaggattctaggctttcaggctatgagctcagaaccaggaaaatctgacaggcagtttctaagtggcaatggtgaggtaaaaagataaacagaaaatgtgaatgagagtctaccctaagaagccagaccaaggggctaatccagtgcttaaggggaaaactaaatgaagactgcaaatcatggaaggacctggagggcagattgaaggtggaatgtggatgcagaggcaaatgtctgggacactctttgctcaggcagggagctggctggaaagtggtagaaattgaaatacagagttcggaggcttttttatctttaaagagaaaaatggttccatatagaaagaatggcatgagaaataacacggaggagacaaaataatcacagcaaaatcatggtaaatatgactctaagttcatgtattcagtcaaaawtattttttgcaaatgcctgctctataccaaccactgtgcagagactaaacaaacaatcatgatccctaccctgatggaaacaagcaatacactaagaaacaaatacacaattccacactgatagatactgtaaaagataatgcttaaagaaaatgagcatttgttggatggtcaaggaagccttctctgagcagatgtcagacaagttttcctggcaatgagaacaatttgcacaaakgccttgaaacaaaaaaacaaaaacaaaaaaggaagaataagagaaaggaaaagctttggtgtattagagcattctcttcaaatgtaagtcacacatctcatcaaaaaatttttttgagcaagtaccttcaatatgtgcacatttatttacctttaaactatatacatacattattttacatacttgttatttcactataaaacattgaaaaatagaaattttaaaggacgagatgaaaaataaatagaaatgaaagttatattttcttcctcctgtatcacagtggatggtcacacctacccaaaagtgagcacactcccctttcacagcattggtggagccagtgaacaaaggggagagtggagactggagagttaatctggggaattctgtcctggccttttagaccatggcaagaagcttagatttttttgtggtctatggaaagccacggaggagttttgagcagcagtccttagttcagtttctttgtccatttgggctgctataacaaaatactattaactgggtgcttataaacaacaaaaatgtttcttacagttctggaggctgggaagcccgagatcaaggcagattcagtgtctagtgcgggcccactttctggcttacagatgtcacccaaatgctgtgtcctcacgtggttgaagggacaagtgatctctcctgggcttctttaataaggcactaatcccgtttatgaggactccatccccaagacttaatacctcccaaaggcctcccctcccaatggtatcaccttgggggataggatttcggtgtatgaatttggtgatggtagggggacataagccttcagtccattgcaaccaggttgtttttaaaagattgctcagtctgctgtgtggggactagattggaaagggacaaaagtaaaattaaggagatcacaaaagagactattgctaatccaggtaagagaagagagtagcttaaacttggatgatcctggtagggatggaaataaatgacatattcaatataacggttggaggtaaaagtgacataacaaactaatgaatggcatgtaagtgtgaggggaaatgaggaatcaaagctgatgtcaagtttctggcatggtggtatcatttattaaggtggataaaactgggagaaaatgagctctggggaggggcaagtgaatgaagctggcacacaagactttcagacatccgaatctgaagtttcaaacacctgccagatgtcccagtggaattgtcttttagacagttggatatccaaatatgaagtgacttaggccaggaatatagattaggacatcatcagcatacagatgatgaaaaccatgggaagactgaagcaatctaggaagagagtttagagaggaaatggtcccagttcaggattgcatccacacggcagccaagaaataaaagaacctcmgaaagtgtagagggcatcacagataycaagaaagtgtccaagaaggagaaagaaaggaattgtatgggactggatagccaaatcaagataagtgtccattcaactgggcaacatggaaagagcagttttaatagagttttaagggcaaggtacgaacagaagtaggtggaggaacaagaaggaacgagtaaagaaggaaacatagcatatgtagagagctgttttaagcagtttggtgctgaatgggttggtaagtggggggattgtagagatgagtgaaaatggaagccttcagagcctgtttgtaaattgccgggatgatgcaatagagaggttgagattgatgaaacaggcccaggaaaaaacaaaacaaaacaaaaaaaggttatttcctgagtgaagaaaatgatggatttgtgctgagtttmtctttataagaaccctctgcttctcctcatagccccaatacacactctactcttcgccttcaaaaaacagaacaagtacacccaccaagcaactggccaaggttaggacaatagccactagggcaagatgaagttaactgaccacggctatgtttacagcatgctccgtggataaggcttgcaatgctagataacaccgggagaattttcagcttaagcaaaagatggatttttatcacagtttatgtagtatcagtagactcacactcctccaccagagccacgatagttcatccgggattaatatggctaacataagaggagaggttcacatgtgaagagttcttgagagaagtggcatggcttttcacaagcatgacttttattgatgccttaggaccactgagtttggaagttcagccaaattctaaactttgcctccctaaatactatttctaccttcatttggattcatttcttttccttaacagatatacatgagggcccctcatttaaacaattctgtacacacaatccattatattaagtgattgcatatgattttgtaaatacattgaacttaactgacagttctatttactattaagaaacatttattttcattgtaatacacttgtctgttgttttttactctttctttttaatcctcttatctcctttagaaaattattacctttactcttggctaattaatatacactattcgtaactctctaaccactgtccacatacactgtacttatactatacatatgcttttttaacaaatttaaattggcatagaaatgttttctcagtttagttgaaatcctggtttatcacatgtattatatttctttcatatttcacaagccagactgtcctataatgaagcatgtcaattttactactgtcgtgaacattccttcacagttagccagatgttctgcatcagtcaaggaaattttttaaaaaaaggaaaaacctttagaaaatagttaacgaaataactctattcctgggggaacagaggtatgcaatccctctgcaatgtctgttctaatctaatagtggttgggttcttttcttaaataatcagtgcatgagtaaaatcctttttttttcttttgctgctatcatggatattatgtgaatgccaacaaacaccaggcactatactattagaataaatagcacctctttttgtgcaagaagaaagtgtggtaactagaaactcaggatctgggtttgaatcctgcctctaccacctacttaccagcgcttttatctaactcctgtgtgccttaccttctttacctgcaaagtgcagaaaatagcagtaaacacttcgcagggatgtcgtgagattcaaaagacataatacatgtaaagtccatggagcagtgattgccatatagtaagagctcartaaacagtagctggtactattttattgcacctcctctgcaagacccctccaaacaaaatgaatgactccctcagccatattcccataatctttcacaaatgtaaataaagacatcaacaacaacaaaattgtttgattttgatgtctttgtgcctctcataggctgtgggatcaggctctttccattaatgtctgcatgtcccagcatctatcatggcatcatggcctgaggcagagcagctactcagtaaatgttttgagactttatattctcagtcatgataaaggtttctttctttctttctttttttttttttttttttttgagacagggcctcactctattgcccaggttggactgcagtagcacaatgatgtctcactgcagcctcgacctcccaggctcaatcaatcctcttacctcagcctccctagtagttggcactacaggcgcccaacaccacacctggctaatttttgtatttttttgtagaggcagggtttcatcatgttgcccaggctggtctcaaactcctggactcaagtgatccacccacctcagctgcccaaaggtctgggattgtatgtgcgagccactgcgtttggccatgtttcattttttgagaatgatttttattttcacaaatagcccaacatttatctgagcccatgtgtactataaaaagagactgctcaaactgaataataaatttccatgttagaagctaagtttcactaaagtaatgarcattattttcttgtatggctcacaaatatacaccacaaacaactccaaaagacacatctaaaaaggttttgagcagaggctgtatcactaaaatgcgagtagtcatgcacacttaayactatttcaaaatataaattctggtttcgaccttaaaaatcatagcaatttagatatctcaatactagacataccaagaaagagaacagtcagtgccactatcagcttttawttttagaatcctgaaagttgcatgtggattggaaaaatgttggttgtagggacatattaccctttcccccttagggattccatgaatatggagtaatttctatgttttttttaattcagtaaaaaaaactatttcctagaatctaattatgttccatgtattattatatttttatccttcattcaatataatttttggtttgatgcctcatttctgggtctggtaatttcttctgccaacagacagtctactttgtagccaacccaaagtcctcatgctgcatgcaatctcctttctttatggtctttcactaggactgagagtagccttagaccaccacacactctagtgctagtttcatggagtagttctcagacctagtttatgcaagtgtccttggggcgcttgttaaaaatgcaaattcttagggcctctgcagattttgcaaataatattcactgggtaatcctgtgactctagatctttgacaagttatcctggtagttctggggcaggaggtcccacagcctcttctgataaaacatcaaaacagaggcaaaggcaactgagatccagctgacttagtttgagtgacatcactaccacagacatgctctgggaactgggcaagtcattaacctcactacagcttgatttcttcatctataactaggaaagaatccacctccctcatagggttgttaagaaggtaaaatgagatgatgcatttaattcaacacctagcagagcacctggaacagagtaagtgcagctataaaactattatttcataaactgcaaggctggcaccaaatcacctgtttagtcttcccttttctgtgtgtagatatctttgtrgttctgccctgaatttttttcaatttttggcctcctcagtaagaactgagtgccatggtctatgtctgatcagggccygggtacctcattatcatcctgtgtgtgtgtctaattattccctgaatggacacacttcattgcacctttttatttcagcctcattagagtgctccattggcccaccttgttatttcccgtctcttcactaatgtcccttttttctgcacctcctttcagtcttcacatcttcttatgcctatttctttcttcrtcgtattaaatccctccttttatgcttgtcattattccctcctttctacacaactcattacacccctccatctgtgaactgccttatgccatcccatttctatctcatcacatcctcatcatgcacatattagctcctccattcatgcttagtactgcattctttctctctgcttcttatctaccacaacctgccctttccaccctcccatttaatgctcccatttgtaaatcacattacaccccccatgtctttatcattacactcatctatttatgcatctcattgcaccattacccatgcacatttttctatgcttttctatttgtacatcacattatggcctcatcaagcatgcacatgtcattattcccctctgaaatgttcatgtccacgtcgcattacatctctttatgtttgcatctcattaaatccagcgctcctaggtttgacaacaaactaacaaaaacagacaggtaagtatgttacctgattttagaaaactaaatatgtttctcaggcacctagcattagtgtttcttaaagaagtcattcatttcagaaagatttacatacatttatctagctgagagacaaaaaacactatattttacayacataaaaaggagcttcttattttgcttgatttgaattatcatcatcactgcttttttttgagatggggtctcactatgttgcccaggctggtctcaaaattcctgagctcaagcaatctgcccacctcagcctcccaatatgctgggattacaggtgcaagccactgtgcttggccattatcactactttttattatttctccacagtttacaaagtagtgcaattatccattaattgattgtggcaaaaagtcactgaaagagacaggttaggaatcaaagtcattttatagtttgaggagtgcattaaaagcaaagagaaattaaaatattttcccaagaactgccagtgaatggcagtggcagggctcaaactctgatcttctgactccaaaatctatattcttcattctgtaccactcagcagaaaaacttttatttctaagtatcctctctgtcacttagcctatgctgtaataattctctaagacagaacttggtgtcagcatgctttgttttgtttggttttctgaaacaaaatagaacatatttcaaacacttagtactttagacctgtttatctccaagtttgaagagctaaaagttaaaagaaactgtaacatggagccttctaacaagagaaaggagaaagactttcaccaccaaggtcagtctcaacacaggcaaaagaaggagactcctctacagggagtttgaggggtaccaaggaagcccacacacgcatacacacgcagaacctttcttcctcacagagtctgacccttgctagtctctttgcttcactaaactgtgttctctgcctcatttttatttttcatcaaattatgaaatagctcataaattcagaaaagtacagaaatgtgatatccattcctgccacagatagatgtttacatttcttccatatttgcatcagatatctccctttacaaaaagaaactgttgtaaatattctcctgaggttgttgtgtattatttccatgaatgcttttgtactgttgttttaaacttttacctaaatgttatcagatggcacatatcttttgcaatgtgatttctgcacttaatgttatgttttttaaatatatctgttcatacatgtagagctagctcgttcatttcagcatctataaaattttccactgtgtaaatagaccataatttatttatttatttatttwtttttgagatggagtctcactctgttgcccaggctagagtgcagtgacctaatcttggctcactgcaacgtctgcctcccaggttcaagcgattctccagcctcagcctcctgggtagctgggacgacaggcctgtgccatcacatcsagctaatttttaaatatttagtagagatggggtttcaccatgttggccaggctggtctccaactcctgagctcaagtgatccgcctgcctcagcctcccaacatgctgggattacaggcatgagccactgtgcctgaccaaccgtagtttactttatccagttctctactgaggggtggttcaactttcttaaaactgcctccaacactattacttcaccagtgcttagctctctgctgtgtgaagtgactaaatggagacatttaaaattccagcatcatgggaagtaataccttctctctaagtccatagtagagtcagttttatttcctctgtaactatacaaagtagtaaacatgtcaacaaaatgataattcttttttttttttaattttttcaagacagggtcttgctctgttgcccagaatggagtgcagtggtgccatcatagctcactgcctccacgaactcctgggtttaagtgatccttctacctcagcctcctgggtagcttgaatagcaagttggcagaacctagtgaaattgaggatatgaataatgttaaatttttaatgtatcatgcaaacaaggtttctgggggcatcacagattactattatttacttagcaacaaataacctcctaagtttccttttgcctcagttgttagccctggggcaacatgatgagaaccagatgtcatcttacacatcctagggtctgtactgtaggcaaggaaccttgacaatgtgaatttgagtatttacatagggggtggaacagctgtccctgaaaggagagaacaaaaatctttgctcattgggaaggggtctgggttcttacttttaccctttagaatgtaaataaacccctccaggttgaagggaagactaatgtctccagcttgacaacccaagctcctatatcctgggtctcatccccatcttaaaatgtaaacatacctctgggaaaataaatctctctagatggtatttcactttctaattagtcataaatttacttctaaagcttgtttttttagcccaggtcccaagtttcagtaaaatttgttcaaaaagccctaactgtgcagaaacacaaaaatattttcacagccctaaactaatacactatgacacagcaattccactcctgagtgattatcacagaaaaatttttgctcacatccacaagggaacacgtgtaagaatattcatcattacatcattgtgtaagttcagagatgggggcacccttggtgcccacactaaggaaatggttaggtgaaatgttgggggtggtggatgcacaccattaaatcactgtgcagctgtagaggcaacagttagctaaatatgcatagaataccacatagagatcttgagtgaaacaaacaagaaaccaaatagggttcacagcataccattatttgcaaaaatgaaaaataaacattgctaygtwtttttcaagaatacgtatctgttccaagacatgtgtcaaacccaaaaggygaatacttataaaaaggggaagttggagaaacagtctgagaattaaagtggtattagggataaaggaaaaaaaataaaattatgagaatgagagaagcaccttggctccaactaaataacctacatggttaggagcatggttttcctgctatctgatttcaaaaggaaggaaaaaaagcctctccaaattagctstttaacatcagcattctctgtagtatagtaccacaaatagatttaacaagtagtactaaatatttgttgaatgtaggtggcagtaatcaattagaaaaaaaaatcactgcaattctttgctttgcactatgaaaggagaatatgtaagtgctggctataattgccaaaagttctgtgattacattttactgctgaaccactgtaaaaatcttaaagttttcttgaccttttgaacattggtagtgttttggccttgctcccactctaataatttgctggttttaatgaactgaagtttcaaagaaattgtatttgtaaaaaagataattgtggttttatcaaacatttataaaacttgttatatagcttcatgcaatttgccacctttattttctactcaactcatacacttccattaaatttttcacaaactgttttacttaaactcttgtcatgttaactgccaatatcctgtagtcagattattttttcatgatttttagatgagtgtgattttggtgaatttggcttttttttattttgtcatatttgttcttaaattaaagtattcttcagagcttctctctgaaatgaatcaaacatagtgttttcttccagccacttggagccagacacatagaattgccatgattttccaagaagaaattcagttcttcccaacacatagggactcaaaggatagaagtataagtttatttagtgatatgtagtgatagtgaggagtttgccacattggcctcatatagtcatgtgtacctcgagttcccttactaattaggcatagaaatatgagagccaatgggacatagcacatgcatggcattcatgcagaatactgaaatgcactatgagtccttccacatcagtgccctgctgcctctgcttagagtctgctcccccatggcctacctccctctccacccactccagccttytgccaagtttcaaattgggcccaatgagttcaattttcacacctgatctcttcttgccgtattgcacaatttggaataataacatctctgatgtttaaaaatgaaagctttgctcttgtgaccagtctacctgttttgtcatatgaaatgaaacttttttcttttttcttttttttttttttttgaggtggagttttgctcttgttgcccagactggagtgcaatggtgcgatctcagctcaccgcaacctccgcctcctgggctcaagcgattctcctgcctcagcctcccaagtagctggcattacaggcacttgccaccgtgcctggctaatttttttttttttttttttttttagtagagagggggtttcatcatctggtcttgaactcctgaccttgtgatccacccacctccgcctcccaaagtgctgggattacaggcatgagccactgcacccggcctcttttttctttttttaggtctcactctgttgcccagactgcagtgcagtggtgagatctcagctcactgcaacctctgcctcccacattcaaacaattcttgtgcctcagcctcccaagtagctaygatgataggtgcctgccaccacgcccagctaatttttgtatttttagtagaaacgaggtttcaccgggctggccaggctggtctccaactcctgacctcaagtgatctacccaccttggcctctcaaagtgctgggattacaggtttgagccaccatacctgaccccttgaaaccaaactattgtggaaaagaatgagcatatgcacatggagattgacaaattcctcaaataccaatcagtggacacaaatcagccatccccacaactgctttgaargacataggattaattttacagtcagggcacaccagagcaactcggggagcttgtgtaaaaatgtagatggcgtgcagtggctcaggacttctaatcacagcactctgggaggctgaggtggaaagattgtttgagcccaagcatctragactagcctgggcaacatagcgagaactctgaacagacgatctgaaaaagctgagggtcttgagaacaagtagtcaacatactatattgatgaattaagacaaayatcattgttcaattattaacactttattctaaaaacttgttaaataaaatgaatttttgtaatacccatagatatgcagatatatagagatagatatatakagagagagatagatttttttaacaaatgtagtctggaaagtcttaatggtcatagttgaatagacatgaacactgaaaacctaaatgctactgttgatataaattagagataagatctatgtgcttcaattagtaaaaatgcataataattcattgaacatttactatgggcaaagtgccatactaagtatttttaaaagctrcaaaacaatatggaagtcagtcttcatggtaagagctttaatccagttgagagccaaaacatcacaccagaagaagcttagtaacaatcacacctcacacaaatgaagctgtattcagtttcctctgtgaagaatactgcagacacaatgaattaccttctcacctccttggactgatgactatgtctctttcatctctttatccatggttcctgataccaggtgctatgaatactgtgttacataaattgaatccaatagtaatatttttcacaagttgaaaaacataaaaaaattgtggcatggatattctttaaagtctcttttgctgtttatttattcaacaaacagcatttcctactagacactatgcctataacaatttaagacaatatgaagatcaatcattaattatattccctaagyaagcttatttcacaccttgtactccatatcattagagtatgtgcactgaaaataactatacaaacataaacttattattatgtgaaaatatttgggaatttttaaaaatacttgcttacatgtcttaaaacatacttgaaatatgtgcctagagtgatcctattaaccacaggcacacagtgcacataargcaatcctatgttttgtatctgtgcacaaatagctttaggacagaatttaaatgtgccaaaacccaaagttcttccagatgtatgctttcactgatttctggaaaattgcttcacagtaccctctcaaagtacatagaccacattataaaatccagaggccactatgcacttttacaaaatccattgcgttgactcatgctgtcatttgtcagtgaaatgatgttgtaaatctctcatctttctatgctgcctggcttagacttattatagagttttccaaattcctaccctcattaatgactctttttctaaaacyggagaaatgctcacttagccaaatgtttaaaaatactattttttcctccagtgagttttaatcttcttgaattaaatgatgtttatcaggaaaacccttattagtgcatgcctactatgaatatgtatccttttttttacatcaatgaaaatagtttgaacttcaacattcttttgtgttttattttgtgtgtatatgttttattgaggcctgatttggagtgtacttgggagaatgtgactcctctaagtagaatcatcactttcatggagaattgggcaaaaggatgtcattttttcttcctcttcacggcacaatctcagtattagytttcaataatgcgtaacaaattagcacaaacctagcaacttaaaacaacacatacttattatctcacagtaccagagtgtcaggatttcagttgtaacttagctgggtcctccattcagggtctcacagggctacagtcaaggtattggctaggctgtgttttcatttggaggttcaaatgggtaggatctgctttcaaactcattctgtttgttggcaagaatcatttttttgcagttgtaggactgatgactttgaactcttactggctaccagctgaaggcctcctttaagatcctaaaagccacgcatagtccctgcagttcataatgtggcaatttggttccttcaagcacagcaggagggtctccctatgcatctgctagcaagacaggttgtgtgtgtgtgtgtgtgtgtgtgtgtgtgtgtgtgtgtgtgtgtttgtgtataataacaacggaattgatatcctatcccctttgacatattcttggccagaagcaattcataagtccttcccatacacagggaatgggagtatacaaacagatgaacaccacaaggtgaaaattactgggaggtcaccttagggtctgtctgccacaatcccattagaactgaaaaatactcagacagtgacttacagttagatataagttatttttatcacttttctggagtctagttatcttaaagaaagtttgtaattctctaaacaaatctatttttgttctcctgttagaaaaatagaagccatatagcaattcttgggcaagccctagggaagctgcaggacccagaagggtaaagaaggttgagtaggagagagaactactgacctcaagcacatttaagaggtcaaaattccaaaaatctaggtgtcactggttgttggtttgtgtttgcttgttttgtgatttattttgctttgatttttcacaaatattggaaactatatgtgtttcatctgtctttccattcgaagtgtgctattatcaccaacttcaaagttcatacaactaccgtggatatcctttagcacaacacctaaatcctctgaggaggtaagcctgcttttggcttcagaaattgaacgcaggaaggtagtttaccatctgtctgaaacgtttaaacttttttccaagacaaatgtggattatgcgcaacaaactgggaattttctggtctcagaacaggaaaaataaaggaacccttaagtattattttaagtactttgtttgctagtagtgtttgtggtgaatgaaaaattgatccttaattgtgtgggaaacagagaagtaatstgcatggcaatggccaagtacagacttcagagacttcacagttttgaaactgatacttatgaacatctgctttttccccataaattttaatatggattgtatcctttgaaactcacaaaattcccaggtgcttcttcagtctttatcttggaaaacatactttttwaaaaaaaagtctttttttccattgaacatattcaaaatcatttttgtcaaaacaatattcctagatatacagcacctattggaatgcctgagatacggtattaaaggttagcaacccaaaatgttgcagtcaccatgtcaaacctccaaaatgtccaaccccagaacacaagccataagagtcttaatagaggatgcggaaaagtatccatttctaggcccagggcatgccttttgttattacacaaatatttgtttagtgcttgctatgtgataggcactttcaggtgccaagtttatagcagccaacacaacagacaaaatatctgtcctcattgtgtttatgttccagggagtgtaaatgttctctttaaaaattccctttaactttttgtactatcttttatatagttcgttagtaaaaaactttgtgctgggtctacaaaccaatgctaatccattaatgatgctggactggactctgggggtattatgaaaaaaaaaaatatgtttctgttctcagtgaactgatagttggacatacttcttacctctgtcaagaaatttagaactgagaattaggagctttgggatgcaatcaggatagccacttgatcattctctatttagatcccttataagcagtgcaaacagtgcctacacgcctcagccttgaaaattctaagaactattcctatacagagagaagataagagtgtgtaggctaaaggaaaggaaataaaatcacagctcaacagagcacaaacatgttagttggctgggtacatgcaaggccaataagaacattaagtccctcttaggaggaggagccttttaagaatgcagtttctggtcatccatcctataccaaaggatacaagtcatttacataagaggaaagcctcaggaggacagtagagctatttaatttggttaggctaatagttttccatccatttacagtctaacagaacctctctgccctgccccttaaagaggaactcattrgcatggtgccacagggcacataaaacatgtgcagtcttcttggagtgtcaattctactcaaccacttggaggaaaaaagttaactaatttaytggtaaataattcaatgcattattttccattaaaaccaatgcaggccatgcacggtggctcatgcctgcaatcccagccttttgggaggccaaggaaggtggatcacttgagatcaggagttggagaccagcctggccaacacggcataaccctgtctctactagatatacaaaaattagccaggtgtggtggcaggcacccgtaaacccagctgctcaggaggctgacacacgagaatcacttgaacccaggaggtgaaggttgcagtaagccaagatcacaccactgcactccaacctggacaacagagtgagactctatctcagtaaaaaaataaaagtaaaaattaaaaaaaaatcaatgtagcttatattatgtaatagaatgcaaaatttgcatacacttttagaataaagcaaaagaactaaacagtcctggagccaagggctgagggattaagccccacccccatattttccatcagccccctgtaaagccaacataataaatattatatatatatatattttttgagacagggtctcactctgtcacccgggctggagtacagtggtgcaatcttgcctcactgcaacctccgcctcacaggctcaagcgatcctctcacctcagcctcctgagtagctgggaccacaggcatataccaccatgcctggctaatgtttttgtatttttggtagagacgaggttttgccatgttgcccaggctggtcttgaactcctgagttcaggcaatctgcctgcctcagcctcccagagtgttgggattacaggcatgacccaccacgcccggccaataatattttttgatatggataattggttctcaattttatataaatgtaaatcccccagcagcatgtcttccaaccacattgccacttggatatcccttctttttagaaaatctggagccactgctagatgcaagaaaattctgggccatttcaagctctgacacctcaaccctgacactcagccctggggcctgtgctcgctcccgctgcatttatgaatactcttctggaaaagtttagctgaatgctttttttaaggttggccaagagaaatttyttcaatgctgcctcttagtctttagtactgagattgagcattgaccatcctgatccacatccccttctcccagtctcagaatgttaggtagcaggcagagcagcttatgttctttgtgctttgtgttcctgacacaggatctggaccaggtacagctccatctggaagaagtgaggttctttgacgtgtttggcttcagtgaaacagcaggagcatggcaatgcttcatgtgcaacaatcctgagaaagcaactggtgagagacccttacctgctgckaagaaccatttgtgccccaaattacagggatctgtcagctccatttttctasgtggccttcctcttgcataaacatccccagttgtaataatgcacagagtcatgtccctgctttgtgctgagaaaggcgtctcaccaaagtggtcgtaggaaaaagggaaaactttgggaggcagagaaacaatcccttacctatatgtggttatcaaggaagcagtatcagccattttgccctaaaagtattcatttcatccagatgaccctgagggttagagagaaaaaaagtgttctctcaagatgtgttctttaaggaaatgagaccacactaaatgagtgaatcagcacacagaccatattatctcacgtaatccctaacactgttgcttgatgattaaactgtaaaaagtgaagcattgaaataggaagaaattatctgagaaataacctcatagctggttattcgccttccacttcctttctgctgctcaagttatttggtctactgaccttgcctaaaaataattgttagcaaatacaagtcatgccctgtgctaaacatatcagacaccttatctcatttaatcagtccttgcaatactcttatgaggaaaatactgacattatctctgctttactgatgaggaaactgaggcacagagaggtatggtaactgcccaaggtcacaaagataaattaacagcagcagaatttgaacgcagcctgactctagaacccatgctcttaaccatttcaccattctgccttctggttacacttgctcaatccaaccagtggaaacacgttgctaataagcctatatccaaaaagttatgctgtcattggaagtgaaatatttcatcactaatgtgccctttgagaggagagagctctcaatgctgactcggctcaggaactgcatttaggatcacaagagcagtgttaaaaagactgtggaacacaaagccactttgtagatgagccatcttctaggcagccattgattataccacctgtacctggtcctttaattttaggattttatgcatcttaaagattacccattgtggcaagtctgtcctcttgttaactgccaagatgttgaggctgaatrgtaaaagtatgtttatttggccagatggagatgtgtagggctctcagagaagtaccaattaaaatgtattaccccacggaaaaggtgcggatggcagaagctggcagttaggacgccagcctttgtgaagcacagattgttggctgattacagagtctggattgagccaacgccagagtgaacaccccaattttttaaaagttaattcaaacaaataaggaattgggraattgactgcctccattataaaactttctaattagaccttattttatatatgaaaaagacagagcataaaagaagctttatttgagagctastaaaataaggtacttatcttaggtatctctgagaggccctgaagagttttcactccaagtaagctgagtccttagtttgataaatatttaatcatatctggccaagggaggcctcagaaaaggggctgaaagttaaaaacacaaagtgttcctttaatacatgttttctcaaattcactgccatgctcttgaaatgaacgttctgcacatttactctttcttatttgtgttcctcacagttaaatatagactgagaacatatagcaataaaaattcaaacaaggccaaatattttatagcagagcatattgaatcaaaatgtttggccctgaaaacttcagtgggtttggatttctttgctcatttccttttgctacatgaaagaggatttgagtttaagaaaagtcctattttaaactgttttttttttttttcaccaaaacccttgactccctggatagtttatataggttgttgatttcatcttcttttttatataagcacttaaattatatatttaatctaagtgaaaggtctaacataatattgttgccaaatatatttttcatggagacagtatttgcattcaagttctgcttaaattcaaagtttaaagatgagacatagcaacaaatgctttattggtcatgcacagctagcatattccttgcatccaatttttcatttatgcaatgcatgtttgttgcattaggtgagtgtcttctacaggctgacccttgggatagaaatatgaataaggtacagtgtctctgctctaaaagaaattcataatccagttagagccaaaaggtgtattcgaaaaaatctagcwtacttcttttatgtttttagcatgctatatttgttgagtgagtgaatgaatgaatgaatgaataatatttttaaatggcaatgtcaaatattccttgaatgttaaaatgtgatgtttcaagattgtgattatatggtaacgatatcaaattcatcactataccatacccaaagcattctgaacctggtaaatgaagattrgggctgtttcctccctgagagaagtcaccgcttgtaaaggcttgatccacttacctgcctgtcttagcgcctagaatgtactatgcccaactgagtactatgtactggtctgggtttcatcaacacccacacaggggccagctgccctatcagcctcagggagaaggggtccaaagaagtagaattgaagtctagaacaaaaggccaaataaactgggtttttgatattttttaaaagaattgacaaatgatacartaattgttttcaagtattcacgtttcaatattttttaatgctgtccagcatctccataaatgaggaataaaacatgagacaattagagaatttcagttagacattaggaaagacatcaagaaatatataatacttcttaactgtgtagactcagccagaggaatccttcagaaattgacagtatctcagcttactgacatggtcaactcacatacattcctgtcttcaagtaagtctcatcaccatcctcccaccaacttcaccatcaacacacagaaattcacaggagtttaatatctggtgatcaataaaatatttttatccagtaatgtacagatagtcagaggaaagtaaatgctaaaataatgtagaggccctgacatgatttataattgttagcatttatcactctaataatatgctaagcttgcatgcatttttctcattttctcaccattattgacttcattttacagatcagaaaactgaaacacaaagagattaagtaattttcgcaaggtcacacagcttctcagtgatggaaccagtattttaatccagacagccaattccagaacctgacttttcaacctgtagggaaaattcaagttaaggacatgaaatattggaaatttcaagagcaatcattcagtaatgttataatatattataaagacccagagacaagtttaattttttagaagtgatctacttcctcgatgacttactctacttaaagaagaacagagactttattatgataatgtgtgagaaattattacttgcaggaaatgattacagtagaatctatttcctattcttccaactgctgattcattttctgataatcattttataaaagttcagagtagaagattagaaaatttctgaaataactcagtaatcctcagagacttgcctggtggtgtttattgcagatcttgttattccacatgaatgagagaatggagattgagcaaggagattgaacagagcagaacttatttctggaaaaccaagctaatcttctttatcagttgcccttgtgtcttggaattgcacagtgtatgttgacagtaagagttagtcagctggtctgtcctagaacacatctggcttcctcttcagtcacattttgttaaagtaggaggaagaactgggtcatgactttcactcatttctcgagacacatgagatgcctttgttcttacaccctacaaaaaacaacttagagttttggcactcctgtcctcctcgataaatctaagcagccccatgtgattagtctcttagtcactagacatttaaaatttgaatgtgatcatcagtagaaggtcttcttgggttctaaaagaaaatggaacaattttttcaaacaactttctatcatgattcatctttagaacttgatttcaaatagttgtgttataagaacatactgtcaagctgagtgcaatggcacgtgcctgtagtcccagctactcaggaaagagtggcgggaagattgcttaaggccaggagtttgaagctgtggtgtaccatgatcatgcctatgaatagccactgcactccagcctggccaacatagcatagaccctgtctctaaatctaaactaattaactaaataaataaatatgaataaaaaaagaatgtgctatttattatattatattagattatgaatacatgggcaaatggagatggtttcaaaatgcctcctgtgtcaggagagttttttcagacagtcaaaagaattggtaacagcagttgtgggtctcctttgggggcacccttcatgcgagctagattatttttccactctagatgccaatgtgaaaatgaactaaatgacctctgagaggacctagcccataaggccaccaatagccttgtgagtctatgaatatgaagcttttccattaaatttcaatgtcaactttcatagaactttaaaagtgataaaagaaaactcaattttggccgggygtagtggctcacgcctgtaatcccagcactttgggaggccgaggcaggcggatcacaaggtcaggaaatcgagaccatcctggccaacatggtgaaaccccatctctactaaaaatacaaaaattagctggctgtggtggtgtgtgcctgtaatcccagctactcaggaggctgaggcaggagaatcgcttgaaccagggagttggaggttgcagtgagccaagatcatgccactgcactccagccgggtggcaagcgagactccatctcaaaagaaaaaaaaaaaagaaaactcgattttgatgtatgtggtggctagcattgtagtatgatgtcttttcttctaccacatgtgttagagcactgtcctacgtgctaagtgttggtagagcaccaaaaacaacggaatgctttttatacaataacttcacattttcacactgatatactgggactactgagtatatattgattatgtaaaattgaacctcagctttttgttcagatactttgcaatacttaaagacaaaataaaaacacacttacaaactcagataatttattatcttgaaatcttccttttctccctttccccatcttccatcttcctattttatgtctctgtggtatgaacattcttctctccctcttaaacctctccacacactctcatttctctctccctctttctctctctgtctttctctgtctctctctctctctctcacacacacacacacgcacacatatgcacacacacctacataccacccctaagcagaattaatttctctctctctgtcctttccatcctctgcctacacttctgtattgcacttggcatgtggccatcagtctttccctctggacagtaaactacaagaagaaccatggattatgcctcatctttgtacatcttaaccagtgcctggcacattatagtgtttaataagcatttggcaaatagatgagtgattgagaaattcattaatcacttaagtgatagaatacccatgggaaaaaatcgaatttgttttgaaatgcaacttgaaaatctaacttttaaaaatctaactctttctcaaaattaaaaacaactaactgaactgaaacctggaaatagcatcttttggaaaattagctttcatgagaagaaaacattgctgtatacaaggtttcaacatgttgtggaaactgaattttagtattatgctaaaatgttacaatatacacataggcaaagagctcatagtaaacatgctaataacttgtaaatcttgaagagaaacaagctaagatcagtaacctaacacccctcagggattaacttctatttttcatccagcatcactttcctactcctctgcctttccatattgggtcaacaatcttgtcttgatacagaggaaaagtgtcagataggccatatacttgcaacaaagcatcagtcattctgtgattatccactaacaaatcactatacgtagtaatgtgtccttttccacatagagaacaagctgagtcaagccaatatatagatgaggagaagctttggaaaggcagactaatgtgagtacattagtttcatcatcatacaagcataagatgacattgatttcaagaattttgtgcagtttttaaaataaaatacttagtatattttaaaagagctctagccatcatattgcagagtaatcctttttgtattgacctatgtaagtacactaagaatgaaatttgtttatcagccacaaatacacctatttaaaagaaatactggtactatactggtcctttttttttttttttttttgaaacagagtcttgctctgtcgccaggctggagtgcagtggcacagtctctgctcactgctacctccacctcccgggttcaagcgattctcctgcctcagcctcccgagtagctgggactacagacatgcgccaccacactcagctaatttttgtatttttagtagatacagggtttcaccatgttggccaggatgatctcaatctcttgacctcgtgatccgcccgcctcggcctcccaaagtgctgggattaccagcgtgagccaccaggcccaactgacatactggtactttttagcagccacagagaataaagtcatcaaaggatggtcatattttgcctcggatttcatccttcccaccttctcagaaacttcccagtatagattagattaacctttttctcttctctattcaatattccccttccaactgagtcctcccattggcttctaaacataattaagtggcttatcctcccctttccctccatctactgccttatctctcacttcccctttaaagccaagagagttgtctctctctatccactgccttgcctccttctcatgactcaaccctctctaaccttgtttctaactctatcatctctctctgtagtcattaacaacctgcaagtcacccatgcactgcacatggttcagtcttcatgttatttgtctcttggcaatattccattccgtaaaccaattcctccttaaagcattcttcttcttcagtttctgtgacacaacactcctctagcttccttcctactctctggacactccttcttatcccacctttctttaccyagctagtcattgttggagtaacgctcttactacagtaatcacctctatgcaacaacttccagatctatatatgcggtcctggcctggcctctcctctgaattcaagatttacatcacctaccacttacttgactgcttctaaggcaccccaaaatcagttattttattttgttttattttttaagataggatcttgctatgttgcccagactgctctcaaactcctgggctcaagcaatcatcccacctcagactccagagtagctgagattacaagcatgcaccactccccagcatcagttcatttaaattaaaactcatgattgtctctttgcttcccccaaacacttactcttcttccagcattccttagctcagtgaatgcaacatcactcaatctattgtaccaaccagaggcccactcactgccttctccaccacccccatccaatctatcaccacaagattgaggattttactttctcaattgctctcaaatctgtccatttctctccacagcactagtgcaagttgccatcaccttttacctacaataatggccatagcctcctcactgaactactctgaacccttccaatctccctcccacgatgcagccagagtgaactcttcaaaacacaaatctgttgtgccaccccttgcatgaaatcttaggtagcttcccatagctcttaaagaccaaacttcataacatayccttcacggtttcacatggaatggtctctcccagcttctccagctttatcctgtcccacattccctctgctctctttgctttgcctagaagaacactcttaaagtttctcagactcactgtacttcttcctgccacaatgcttttatatgtactttttcttctaccaagaattccctctctcccttcttcacttagttaaagtagatcttagccttcttattacaaatcaaattcacagcttcagtattggaagccttttgtaaccccccgatgcatactgaggtcctcaaagcaccccaaacttcttctccataacattggttacagctgctgtcttgttcttttatgtgtgacttttagatcaatgtctacttcctccagtaaatagtaagttctatgaagtggactctcctcatccatctatcctcagcccctagcacacaacagatgctcaataaatatgtaccaataaacgaatggccaaagttagtgtcttctcagaaaattttcagtaataatttttttctcagtcaagtgatgacaaaaaacagataaatgaattaacaatgactcattttacaagaaaaaggtagatattcatatgatgacatttacagcatctcttttgtgccaaatatattctttatataagcagtctcttcttaaataagttcttttcataagtactataataaacagatcatgttaatagaatgtgtgatatattcatatatatgtgtattaaaaatatacatacacatggatatgtacacatatatgtgtatatacatgtgtgtgtttcatatataacatacagcatgtgatggtgtttatgtaactgctaaggcttccagtgcagacattataaacatctattcattgtcaaaaggtttgaggccaagtgctgaaccacaacagatggaactcctgtttaaaaattccataaaagtggtgtaggtaacaccttaatatgttccagaatacaagaatttacaggcaggtaggacaatggttacaatgtgttcaaatggtacaacccaaacaagttggtcctccttatcacagacggggcacaagcttgtcagatctattttttccaaccccaggcaaactctacaatctgcaggcagtatgggaaagtgctcaacatttaaaactaaagtcctatggccagatcccatcagtaatatctatccacgcgatcttattaatgagactcagtaggaccaacatcggatatgtgtgaaaccctttcttattaaaagttaatcytacaattagacaattatcagccaggcacaggggctcacatctgtaatcccagcattttgggaggcccaggtgggtggatcacttgatcccaggagttggagatcagcttaagcaatatggcataaccccatmtctacraaaaatacaaaaattagcctgtggtggcgcatgcctgtagtcccagctacttgcagggctgagatgagagaatcatttgaacctgggagccagacgttgcagtgagctgagaacatgccactgcattccaacctgggtgacagagtgagatcctatctcaaaaaaaaaaaaaaaaattatcttcttcattgccactctcctgatcttttcctattggtctctatcagtcattgcacagcagtcccaggcaaatcttctttgatgagtttctcataaagacatgtactactcagaactattaaacaggttaccatcttggaaagtgcccttaaaatttttgtctcactattaacacaataaaaaaataagcaaaattccacaaacactaattctgaacattttttctgtaaccctattgattgaaaccaagaacatgaatgtaagcttatactgccatccttgtctttaattttatcaaaaggtcatagttttctccctacaattggttttgcagttttactctttcgtatatcatataacctattactgtcatctaccacgaagatactaattatttcctagaagtttttgagcaacataagaatcacctgtggaccttgtttaamatgcaaggcttctcaccctatcccaaaattttgattcagtgagtttagggtggttcctggaaatgtgcattctaacaagctggcagataattctgattctctggttctcacaacacagttcaggaaacatagccctaaatgcttacaacaccgtatttctgaagcttttttgcatcagtacatcagtaattggtcagagaagcatatgttttgatgggtatgaaattactgagaaaggaagccattcagtcacatgtggcagtgccctcaaagggctgctgtcaaacttagcttggctgtccaattttggtccccacaatattgtgtaggatgttacaaagtcagtgaggatcatgcctcctggtttattcactgccagtagagaaatattgcactctcaaacgctgcctggagattcttaagaaacatgccatttgttatgatccttagcaatttcaaaaaccacagacactcagtctagtaaatgtggctcctacgaccccttcatttaatgcttctagccctctttttgcatatcctctggaattatagtttgctttattagaactggcacacacaccaaagaaaaaaaaatcagtaaaaccatggaaggagattgaagtaaatttgaaactttaaatacatacaaagaaattccccatagactgtataggattcataattcccagaagcagtgttttcaagggggaaaaaatgacatactatactttttctcagttcttacttaaaaactaagaatttggagttaatttatatttcaatatctaatcaatatctacatatctatatattgatatatatctatacatgtcaatcattatatatatatwttttttgttggttttttttgaaatggagtgtccctgtgccaccagactggtatgcaatggcacaatcttggctcactgcaacctccgcctcccaggttcaagcaattttcctgcctcagtctcccgagtagctgggactacaggcgcatgccaccacacccggctaattttttgtattttagcagaaacagaatttcaccatgttgcccaggctggtcttgaactcctgagctcaggcaatccacccgcctcagcctcccaaagtgctgcgattacaggggtgagccaccttgcctggcctggggtttatattttttcttccagaatatgttttcttttgaaggcatttatctttaacaatcagaaaagagtatctagaaattcaaatatcacaaattaaactcatgacagtctcaaatatgagttattcatgcacagtgcaatactttcaagacaaaactggcataagccaaaaagcacacagtatgagtaatttctgagtctggatgaaagtcagtgtgccatgtgaacagtagttatgtggaggttattgtctattgtcattccttccagactgtcaygagaacaagcagaaacaagcagaaagtctaggaagagaaggaagcaaccacagataacaggaaattctcccaaagcagctcaatctattactgggttgtagattgatttactgtcttgtaaatggaagtttacagtcttgtaaatggmagtttactgtcttgtaaatggaagtttcaatgaatacgtggatgagttactcaaaaacagaagagrgccaggtgcagtggctcatgcttataatcccaaaactttgggaggcagaaatgggaggatcacttgaggtcaaaagttcaagtccagcctgggcagcatggtaagaccccatctctacaaaaaaaaattaaaaattatccaggtgtgatggcatgcacttgtagtcctagttacttggggggctgaggcaggagaatcgcttgagcccaggagttcaaggttccagtaagctatgatcaagccactgtattccagcctragcaacaaaagagaccctgtctttaaaacacacacacatgcagacagagagasagagagttcaccttccatttgagacacttggaattgcctttcatacctccatttttattaaaggtccaagttcaaagactgcaggagtccctctcttactctgaattctcttactattcctcacactttgatataggccattaggacatggtatttctaaaaccacctgttcatcacagtgaaaagatgattatgatttgcattgatccatgatgtcaatcatgatgacagtagctactatttattgatcctttattgtgaccaggtctcagctaagcaaggccactgtcaactgttgtggcacttttatgtgctttcatttatggtgcatgtaatcctcacggggatgtatggcttcactagcaaaacccccacagccatttgtgttgtgttaagtataactctagggagtaggaaagggaagctcagtgactttaaatagcttgtccaggaccagtcagctggtaagtggcagattctggacttcaactgaggtcggcctccaaagacagtgctcttaccacataaaccataggcctatactagagaaagtctttggtacagtctcatgtgatctattataataaagagtaaacatggcattcagcacactggttaaataaattataattggttaaagacattcagaattgcaacaaatcttaaaaccaggtagagagtgaattattgaactcttgtgctcttgaaatraaagaggtctatgactatacaagctttttttcattatgttacactacaaagcattacattccactctgcatggtgcccaaggctctttaggattggtctctctgattctcacacctcatctcttgcctcttctctcccaccctgctccctcccagaatgagttacagttcctagaatgcattttatgcctcccttcctcagctttggtcctttgctatgaacttttattcttttttacttctttttttggctcaatgaccttccttcctttgccttcatagctgcaacttgtccctgagaattcagcccagacagcatctactctagcaagcttttctgctttgtatgccccagtttagaataagtgcctctcagtgtgttccagttagaccctgtgcacagatctagcctggtacttatcccactctgtactcacttgcttactgcatttctctgcatctcaataaytragactgtcatatttgtgtttatatcccctttacctggcatgtgcctagtgcatggtaaccataaaggcattttgaatagaagaatgggagaatcaatgaatggcaatgggtattaataaaaactggaactcagtcttccatgacaagaataacatgaatgctaaattctcttattaactgagaagaaaccactgggggcatcttattcatttctagtcaattccaccgccaggagataaaaggatttttctctattctttagacccatggttttccccctctaactcctttctacccttcttccataataagggaatcaccaccatgtctgtagtacaaactacctgcaaattggcaagttgtaggcgtactttggtctagtcaaaagcagatctgtcaagaagaaaggtsatggcaagtgtttcaggatgcttgagggattttgcttgttgtctttctaaagggccaaagaatgacaacatctgcttattatgagagtgttttgagaaagctagcaaaagttttagcagaaaaacacccaggggctaggcacaggggctcatgcctgtaatcccagaactttgggaagctaaggtgggcagattgcttgagcccaggagtttgaggaccatgggcgacatggcctaaccccatttctacaaaaataaaaaatttttaaaaccagccagatgtggtgacacgtgcctgtggtcccagctactagggaggctgatgtgggagaatcacttgagcccaggatctggaggctgcagtgagtcatgattgtgtcactgcactccagcctgggtgacagagtgagaccctgaaaaaaaaaaagaargggagaagaaagagagagagagaaggaaagaaagaaagaaagaaagaaagaaagaaagaaagaaagaaagaaagaaagaaagaaagaaaagaaagagaaagaaagaaagagagagaaaaagagaaaraaagaaagagagagagagagggagagagagagagaggaagggaaggaaggaaggaaggaaggaaggaaggaaggaaggaaggaaggaaggaaggaagaagaaaagagacaaacacccaggaaaactttactagagagtccttgtccactaagacaatgctcctgctggttcttctcttcaaacaagggcgattttgcaagagtttccatggaaaattattaggcatccaccttacagtcctgatttggctccttctgactttttgtttcctaatcttaaaaaatctgcaaagggcacttattttgtttcagttaataatgttaaaacgactgcatcaacatggttaaattcccaggacccttagctctttaataatggactaaatggctgatattaccacttaccaaagtgtcttgaacttgatggagtttatgttgagaaatacagtttccactttttatttttatcttctaattccatttttttcatgaacttttgaagttccctcgtatatctgaactttgttgaatttgacatataatcagtgcctgatcgcttctgttttccatctctcctgcccagctccatgtcccacaggctgccatgtagtgattgtttcaataggctcttttagctctggctttcaggtaccttccaccactggggacaccagtaagcagagggagggaggagagagaggttgagttattgatttgctggctgcctccctgcttggacaccgagggtcgacagtgtcctctattccaggccacagctgttatcaaacggtgctctccatacaggtctcccactaagtcctaactgttctctgccctttcctcttcaggcggaggagtgttaggcctgcatggttactggccccagagtactatggcgcttttcctacgccctgcccacatctgagtaaataatctagtaactctattaactctcctccactgctcagtttgagatgccatctgtttcctgccaagaccctgcctgacacatcattgatcccatctggggcccatgaggcttcatgctgggctagctggaccctcgcaggctctaggccctttcttagtcctttctaaaggggcttcagaaaaactttcccataaagtccaatatgacctctctgtgactgttactcaatctctttcctggatcttacacctagaaagccttgaattgacttctcccttcacccctcagcccatgaggggtgttcgagagcacctgctttacttgtttctgagtttgctgattcttccggcttcttcaggttcttttgtgtgttttcccccacacacctaccttgctaccactctatctggaaaatcctatctgatccttttctgcactctatctggaaaattctctcttcttcatgagggtcccagctctcatgtcaccttgtctcaactagaagtggaatttctgctcttcaaatgctgtaacaygtggcttrtacttctcggtggcacttgccaaaccctacactgagcagtagaatttgtaaaatgccatatcttccctagatgataaattaaagctccctgtgagggtgattttatgacccctcagatccaaatatagtgccttacagcttatctgtgctcgaaaatacatacggggtgggtggatgattgataaatgagcagatgaatattctttattttttattcttcctgctgtgggtcttctcagctctgggagacctgttattattatacttactcatcaacttcatgttgaataagaccaaccccttcaaaattcatttttttagcaacaaatatttttaacttggtgcagaaaagggataaaattaacatataaacatttgtattagcattctgaaaaacttttaagttgacaaacacagtaacagtttgggttccaattgcactagaaaattcagtttaataacccatagcttttatagccagttgatattttaaaaaataaacagatccatgttagtagagaatgtcctagccaaattgtggtgctttgttttttggtgttttgttttgttttgttttgctttttttttttaagagatggcatttcactctgtcacccaggctggagtgcagtggcatgatcatagctcactgcacactttgacctctgaggctcaagcgatcctcccacctctgcaccccttcacccccgtgagtacctgggactacaggtgcatgccaccgtgcccagctaattattttattttatttttctgtagagacagggtctcgctatgttgctcagcctggtcacaaactcctggtctcaactcctggcctcaaatgatccctctgtctyggcctcccaaagcactgggattacaggcatgagccaccacacctggccaaattgtggtgctttaaatgaaataatgtgttaattggaaagtgagaaaatgattgaatatcctctatgttctacatgcaaacaatttattttagatgatacatgatcataccctygtagatcattccacatgttatttttcaaatggaatatgatgatcttagaaaaatagtttcttgttttagctgtgaagaggctgtgataacatatctgaatcacctgcttaaaaggacgtactatgggcaatagacctttaaaatgacacktccccagccatgcatatgttagatgtaatagcaaaaaaaaaaaaaaaaaacaacaaaaacaaaaacaaaaaacaaacaaacaaacagttttttaagatacgggatataaaaattttgttttgttttttgaaattatttttaaattaatctcacagctccaaatagcctggcttttactgacttctctgaaactgactctaacacctaaatttggggcctcacattcagctactttaaagttctgctaatgtttcctttctaaaaccattttcattgatttttttcccctagggctgattttcactgggctacggtgaaaagtctttgcttcccagcttgtctctgaagtccttcatcctttgttgttagtaagcctatcatttggtcttgactgtctcatcatagttattatatcccattcacccatgtctttaaggactccaacaattttgcccagtgttcattgtaaacttttgtcacacattactcttcaagtgaaacatytggatctgccttgagaaaaaataaagtagttaatcctctatgtcagatccaaaaggatccatgtacttaaatattacctaagtcaatcattatttcaaatcatctcagatatcataactatttcaaatgtttctttgagtaaatatgaaagactgagacaggaaaaatgtatcaytattaaatagcattacattaaatcatcttgtcattaaaaccatggtatcatcctgagcaacatgatgaaaccttgtctatacaaaaaaatattaaaaaattagccaagtgtggtggtgtgcacctgtggtcccagctactcgggaggctgaggtgggaggatcacctgagcctgggaggcagaggttgcagtgagccaaaatctcaccactgcactccagcctgggtgacagagtgacaccctgtcttaggaaaacaaaacaaaaaaactgtaaagtcaagtctttcctagaagtggggctagggtgagggagaagcagtgccttgtgctttgctatttacctagtgtcctcacataaatttctttcttttgatttttgacctcccagaatcccagggggcattattattttctcttgctgattagaaaattgtaatttagaggattcaaatctaaatcttctaagttaatattaaaaaccttcagatattacaattagattaccattttctctcacctgaaaatatgaaaaatgggtgcttttaaattttttaaattaattttggctttggtattttgtttttgttgtttgttttaacttatttttccccttttttctcctcttggatcacctcttgaaaccttctttcctcatcccagatagtctgctgcaccctttgtgactcaatggtgtactgttaataaacatttactgaggctctagcccggcaggcactgtgttaaggctgttcctgatctcaaggaacgcataacccagtggggagacacagtgccctaagcactttaactgaagtctctgtagatgtggttgcacaaaggaaatcaccatgtttatggaaaatttaaatttgcaaagakcattactagctttaagaatgctccacatcagacaattcctatcaaagcaaagcagaactctgaaattattttcttgatattaattgtaagtttatatttcatgagttcctgctttcttttgcctctgctatgctcagtagtagcctccaccagagcttctcagaagattgggggtcttatcactgaggtgtcagatcaaatgtcatcacctcaaacatccaagctctttcctgaccactgaaatgcatgcatgtacaccaagcccccaagtcacttactccctattctatattcatcatagtccttatcactatcttacaatatatttgatatgtattttcagtgtttgtttgtttgtttggtttttgagacggagtctcactctgttgcccagcctggagtgcagtggcgtaatctcagctcactgcaacctccacctgccaggcccaagcaattctcctgcctagcttcccaaatagctgggattacacccagctaatttttgtatttttggtagagatgggctttcgccaagttggccaggctggtctcaaactcctgacctcaggagatccacccacctcggcctcccaaagtgctgggattacaggcatgagctgctgcgcctggccagtttttagccttaatttggagttgacaatggaacagccaattgaatagtcatccggaaaaaaaaatagccttaatagtactttgtttatgaaaactctacatttcggctgggcatggtggctcacacctgtaatcccagcactttgggacgccagggtggatggatcacctgaggccaggagtttgagaccagcctggccaacatggcaaaaccctgtctctactaaaaatacaaaaatttagccgagcgtggtggcgaatacctgtagtctcagctactcgggagactgaggcaggggaatcacttgagcccgagaggtggaggttgcaatgagctgagatcgtgccactgcactccagcctcggtgacagagtaaactgtcaaaaaaaaaaaaaaaagaaaaaaaagaaaaagaaaagaaaagaaaagaaaactatacattttattatttttatcctgaaaatgctctgtgaaagtggacaatcctgtgaggcaattattagacctatattagaaaaaagaaatggtagtgyacaaaaggcaggttgtgttcatagggtcaaacaggcacagtccagaatttttccaaactgatggaacaaattttattactttcaaggtgctatgaaaattgaagataaatatatataaataaacattgtcctactacagatggagctttccattgtccccttctgctgaaatcagatgctttcatctgaatttgaagagtgaatcttatgttgttggtaaaaggaataaaattattcagttcagcgtctaaactctgacattgcaatggatcttctaattctatgatcatttgtaatcatgcacactctgcttcaatgtaaaattagtccattcagtcaacaaatatttatagacttcctactatttgccaggcaccatgttagatgcttggtgattcaacagagaacaaagcaaagaccctgcccttgtggagctttcaactgaatgagacagaaagatattaatcagataagcactaatatctatctacaaatgataatccctgatatataagaaacatgccatgtgccatgagaacayatgggggaaagccaccctcatctggatttggagagggctttccaaaggaagcaacatttaagttgaaatgtgaagtgatcagttgttgactaggtgaagatgggaatacagagaggggaaagagagtacatgtgttccagagagtgagactagcatgtacaagagttgggtaagtttgcctttgctgcttggtgttaccgctttaggaaccatgtcttttggagtgctgcattgacttttgctgccaaatagctaaatatacttgggtttatgattatttataaagctatatttccagcagttcatgtgtcataaagcatggaaatttgttttttattacctagttactggcaaaatcaaaatgaagcttatggcatactagatactttgtgccaacatttcaaactgttccaaattaatttggttattccaacattagaaacagaacactatgaaacaaagaaaccaagcacrgaaagctaaatatccagataaactttaaatactgctaacagatgctctttgtgtgaaccaatttcttttgaaaatggcaatgagggctttcaacagttttccattgtcatatctgaattgtgcattcttttagggacaaaggaggaaaggttaaccaaattcatcatttattagcctactttccaggtgtgctaactgggttctggtacactgtacagttctgacttttgatcacctacctagtaaatattggaaaatacatggcatgattattctkctaccttcaacagttgtaaatcaagatggccagcctctcatagaaggaaarcttaaagagaagcaagtcagatggaagttcatcaaaaggtggaaaacacgctattttacactggctggaaatcaacttctgtttcaaaaaggaaagtctgtaagttcctccatcatcttttacacttgcatttttaaggtyttgatctccaccaatagctaaacgttttgtcttgggtttaaactctaataatttttccatctccatttcaccatcttacagmattgttttatcacacatttctgtgtctagtctgtttattcctatgttagttgattcactgtccccttccagtttattatggaagcttgttttagttgactttttagttgaactgcagagggactgcaagtcttgactcagacaccgtgccctttgtttccttgtggaccacgtacacaaatttatgacttatgatattggctctgatttttttatagctatagtttatatttggaaatgggggtccaaaaaaggaggacatagacaaggaggaaagaatgaaggctgatttactttaggtactttttatagtcaacaaagtttaattctgattaaaatattactgtctttcatctatttaatattcagttaatgaatataatagaattatgatcaaattaataaatatttaatataattttccatttgaataggatgttcagtaattatttgtattgtgaattttcagtgggaaacctctgaagtagcattccattgcaatcaataatgcaaagttaccttctcttcttttcaaattggttttatgtatcattaaactctcctgattcaggatcaagaggaatcaaatcttgacctacttcttggctattttagaaaataatcataatgactagcattttttcagtgcctactatgcaacaccttggattgcctcaaacaatcctcaaaacaatcctattaggccaccactgctattattgccatttcacagatgaggaaactgagtcaaagaaactgattggattgtccaaggataaagctaataaggtgagaaagggtataactggggtcaagatcaggcagtgttacaccaaagcatgttcttaaatgagtttactgcttcccatgtatacttaaaatacagagtcagtggtaaactgtactcaccagggatctccatagaaatggaaccaataggatatataaagacatatacgagatttactatgggaattggctcatgaaattatggagggtgtgaagttccatgatatgctgtgtgcaagctggagaaccaggaaaactggtggtgtaattcagtctgtgtcctaaggccagaaaattaagggagtcaatgatataactcccagtccaaggccaaaggcctgagaacctgggtatggcrgtgagctggggggagggatgtaagtcccagagtctgaaggccccaaaaccaggagctctgatatccacaggcaggagagaatgcatgtctcagtgcaagaagaaaaagcaaatttatctttcctccaacttgttattctatccaggtccccaatagattgcatgatgcccacccacaatggggagcatggatcttcttcactcagtccactaattcaaatgccagcctcttccagaaacacctcacagacacatgcggaaataatgctttcccagctgtctgggtacccattagcccagtcaagttgacacataaattaaccatcacataaaccaaactgtctgaattaattaatgaaaagtggtaaattagttaaaaattataattcattctcggccatatgcactatatctttagagtactcattataaaatgtatttgaacattttaatcagtatgaatcaagtatcgtgtattctgaccagtgctcttttaattaataagacttctgttaactttttgaatgaaaaagaatattttttgtgatacctactgtgtastcatgctactttcttcatctgtgtgtgttataacatatacagatggacttttctgtagctgaacatctttttgaaagggcagttcaatttagacagctattggaaacttaaagaaatttttttagcataggttcacactaaagcatgtttaaagtgtttaaaatgactacctgaattttctgtttttattcaagaaatcaagaatagaaatgaagacrtagtaattttccagatcccttaagacaaagcagagttaatctatgagaatgtttttctgaactcaaataatgacctttatactttctgattcatggcttttttaataaggtttaaagaaaaagcaattttataattaggtaacttgtttgacatgtttatcaggaaataatggtctgacattccataactctgacaaaacttgcggctcaaatagtgggaaataatttaatatagcatgaaggccacagcaaaatacctctaatctccagggaaacaataacctaccagtggtcaacaatcctgctgaagcttcaggtccttgtaaaagggccccttttaaatgaaagaaatgtgcattttaaaattagagctgaggttgaaagactctagtggaagactctaatctttcacttttgcatttttaagaccttgatctccacmaacyagctaggcaatagtgtcctttgactttctatctattcctgtctcagttgattcactgtccatctttaaattactatggtaactttttattttcgtatcaatctctgtactatagactacttcaaagaaatgcaattttattactgtcagatacttactgtaaaccaaattaggctaacaaagtattgtctagtgtgtatgtcttcaaactttatcctgtgtaccctaaaagaattttgaaaaatctatgtaataccttgcagcattttaagttgcagcaacacttttatcataagtttaaacatttgcccggactgtaatttctgttgaattgtaaatattgacattttaaaacaaaaggattacatctctccattaaatgtaaccattggattaaaataccatagcagtttaacacctaacactatttttaatacataaattaactcttttttaaatagaagtgttcacattgtttctctttttttttttaaatcatgtttctgttctacctctatcacagcattttatcctgaatggcatttcatttttcactgagtaaaactatatgtataaattgaaatttaattgtttaaattccttgtgaccatccgtytccaagtgttattttttctgatttagttatctttttaaaaagttatatccttcatgaaaatccataagtataatgccaagcttaataattattaaacattaaaaattgaaatattattgaaaatgtatctcataatgaaatagatgaggagtgattacattgccttggctgatggatacttccctgaygtcaatagttggaattgcttttttgtttggtgcttctgagatttgtttacattggacaaaacatcatagaaagtatgggatgagtgaagaggatgctttttcattgcaaagtgaaaggagggtgattgcaacaggagaggtgggcaaggagaattggcaagattctcaaccacaggtactttctctagtagacaaaatgtattcatgtgaaagacctgaaattacttcaaagaaatatctggccccttaaaattattcrtcttagcccagtgtgatgactttggtattgtagaggtccttaaatttttgctttaataaaaggcaaatgtaacatcattaaatatttcttctcttactgtttgtagacaaagcatgcttccaaagctgcagagagtttcaaaaacagtttggtctatgcaaacactggaagcctctctattcaattaaggtttggcaaaatctttctcagaggtagcacaaaggaaaattcaatttcatgcctcccaaactacctgaagttataagttaatagcactccaaattgtaccgttgcaccttgctctattaatataacgttaatagaaaatgaaagaactctgaatttttcccaaatcccactttataataatatcctttaaattaattatcttgtgtcaacttatgatactctaacaaaggcccaattgctcactccttcagttattctaatgattctgaggccttagcacccaaaataacaaaggtcttgagacataaaaagtgaaaggattctggccctcttagaaagttctccagtagccagagatccttgcctacagtaacagccagcccatgttcttttcttcccatgcctttcagaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctasagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaattgtggtgatttgttatgcagtgttaactaatacaaaagctaagttgggctacatacaagggataactttttccttgaaatttattgattatgtagtctagtatagaaacctggagaaagattatgaatggtcaacaccttgaccctcctgctaacttactaggataggaaatataaaaggggccatgtttgcgaaaggaaacaattccattttaacaagtaaagtttgagggtattgtgagtcacagaatttattacacattggaaatagagttctggaggtcaaaattcaggatcactggatatataggtagtcaccaaagatgcaaaattagatgaaattacccagagagaataagaagacaaaagaattaataagggttccttgagacaccagcatttaagtaaaggcagctggtgtatctgattagtgttgagagattatgtagaccaggagaaacaatgtcacaaaagccaaattaataaggatttttcaggaaaaacagggcaacaatttgaaatcctgaagagtaatcacttaagataaagcctgacttccacaatcaggaagcaattggtgtcattgggaagaacaattccatttgagtgagggagtaaacatcaaattttagtaggctgaagtgtcaatgggaggtttggactttaaagcaataattggactattctttcaacaaaatggggctacgatgaaggggctaagatggagcaagtgttttcttgctctttttaagatgagtaagaattaagggaaagatgaaggagttaaaaatacagaaagaaagaggaaaaaaatgactttgcttgagtaaagtttccagaagtgataggaagggattaaaactcctttattctgcagcaattaactgagcaggtgctaagcaacagttgccatgcttggcctggagatacaaagataaaagacacagtttttctcttcaagaagtttaaagtttagtggaagagacatatacgtacaacagaaatataagtgctacgcagcaagtgccttgatgaaggtatgcacagggtcctgtggaaacacaagagaagacaccattgtaagtgactttaaactcagagtggactccctcactgcttcccagaggtgatagaaaatgagctagtcttaaagaactagtaggattgctgtggacaaacaaggagcaaatggtcagtagggtgaaccacgctacaaatgcaaaagagggagaaggaacatggtccatttgcaaaacgtaagcttttccctagggttgaaacataaggggtgtatggaaaatggttcagagtcatgctgaaaaggcctgcaggaccacaggatttaggacttggttccatgccaagggtctaaactttttccttaacatgatgaggcattaatttgtgtggcagcaataaagataaaaaagaaaaaaaaatcacaaataagatgatgaagcaccattaaaaggttttaagcagatttgcatttagaaaggtaatcttaatagtggtatagagaatggattataagaatatcaaaaattgtagcagggagaccatttgggaggttcttctaaggtagtgaggacctggactgatgtagtaccaaaggaaatagagataaatgaacaggcaggaaaaatactgatttagttaaatggacagaacactggcggattggatggagttggagtatgggaatggaaaggaaagagtttctgctgatccctaggtgcttgcttgggaaacttggtagatgatgataatgatgatattcactgaaatagaaaattcagaagcagcattttgagagataagcagatggtaaatttaattttgatgtatacattcagggaacagataggggactaaccttgcagacagacaactcctgtgaagttgggcacgaaaaggatgagaatgagtatagttgtaaatgattctctaaatattcttttaaaacttaccgccccatacttaagagtcagtgaataactctagctgttttagtcaattaggaacaattggtaacagacaaacactgacaaagtattaggtgaccttgcattagctattaaaaatttgaatgccaacagtgtgcttaaacctttcacagcagagagctcgtggtaaaacagtggttatgctgaatgtttggcctcagaaagaagagaatggccccctcagctcaatttgtggggaaagaattatttttactacttgctacaaagtccttgtgatttaattaactggatgcctctaatctacaacataattctcagtgcctttgagccagatcttaaaaaaagtaaatgtgtgaagtgtaaataatgaactttytggtttcattccatgatgcaataattccaatgcaagtaaattctcctgggttcagaatcacactaggaatctcagaatcatcagcttcccgcgaatatttctggcacttccaccctggttgctggtgagtttaccacagaccggcctttcccaaaagggctgccatttcttcccgatctaagaagaaaccactttcctaaacatgcttaaacctttaaaaatgttggtatgaataaaattataatcatggaccgaaattgaagtggctttcattttaatttaatttttattctttttccctcccagatagcattggaaatataaatgtttatgtatgagaagcttatctagctacttcttgagaacctggagtttggtaaaaacaaatgttcaatacttttctaatactgagctttctagaaaatccttagctggtgatgtcaaggggcatttactgggtcatctccaactcacctactttccataggtacccacagacctgtttgtggtgatgacttattctcagacataaataaggattacatgtttaaggaagcattacccactttaggaaacaattgtgagataaggtgagagaatgtgagctgaattcaaagtgcattgcagacaaataaataccatggtttaaatgccctaataaggatttccagttcccaaaatctaaatttttagaagagaaaccaagaaaaaaacaaactgtcatcttgtttcagaatagcaccagagtatagatcctttggaacaaatccttcccaaagatgctcctgaaagacaaaggggttggaaaatccagaagacgtctaccaaggtagggaaaggggcacaggctctgggcacgtgaagagtcaatccctcactctatcaaaactagattaccaacctgagacagttattcatccttcatccctggtttggggataatattatccacagagtggaattgatgtgagacacacatgtcgtgcaaaagcacaaaacctataaccttaaccagcagagaacctttaacataataggtgcttgaaaaagacactccagtttttatgtaccattaagtaactatgataccatgtcttaatgataattacatgttgatgtcttcctttttaggcaaaacattcagtggttgctttgcaagaccatatggaactgtggtcacttcaatgttggctctttcgttcactaatatcacacttcattccactcctctgcttctgtgcttttctgtgtacatgataactttttgtttcaaagtcaaaccaaattgtaacctgtttaagacatagtaaacagcaattagcccgtgtgctgtcaactatccacatatctgaatggatgtgacaacacaaagagctaagatagtatttgcacatcaataggcaacaacagaaaccccatcacagccattcccactgcatagtgattgtaaaacatgtactaatttcagagatatttaaatgtgggggaagaaaatgtaaagcagttagcagaaggaagtattaagagttccacacaggtttgtttcacagtaatcaaaactgtatgttaacatttttgtgaacagtagagcatattgcaaatgtaacaaattttaaaacataatgattaaaatgcccccagtgcgcccatcctcaaaggtgtgaggtcagctttgcctatagttgcttaccctctcttttgacaggactaaggatggctgatgtccacatacaagccatgtttatggtctctatatccccctgcctgtgctctcctttgtccaagtttcctttcctgaaagggaagctgggtaaagaatgggccaagatagcagagatggaggcaggggtgcacacggtgtgtctttttattttttcactttcattttaagttcaggggtacaagtacaggttcattacataggtaaacttgtgtcatcggggatttgtagtatagattatttcatcatccaggtattaagcctagtacccactggttatttttcctgatcctctccttccttccaccctcaactccccgaaaggccccagtgtgtgttgttcccctctatgtgtccatgtcttcttatcatttagctcccacttataaaagagaacatgcagtatttggttttctgttcctgcaaagcacatgatcttgttcctttttgtggctgcatgatattccatgaaccacattttctttatccagtctatcattgcccaaatgatgggcatttagattgattccatgactttgctattgtgaatagtgctgcaatgaacatacatgtgcatgcatctttgtaatagaatgatttatattcctctgggtatatacccagtaatgggattgctgggtcaaatggtatttctgcctctaagtctttgaggagtcattgcactgtcttccacaatggttgaactaatttacattcccatcaacagtgtaaaagtgtgcctttttctccacaacctcaccagcatctgttgttttttgactttttaataatagccactctgactggcgtgagatggtatctcattgtggttttgaattgcatttctctaatgatcaatgatactgagctttatttcatgagtgttggccacatgtatgtcttcttttgagaagtgtctgtttatgtcctttacccacttttttatgaggttgtttgttttttgcttgtaaatttgtttaagttccttatagatgctggatattagacctttgttgggtgcgtagtttgcaaaaattttctcccattcagtaggttgtctgtttactctgttg

SEQ ID NO: 17612 - DNA, 29173 bp, Homo sapiens
atgggtggcttgaagtaccagttgaacctcagaaaaattaaattctttaggaggaatgcctttaattagaatcagaagtagactctgtcatggaagtcctggaaactccattatttcacagatttgcagactcatagactttcttatttattgtcagaaacttctggaagtctctcaatgaatctccaagttactgggtgagaccacacctagcccaggattccagatgaactgcctagtccatattattggtgaagacacccaggaaatatttcacaacctatctcagtaacattccaatgtgttacaatcctcgcttttaggaaatccttcattatttccaaagatactgctactgctctacatcctttgtgaaaataacaagatcaaaacctttataatctcaaaaaaaaaaaaaaaaaaaaaaacaggaaaagaattaaggaacattctctcttcttttttttttttttttttttttttggaaatggagtcccatcctgtagcccgggccagagtgcaatggcgtgagctcagctctctgcagcctccgccttccgggttcaagcgattctcatactcagcctcatgagtagctgggattacaggcacccgccaccatgcctggctagtttttgtatttttagcagagacagggtttcaccatgttggccagcctagtctcaaactcctgacttcaagtgatccacctgccttggccttccaaagtgctgggattacaggtgtgagccactgcgcccagcccacattctcttcttctgcaaactaacatgtctatacctttttcagtcctttaatgacctgtgtggaccctgtacataacaacgtgctctgtgggcccctccgttgtgggtcgaacaattaaacacctcactctggttggtgccagccagatgagttgatgaaacctgagaggccagattgcttccagttctgtaaaacctgtttgagaattaaaagagatgctccatcatgtcctaggctgagtaaatatgaaggaacagtgtaattctatggcaactgacaatcccaacagtaagccaacacagcaccacccccaggagcaacagcaagtgtttgagtgggttcaaaagagagttggggaactagggggattggggctgcacgtgacgaggagaaagggtgtgggataacatgggttggccttggttgataggctatgtccagtctctgctgcctctgtctctccttcctcctccttacctcactcttgagccccccacctttctctgtctccctatctgaaacacataccctgctcttaattgggaaactagtaaacatttctgctgattttaatcctgaaacatcattgagaccatatgaaatgagtcttaaggatcagaaccatatgaagggaaggactgtgggctggcagccggcgcacctgtgctgtcttctggacttccaccaccaacagtctccaggacctgtttcaagttgcttcacctctttgaaccgacttcatctattaactgagtggttgaactagatggctctttctggcttaaaaattctgtgatttcatttctggaggaatttcaagcatgggtagagagagaagaaactgagaggcaagaggtatggtttggactcatcaaattaaatcacaggtgactttccagtccccccaccaccccgatctgtaaggctgcctttgggtgcgtggccttcctgcaaaatggcaaacacttgaaaaagcttccacgctgaaacccaaaccagaccatatttaggatgccccataaggtggcattttttactaagatgataaaggataaacattggtggagccagagaggctgctcccaaatacagtcctccccatcagcaacactgcagtagcctgcacctatcgtccagagtatgaaaaagacttttgccaaagacggcttttggggatttatcattattacatgttaagagcctgttctccatgtcctcaccttcctaccttgctaatcttccccatttccatctttcggcccagtgtgagacctcaccatctccttttcccatcttctttcctccatacccttggtttcctagcaggtcaatgcccctgccccttcactggaatccatccatcctggttattcttttctttatgaacctgctggactacatctcaaagttacccaaaagagggatacaaagacacaataaaatcggaaataacgctcacccttaccagcctgcagttaagagtgtgtggaactagggtggctgcaggcaaagagatagggggaagggctgcctcatgccatgggcaggacagtaaatggtgcaaattttctggaaagcatcttagtaatataggtgaagagcctttacaatgtgtttatcctatgacctatccttacttctcttattctaaaggaataagaagaggtttaatcaaagcatgagtgaaaaggccatccaaacacagggaaaggggccgttatgatgtctacggttctaagaaatagaaaacaacaacttggcttaaataataagcacataaccaaagaaatctagaagtaggattcccttaagagttgagagatttagcagctcaaaaatgtgacctgacatacgagttctttctatgcttttgttcttcctcctccaacactggtttcacactaaacttggctccccagtggccaatagcaccaaacagcacttatcggcattcttgttggtatccaaaagagatggagaaagcctgatttcacatggctcttccttaaaagcaacaaaggacttttcccggaagccttcagcaaacctcgtcagatttgaatcacatgccaattcctaaatcagtcactggcagggaagtgggaaaaaggggaggaggtgtttacccttaaccaatatgcctacccctgcccactgagatcaattccataaaagtattgcttcagttctttgaagaggagtacaatgtttgtgagtcactcaccacatttacccaccaagagctaagggataactgagtaaaatggtagagctggtaggaaaatggtgagtagtcccgtccttctgtgccataattgacttgtacacaaagagatttggaaatttaaacataagaactctctcttcccaagcccagggctttgggcacttcaagtctggtccttgcctgggcacagtggctcacgcctgtaatctcagcaatttgggaagccaaggagggtggatcacctgaggtgatgagtttgagaccagcctggccaacatggcgaaaccccaactctactaaaaaatacaaaaattagttggatgtagtggcacacgcctggaatcccagctactcaggaggctgaggcaggaaaatcgcttgaatctgggaggcaaaagttgcagtgagctgagattgtaccactgcactccagcctgggagacagagcaagactccatcccaccccccatcaaaaaaaaattctggtctttacatgtgaaaaaataaaagctaatttttaaaaactaaataataaagagtgttaggtgataagttttatgatagagataatgtgtgctttaaaacacacagcataaaacagatggaaaacacctcatggagaagggagagcttgaattggtgtttgattgaaggacaagaaaaatctgttggtaacttcctcctggctctgacctctgatgcagttaaagtaaagcaacttagaattatgatctagggaacatattcagagagaaatgaatttatgatgtcttcaatttgaagatgctatgattttagactattctagaatacaatgatttttcattgcttcacacttgtaagaaatgttccactactgaaaatttgcaacacttaaaaaattcctacacaaaatcacagcccaccttgctgttctatgctaaataaacaaaatattttttctcaattatgttgctctccttaattacacgcaattttaaaactagctgtaactgacagccctttcctcacacttactgccaatgtatttaggtcaatcccacctccaattagagaaacttagaaaaaggaaatcctacggtgaaatgccatatgccttacaattttcagtaactaatcctcaaggatgacaacttggcaaaaaagagaactggaccagctccctgaaaggtccatcacttcggcccatgttaattgattgccttaaaatcacagtgcttccaggttgtagagacacactcaaaatggactattgccctcacattaaaggggataggttttcttttcccttttcccatccctgcttctctcaaagctgcacagaggtatatgaggtttggggaatatttgcagcacatgttggctggcaagaatgtgggtgaattcctgttaaggggcgcagacactccctcttctatgacctttcctttccacccagaacaactgaagtatcatgataagaggaagggctttgtgtttgagataagcagctcctatacctgtcagctttctctaataagaaagctctttcctgccaccgtataggtcaccttcttattggtaaagcatgatgaagtttggaaactgttgtccttgttttgttgaaagaagccaagttccaagaaatctgcagaggcattcctacaatccctcagccatggcagcatgaatcctgaaggggcagtgagtgctggtttctactctgtctgcacagctaagcctaggggagataatcttttcatacaagatgcattctgcttttgtgggcctcttgcagccctcaagcccccatctgatttgtacacaatgatccagtgggccagaggagcccagagccatgagcggcccatccctccaagaactatttctgactgtccagtatcatggagcaagtggaaagaagaaaaaaaaaacccaattacttttcgaagagcaagatgaatgctgtagaaggagaaggaaggggagggagatggatgggtgccgattccagaatcttcagatctgcttggatgaatcattacctatgatttgcgggacaagaatctgattttattcatcaaccagtagaaacttttctttctgcctcccaacatctgaaatccaacaaacatgtgccttaggaacataccggtcatcttttagaggcattttatatacatattgagtaactagaaaacactctttccgtaatacacacacacacacacacacacacacaccatcttgtcatacaacactcccacgcaagaaaagcgaaactgctgtttgatgaatgtaaacacttggctgtttgcagcagtcgggagtcctgccaggtttaagtgctaagatgggaggtgaaccccaggggtttccccctgcccgtgctgagatccttatttggtcaagcttctacctatgccctggcctcggagcgagcccgatagcgctggatcacagcagagggagcgaggcggctgacgtcccatcccgaagagatgaatggaattccaggaagctagagtcatgctggcttgggacagtggcttgkagaccagacttcaatgacagaagcactaggcagcggcactcatggcaatgtgtgcacccacagaaatgtaacccacacctcgggttcaggagccgaaaaatgaaaagaacgtttagggaggaaaaagggaaatacaataataggcagagagtaatttattactctatgggtctgctctgtaaatagctgaagactctggagccagatggttctgcaaattctccaaacaggagtcacgttaaraagcacgagtgggcacaaaaactgtttttcaagacacaatttcaatttggcttgtggaaactggatacgagtaagtttccttaaaattcgagtagaaagcagctgtcctccccgggccccttgatgagaatacgcacaccgcccccaagcggccggccgagggagcgccgcggcagcgggagaggcgcctctgtgggccccctggcagccgcggcaggaaagggcccgaaggcagcgaaggcgaacgcggcgcaccaacctgccggccccgccgacgccgcgctcacctccctccggggcgggcgtggggccagctcaggacaggcgctcgggggacgcgtgtcctcaccccacggggacggtggaggagagtcagcgagggcccgaggggcaggtactttaacgaatggctctcttggtgtcccctgcgccccgtcggcccatttttctttttacaaaacgggcccagtctctagtatccacctctcgccatcaaccaggcattccgggagatcagctcgcccgaaagcccctgcgccaccccgcgggccctcctaggtggtctccccagccccgtcccttttcgggatgcttgctgatcaccccgagcccgcgtggcgcaagagtacgagcgccgagcccgtgcgcgccaaggctgcgtgggcgggcaccgacttttctgagaagttctagtgctcccaagccccgacccccgcccccttcactttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccrctgcgcccgagctggcctgcgagttcagggctcctgycgctctccaggagcaacctctactccggacgcacaggcattccccgcgcccctccagccctcgccgccctcgccaccgctcccggccgccgcgctccggtacacacaggtaagtcgcccccggcggccgccgaggaccaaagctgcccgggacatccacctggagcgctgaggcttcagtccctctggtggaccccggaacctacactctccccgctcgcctaccccagcccgctcctctcagccgctggaggactcttcagggcaaggctccagagccatcctctccagccttgaggttcacaaaccaactcatcaggacaccccaagatttccttactctctgaagtcctccttaagcctttgtatcagcactccagggaagagtctgtacttccccgtgccctccctgcaaccccaaactacagttcctgatcttgctcaccttcgacttcccaaaagcccccaaattgttggtcttgcgccccccacactttaaaaccagcatctctttcctccacctctctctctctctctctctctctctctcatgctctctggaaagtaatcctgttgtccttcatttcagcaaacgcggggtcaaagagggatggtcccggccctgtccccatgcccagccccgtttctgcgcaccgtccctccctgcctagctgatctctgaccctcggctcttgtgcttcctgctacaggatccctgctgggcaccaacagctccaccatggggctggcctggggactaggcgtcctgttcytgatgcatgtgtgtggcaccaaccgcattccaggtgagtttgtgtggcacctttaggggaaggagggacaaggaagaggtgctggctatcccaggtgtgcccyctcacgtgctgtcctctccctcttgagcctgactggacatcaggacgcagcttcactctgatcctggtatttattcacctctttcagtggttgccaggagttttcaccccaaccctttgtctccacccctaaggactcagccccctactgctggtcccagcctagaaagctcactttgtgttctctcctgtctaacagagkctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccaggtgaggcttcttctctgagccctgctccgtgggatcatctgctagacaggtgacctgccaggagggctacaggaaatcctgtctgtaaactaacgcagcagttctcagattttaggcagcatgagcatcacctggagggcttgtgaaagctcaccctgctgcaccccagccccagagtctgggattctgtaaaactgcaactctaacaagtaccaggtgatgctgatgccggtggtctgggaagcacactttgaaaactactcaaggaaacaagaaatggttttcctttagcagtcagcctgttcaagccttagatactccttaggctcttaagaaaagagcttatttcaaatgcattcccccaattttaatcttgtttgaaatggatactttctatgggcagaatcagtaccactttgctattggattyctcatggggatgcagctggtctcacataaaaggttaaaatagcagttagttgttgctgttacagcttcatctgtgccttaacttctagatctttgcaacggtggctttgaactcccacatttaactctttgacactggaaagtgtcattatatcctctaggcttaggatcagattccatttcctgtgtacccaagtaggctgataactgaattctttgtaaaatactcaagacttggcagaagtcacaattaagattttgaagttgtttggcgattaatgttgctgtgttattttgacatagtgatcttaagacagctctttgaagcttttagaacatctattgtatgcttttcctagcatacagacagtctcccccaaccccatccccaccccgctctgcattctacaagtaatgtgtgtcctctgcccacagggggtgctgcagaatgtgaggtttgtctttggaaccacaccagaagacatcctcaggaacaaaggctgctccagctgtgagtacccctctatttttagggcacatagggaatcagggggaattccaccaaaaacaaactgaggaatttagcaatagtggttatacataaattacccccagtgagatcatcaagaggcatacagaagtgactccaaggggtattatacacacacacgtatacacacgtgcgcatacacgcaacccctctacctgcatccttcacaccaaatgaaacgtcttctaccactaagaactcaagaggctggttggtaagagtatctatttgaagttttcattttgtttcttgccagctaccagtgtcctcctcacccttgacaacaacgtggtgaatggttccagccctgccatccgcactaactacattggccacaagacaaaggacttgcaagccatctgcggcatctcctgtgatgarctgtccagcatggtcctggaactcaggggcctgcgcaccattgtgaccacgctgcaggacagcatccgcaaagtggtcagtggcctctgcacccagccygttagcatgaaccctggaaggtttatcgcagatggtcccaaatgactgaaaatgcggggggacactaatgatattctctcccatttagactgaagagaacaaagagttggccaatgagctgaggcggcctcccctatgctatcacaacggagttcagtacagaaataacgaggaatggactgttgatagctgcactgagtgtcactgtcaggtaagggaccttcaccagccagaataagaatcgacggcttttgtttgaacctacatctttggggaaataccctaatcgccacagagattctttttatgttccatggcctgataacaaagtgttttttttttctttaagatgcaattatggcatctataagttcttctttaaactctcagatggtttatcaaagtattaattataccccaggctaagtatctaagagaatgaatctactaagacatctgaataatttacctaccttagttcaaagactaagtgttgaatgtcaggtaaataaaacctggttggaacattcatttttttttcccaaccctgatttatattcagctttggcataggttcttttagtacagtagcaattgtttttcaaatcacttagtctgacactgttaggatgttactgtctgctttgctcagatggcactgccaggtgtgtgattcactctagcatccccgcatgccagtggccagtgagtttggaggttcacctggcttatctattaatagcaaagtatttgaatttgcttaaatacaaatcacagatgactggctgtgggaaccaacttcattaaattccctttcttttccaatataaagacagatcacagatctatagatgaggaaaaagtgcttatagatcttccttcctccccccaaacacataatataaaaatgtaaaagtcctggctgaattttctgagtttgatttcagacatagatttgacccatgatgtttgttggttcctctgctataaattctttgtactgtaacttccacccttgactaagtagcaattaaaaagaactttccaaggaatggagtgacacgtaaactagcactagaactgtctctacgatagtggtggctgcaaatatgacagagacagatctatgaaaatcattccactagagcattgacagccctgaccatgttttggcttgtaaaggaaatgttacaggatgtagacttctgtatgcaacatgctcagcagcctgttcccctctcactctcttgccctgcagaactcagttaccatctgcaaaaaggtgtcctgccccatcatgccctgctccaatgccacagttcctgatggagaatgctgtcctcgctgttggcgtaagtttctcaaatggcatagctattcttcagtgactaggtcagttctacatacatcctagacagccgagcacaacactggaaccccacccccatctccatcatgcttccattcagtttcttgctgcagcagctggttaactgacagcttatctgctgtacagagccaaaactccattatgagtacatcgtaattacccatctggattgcagtaatggcagtgaagatcttggtatagctcattaattctgattttttgctttgaggaaaagagatgaagacgtggcagcaacagctctaagttgactgcttttagaatttgaccttagtggcacagagttaagaaaaatctgctcaccagagatattgacaggcttactgtgtaagcattggcctgatcgggcctggaagttttgcccctttcatctgtagggataagagggcctaagagaatagcagcaatctgagctctagagcaccaaaagaaataaggcacgatatygttccatrgcacgttatccctggcttttgttaccagtaaaatgaatgactttgctgagacaatacttagtgtagcaggtacaagttataaaagtgattcattacaactaagataaggaagaaaacaggaaaacagcacttgcccttcacacacacagaaacacacatgcacacacacacaaacacacccttgtcacagctcagaataaccaattccatccagggatcatattagcgatattggcactgtaatggtcgtttttacatttattttctgttccgcattcacttaacatgtgcgttaaaaggaacaaagctagctggaggtagcaaagttttgaacttgaatcagggattgctaagaaaacttacaactaatgaccacagaaagtaagttctttgtcttctgtctgatacagctagatgtgattgtagccgtggtgcctgggcagatggtaaacaaacatgctgtcctcttatgacaatatgtgcagagaaggccccaaacgctggggtgagaggaacaacaaactgactaactcacggccgagttggagccagaaccaacaacagctcggctgccttcacactcatctgtcaaacacatggtgtatggctcccctgacagaaatgactcctataagcttcctcatactcgcgcattcttggaagtctgagactggaaatgcctacccagatatgttaagtcagtaaaggaaaactcatttgcaatgctgagaggagaaagaaaatcaatgaataggagagcatacactgtgggaaggctcagctgtactgagccaggcaaagcatccgattaccccactgctgtacacatcatgacctgggataaacccctgggccgttggcctaagaaatatgttgcttttcatcctgtataactgcaactttgtgccggctcatattatgttctagagagctcatgtacaccatggtgaccatagttaataatactggattgtatgcttaaaatttgctaagagagtagatcttaagtcatcaccaaaaaaagtaactgtaaratgatggagatgtgttaattagcttgacggtggtaatcacaatatatgtgtatatcaaaacatcacattatacaccttaaatgtatataatatttgtcaattatacctcagtaaagccaaaaagaaataaatatattgcttttcaccctctggcaagtggagggccctgaacagagccctctaaagaacagcttgtcctaatcatcaygtacctgatgaacctctgtttcccctgcagccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaaragatgtaagcatcttagcctctcagggacgtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctsatttgcaacttggagataataatagttcttgataagtttatcttgagcattttatttagatactgcatgtaaagcmgttagcaytgagttttggtttatggtaagcaccctgtaaatgttaggatattaacagcaacccataaaaacagcgaacttatccgttctctggtagaaaacattccatgttgacatttgggcatgtggccaggagccaatttctaccgtacactgggtttagttgccattgaccatttcctggaaatacttctgcgtgctcctgatgggagcctctatttggctgtctctaagccaaaaccatttgtgaccatcaactctgtactttagttaaacaggatggtggctggagccactggtccccrtggtcatcttgttctgtgacatgtggtgatggtgtgatcacaaggatccggctctgcaactctcccagcccccagatgaaygggaaaccctgtgaaggcgaagcgcgggagaccaaagcctgcaagaaagacgcctgccccagtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacagtcaatggaggctggggtccttggtcaccatgggacatctgttctgtcacctgtggaggaggggtacagaaacgtagtcgtctctgcaacaaycccrcaccccagtttggaggcaaggactgcgttggtgatgtaacagaaaaccagatctgcaacaagcaggactgtccaattggtgagccacgcagcccaggatgaaacgacccaggagctttkctcttttactgaatgctgcagtcagcattcgaggagattccagcttggttagtcctgagcgatttgattgctctaagatgcaggtggacaacataatcccaacaagttatcrgttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgaggtgaggaactgatggggctccgagtttctggatctaggaaagcagctaacctgtgcagtcgcttccttatggcagtgacttctaaacatgawgcacgctcttatttcctccatagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccartgagaacctggtgtgcgtggccaatgcgacttaccactgcaaaaaggtagagccaggtcctttgtgtgcctccagaaagagggcccatcaccttatcaaaacacaggctaaggaattttaaatacttaaagtttggacatgaaactgaaagattaaatctcccaaagggagaggggcactaattcctattaaaattaaatcacttggtgccaaaaacatgaacagggctagctctttttgggcaactgtgttccatagtcaactcttctgtccaaaaaaaagttcagtactctatccaaataccagcaaagyatgacttgtgttcacaacatctataaagcctagagcatttacacaaattctgtatgtatatcccccaagaaaagttttattttcttgtcttcccataaaaaaaatatgctgttactgagccaaattctgttctttttctatttggaattccaggtacactccctcgtgcatgagctcagcatgaggaaggcaactgaagcagtgatatatatcttctctttcctaggataattgccccaaccttcccaactcagggcaggaagactatgacaaggatggaattggtgatgcctgtgatgatgacgatgacaatgataaaattccagatgacagggtaaaaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacaaatgccactttgttccctagattcatttcaaatgtcacatcgaaattacagtaaaattgactttgggcacactatgaactgagatgatgggattatattctacatctcactaacttctaacccacagggatccatttttttaactatgtccttttaacttttgtagtgatcgttttacactgagtgatcaattagcctatccactaggtagaaagtattgctgattttcacagttttagacatattatgcacatggtttgaggcttgagctgttttcaaggacaacattgttaagtgctccatttcttctctttgcaggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtaaggtgctgcctgatcagagggcccgcgggagacagggacatgcacagctttccaaacgtacttctgtctagtcctggctattagtrtgcactttggtggaaacatccaaggctggagagcccagctcttatttgtcccttgttctcttcaggtatcctcaatgaacgggacaactgccagtacgtctacaatgtggaccagagagacactgatatggatggggttggagatcagtgtgacaattgccccttggaacacaatccggatcaggtaggtggatggactcctttcagagtctttcagtaaactgttggaatatccctttcatggcctttgaaaaatgagcttaacaaagttcaaacactttcattactgtggctccctggcttctcatagccaactggaatacgttcatgtaaataatttgcctgatgtgagctccttgcacagagtctcacagatctttagcatgaagatctggtaacttcagtcttaccttctgtaagaagggctactggacttgctcagcatcgtctaccattgttaagacaaattatacaaagcagacatctgtgactgacaactgtacaataatattaatcatatgtaatactaagagatggaaaaataaatgtgcataagcaaaataaccattttcatggctaatgatgtaatctagctataagaaaatcatcaaactaaggatacatccaaaaccaaagtaatttatccctgtcataaacattacccagacagtatacaacacagggaccagtggtctgtttccatcttttcaggacttttcagagaagtcgacgtgtcaacagttttacaactgaaaccttctaaggaaattctctgttataaagtatccagaaaatttcatttaacattaagatgtaaacagttaacatttcatttcatctttagtaattaaatatcactctatttgaccttatttagaaagttttatatgtaaaacatttttaaattatcccttctcagatttttatacgaaaacaaagataaaggaaaaaaacttttaaaatgtaattgctactattgctatctttctgcaggagtgtgtaaatagacatgacaccccactggctrtatcaaacaatggagaattttccctgtggtgggggcataagttatctttaacatgaatggtttatactgcaatttaccctccatttacatctctctttcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggtgagtcatgggagccactttctaagacagggactgctggcacagctgtgtagattgaagaaatgaaaccaaggctcaaagcatttgacaggatgaagggaccaaatgccaacttagacaagatagtgacatttctgacaccagtaataataatagcactttagaattttgctgaactcttgcttttttgacctcaggcgatggtcgaggtgatgcctgcaaagatgattttgaccatgacagtgtgccagacatcgatgacatctgtcctgagaatgttgacatcagtgagaccgayttccgccgattccagatgattcctctggaccccaaagggacatcccaaaatgaccctaactgggttgtacgccatcagggtaaagaactcgtccagactgtcaactgtgatcctggactcgctgtaggtgagtagcgagttcttagatcctaagagactgatgcatacrtggggaaaaacaaatataaaacctggcagttgtacctatccctgtgggtgctgaggatgtctrggaacatgatggagaaccttctgaaggctgcaggttttaacctggctctgggctcttcttccaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtaagaagcaaagccctggaacagagagagagcttatgggtgcctgactagcactggggatgctgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtctgctttatatgtgtgctcagtggcacacaacaaatatgagaggacttggaaaaattccccattgcagccctctaacttagatcagctcagtacctttcaagcattgtttctgatggaatgaaatagaaatctttacctgaaggagctgtgtttcaacctttccttttccttttccttcaggtgcgcaccctgtggcatgaccctcgtcacataggctggaaagatttcaccgcctacagatggcgtctcagccacaggccaaagacgggtttcattaggtacgatcatactgattcactttcacttacagtcacactgagggacaaaaagacaaaaagtattaaatagcattgtcactaaacaagattttttttccctgcagagtggtgatgtatgaagggaagaaaatcatggctgactcrggacccatctatgataaaacctatgctggtggtagactagggttgtttgtcttctctcaagaaatggtgttcttctctgacctgaaatacgaatgtagaggtaagagcaacatcaccatgaatgtacactggacatctctatttcagactaatatcaaggatgacggttatgggggagtccagtgtaaagactgttttggagacagggttatttctattttgcttttgaggacacaaggacaaaaatggaataatgcctaggcactgtggcttatgagttcctgagtccttagctataatattagtttgcttagcaatctctgtgctcctcatacacagtgcaaaggtaagctgcagaaaagctcctatataatttggacttcattaataatactgttctttacaattatatatttatatatcttactgcttattgttttatgcatgccatcacagcacgagttagcattcccaacttttccctgtatacaaagaagggagaggaatgttgctttcatattggcatgttaaattaatgttcactattaaacttagcattttttttcctcattcttttttacttagtcattacttaagctcgctgagtccaacactggctctaccacaaaataagtgcttaatatatatttactgggccaaggccagatacctaaaagatcaatgacagtagagaaagatggttgattttactcaaaaaaatctaaattattaatgtaatttttgagtccaaatttttaaaataagactccctaaactgttaacattgaaagcctttggaaagcataatatatgttctggaaggttcacgctgtgtcggtctcctagcatcaatgtcagctaataaaattaaatgctaatgtgcttgaacaaccttaaaattaggcttttgtcattagaaaagtagagctattcctatgtggttaacttattaactaagatgtctatgcttttatgaattagttttcatttgtatatttatttatatttgtttatttaacagatccctaatcatcaaattgttgattgaaagactgatcataaaccaatgctggtattgcaccttctggaactatgggcttgagaaaayccccaggaycacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttrggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcrttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgktttgkttttttttttttttttttttgcttttgacctcccatttttactatttgccaatacctttttctaggartgtgcttttttttgtacacatttttatccattttacattctaaagcagtgtaagttgtatattactgtttcttatgtacaaggaacaacaataaatcatatggaaatttatatttatacttactgtatccatgcttatttgttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttagaatttgctgcgtttgtggaataaaagaacaaaatgatacattagcctgccatatcaaaaacatataaaagagaaattatccctaagtcaagggcccccataagaataaaatttcttattaaggtcattagatgtcattgaatccttttcaaagtgcagtatgaaaacaaagggaaaaacactgaagcacacgcaactctcacagcgacattttctgacccacgaatgatgccttgggtgggcaacacgattgcatgttgtggagacacttcggaagtaaatgtggatgagggaggagctgtccttgcaatgttgagccaagcattacagatacctcctcttgaagaaggaataataagtttaatcaaaaaagaagactaaaaaatgtaaaatttggaaggaatccataaatgcgtgtgtgtctaaatacaaattatcatgtgaagaaaaggcccaagtgtaccaataagcagaccttgatttttggatgggctaattatgaatgtggaatactgaccagttaatttccagttttaatgaaaacagatcaaagaagaaattttatgagtaggttaaaggtctggctttgaggtctattaaacactagaaaggactggctgggtgagataaaatcttccttgttgattttcactctcattctataaatactcatctttctgagtagccatgatcacatacaaatgtaaattgccaaatcattttatagtaccaaggtgaagaagcaggaactagaaagtgttgataatagctgtggagttaggaaaactgatgtgaaggaaataattctttgaaatggcaaagaattaaataccatcattcattatcagaagagttcaacgtttgaagtgctgggagataattctaattcattcttggatagtgaagcaaaactgattgaaaataccaagataagacagaaaaagtgactggaaagaggagcttttcttccaggcatgttccagtttcaccctaagactgaccttcaaataatcaggttgtactgaaataaaggacttgttaaaaattaaaattatgtcatcgagatgatagcttttttcctcctccaacagtttwttgtcatgtgttgtgggagagctcgagtgaagagcaataaactccaggtcttataagaatgtacatacaataaaggtggtgccagcagtttttttttttctaaagagtcacatgtagaaaagcctccagtattaagctcctgaattcattccttaaataaattggctctctctctcttctataatttctttttctttttatttttgagatgaagtcttgctctgtcgcccaggctggagtgcagtgacacaatctcggctcactgcaacctctgcctccccggttcaagcaattctccctcctgcctcagcctcccaagtagctgggactacaagcgcccgccaccaagcctggctaattctgtatttttagtaaagacggggtttcaccttgttccggacaaacactaagccctaaagggaaatccaaaataaaaacatctatttttaataacactttctatctaaatcagggtgactttttaaaaaaaatccggaagctttgtgttgaattacgttacagacttagttaccagtccttgttagagttaccttcagttgacatgctgtgaatggtcccacctcttttatggcagaattcattacttaaaataactctattttcttcccccttacctaaataacagaaaggctcactatgtcccaaatatcattggcagaagcaaactataaagtcataagccctttgcagtgcaagtctagaaataattttactctgtgtttctttctgtctccctcttccctcccctttttccttcctaccctcccctcccctccctcctccttctttctctctctctctctctctctcatacatacaaacatcaaataccagaaaagcatagatttagaaagctgaactcctctgaaacgctgacggacaacactggcccctctctgccccacaacaaattctcacccatatcacctttgccctctgattcttcccacccaaaccctaaaacacagagtgtgcctcatggcattcctatgagaatctaaaatcacaacttttaacttatacttccatcccacagcaaaactcttggcatcaagataaattatacgtagcacattgacatcagcatgaacaattgctattttaaatgaacaaatagtaaactgaaatagtgtctggaaaaagaaactgcctatcaatacctctgaaaatagtagctatagaattcctcattttaaaaagtcaaggaaattccatataaacaatcattaatgttattcagtatcagtggatgaacatgtgccagcaaaaacaatgttatgtatacatcactcaaattttattaaaggcagcacaatagcccgctcattttttgattcagaaataaactggacttccaattctaatgccaactcatcttatggaatgtcaacacaaaattttctcatgaatctaagttactgacttgtaactaaaccatctctcttcaaatagtaccgcagactgtcttttaaagtagctcatctttatttgatgcaatctaaaaggcccaaactctgaaagaaaataagaaactattgttaactattattaacaaagtaatatatcaaataattcactcaaactcctacttaagaaacgtgtcatcaccaataagatagtaaaggctcttctaatattgctttgttgagacaattcatttcatcttatggcaggttgtaccagtttcacagacatgagacaagtgggaagaaggaaaagcagggccacagcaaaaattcccagtgaccaccatgatctgtctgaatcacagtagaggtgaaacatacaaaattgaatacaggacaatcacagcacttcaacgagttttaccctaacacgtatacattaaaatgttggtttttataatgaatcctaatactgtaagattagcaataaatttataaacaatggtcccagaaattttaatgagcaaaaaccactgaacaattacaccccaagtctcaaaaatatcaaggaaatataatccacaaagagcgactccaaatgtcaaaatcaataaagaatagtctctgcagtgcattcattgaattcaaataattcaataagaaatttaatttaacttcattaccaactttctgaaaagcacacccagcaagtccttgattagggttctttacattcttctgctgcatctttagtctcctgctcatctgcacataaaaacaataaccacagttattagagattcagaaatgtatgcataattaagaaaaacaactcagcctataaaatattaaatccctttacacatgaggcaataatcacactctcatttaatacttactgaacagtcaccacgagctgcagacaaagtttacgagaaaaatagaaagatcagggcgcctactctcattgagcttacagctcagggagaacactacaggttttggagctaaaatgattatggatgtggagacacacacagaagttaatattttgctttctactaagtttctgggaagtacagtgagaccaaaagtaaatgttatatgtagaatagataagagctgatcgcctttcatttcttgaagtgagaaaaaaaattgtgacattaacagaaaaggaatggaaatatttttctacccttggtgagaaggttatcagaaaatgcagaattgacaatagaactaaattttaaaaagacaaagagaaacaggagaaactggaaccttcatgcacgactggcaggaatggaaaatggtgcagtagctttagaaacagtctggcagttcctgagaaggttaccatagacctggcaattccacttctaggtataagcccaagagaaatgaaagcatacatccatacaaaaacttgtacacaagcgttcatatcaacattatatgtaatagccaaaaagtggaaacaacccaaatgtccatcaaatgatgaatggataagcaaaatgtgatatatccatataattgagacttattcaacaatagaaaagagtggagtatggatacatgctacaacatggatgaatcttgaagacataatgtaagaagccagtcacaaaaggccatatgccgtatgattccatttatatgaaatgttcagactaggcaaattcacagagacagaaagactggtgattgcctagggctggggttggggaaaatgggaagtgattactaatacccaaaatgttgcgttgtcgggggtggaaaaaataaaaaattgatagtggtgatggaggtacaactctgtaaatatactacaaacaattgaattgcacacttttaatgggatgaattgtaggaagctggtgaacagtggctccccaaaactcacatcctcatccctgcaacctgtgaaaggggtctttctagatgcaattaaattaagcttctcgagataagaagatcatcctggattctctgggtgggccctatattcaataagaagtgttgttatacaaaaaagacagagggagattaacacacacagatggagggaggcaatgtgaagacggaggcagagactggagtgacgtggccacaaagccaggaatgcccatagccaggagaagctggaagaagcatggaagcgttctagcgttctctcctagggcctccaggtggcgtgtggccttggtgacaccttgatttcaaacttctggcctccaaaactgtgagagaataaatttctgtcatggtaagttgttgtgacaaccataggaaactaatacaaatatatgaattatatctcaataaagttcttattaaaaaaagactcaaccttgtaatgaagggcagatgacttgcagtttcagagcaaagtgataaatgtagtggtactgtcaacacatggagaagaaatattaaacaggatgtagaggcaggtgggatgaatgaaaagtggatcacaatacccccatgcatgaggtgggagatgatgggacataattccacgccttcgtaagtgctattctctcactatggagtgttctttttgcccacccagcaaataaccattcatccttggaggcacaacttaaatgccacctcccatccctctatagtgttgtctatgtactttgtcctgaagctcttactatgtttgtcccaccctactgtaattaagtgtctgtctttaggcacttaaaaattttcatcaatagaactagattgagtaacaaaaaatttttcatcaatatacctagaacaacggtcctcaactgggggaaattttgcccccaaagaacattttttgcaatgtctggagacatgtttgtctgtcataactgcagaggacactactgacatcaagtcagtaaaagccagggattccattaaacacccgacaatgcacaagacagcccttcaaatgtccaactcaaaatgctaacagtgctgaggtgaaaaactcttggaacttagaaaagcatctaatacacaggagaatctcatgaaatgtttgtggggtaaatcgatgaatgaatggatggcagatggatgatgaatgaatagcatggagccttggggttttaaagcatggctgcacagcagaatcacccagaccctgatctcagaaactgacttaaatgactgctgccagaacccacccctagaaattgacttaattcatctgggatggaaccaagctgctaatctgttttaaatctcaccaggtgattctaacatgcagccagaggtaagaggcagcactggctaaggaacagactcagtatagcttaaatgccaggccggctcaaggcagacggaagtagagagactgggcaatcaaaagtatgcaaagcatagatagttccatactggttatatgtgtctccaaacaaaatattaacgaagaaaga

SEQ ID NO: 17613 - DNA, 159138 bp, Homo sapiens
  misc_feature (1)...(159138): n = A,T,C or G, or insertion/deletion polymorphism (see Tables 1-2)
attgatgaggagagcaagtagaaatgaaaagagaaaaccagtattaggagatctataaagaaacaatagtcagaaaaagagtggttaaagaggcagaagaatcagaagagaaccagattcatgaaataaaagagaggaatcagtttcaggaaggaaagtgtggtcagtagtgtcaaataccagagactgaatagcctaaggatttaaaagaggtcaacagcaccaccaattaagcggtttttctgagcttaagatatttttctttatttttctatgttaaaaatattttataaagaaaaagaaaaaaagagatcacatttgcccccccaacccgtccctggcctctctctctctaaggaagtcgttaatgaatttgggcagaatagattcagagctgtgagagtgaaaatttgactgcagtgggtgaggtgttaataaaagggagggggtagagatgaaatctttccagcagtttggctcttaaggggatagcttgaaggaaagagggttggaagggtggtttttaaaaagaattatcactcactaatcaactagaaatccagtggaatatgcagtacttgtctgtaatccagcaggctaacttttttttttttttttttttgagacggagtctcgctctgtcacccaggctggagtgcagtggcatgatcttggcttaccgcaacctctgcctcccagttcaagcaattctcttgcctcagcctcccaagtagctggaactacaggcatgcaccaccatgcatggctaaattttttttgaatttttagtagagatgagtttcaccatgttggtcaggctggtctcaaattcctgacctcaagtgatcacccgcctcaacctcccaaagtgctgggattacaggccagagccacagtgcccagccaaggctaacctcttgatcccaatgacaaacagaacaaacatcttactcaagtccagaagcaataataattttgaatcttgcttgcatgtcaacaggagccacattaatacagaagaggatcacattggtccaattaaattgaattgattgagagcctctgcaatacacggtctactgcacaaataatgatggttcctggtacatttttatttgaccattgattgctcgatttgtttctgtgtctaactgtgtattggaattaagctgactcaatttgaactgcaggtccttttatccctcttattttttatttatttatttattttattttaaggcatttctcactctccagaaaatctctaagatttcagctattaggcatttgtctttttttttttttttttttttttttttgagactgagtcttgctgggttgcccaggctggaatgcagtgtcacaatctcggctcatcacaacctccacctccctgattcaagtgattctcctgcctcagactcccgagtagctgtgactataggtgcaaaccaccacgcccagctaatttttgtatttttagtagagacaggttttcactatgttggccaagctggtctcaaactcctaacctcaagtgatctgcccgccttggcctcccaaagtgctgggattataggcatgagccaccgtgccccaccaggtcttcttaatcataacaaattcatcttaaaacatcattttaaaatatattattttttattcttcattgacttcctgcattactctattttttcagagtttctagcaaccagtatcattggtattttaaacaatgtgtacatgtacatttatgcagatgagttaacatatatcaaagcaacctccaaacaatgccatttaggtaatctccaatttaaaagcctcaatagaatgataagattgagcttttctgtagttccatgacctccagcagagtctgcaaggccacagctgcctgaagrttgattctgtaattagaagatgccagggtcatctcagaatagaacctcaagccacccaggctacatttacagaatcagcctctccagaaaaacagcaacaaaggagggccttcctatgtatttggaaggagtcacctagaggagggacttggggttttggtgttggtgtggggggcagggatgggatggggagggggaagcttattgaaatatactaaaagacaaaccaacctaagggctggagggaagaaaattcacacttgtaagcttctttttcaaggggcatctcttaggctctagcttttgagattcagtatatatatatttttgagtcttgctctgctggagtgcagtggtgtgatctgggctcactgcaagttctgcctctcaggttcacaccattcttctgcctcagcctcccgagcagctgggactacaggcgcctgccaccatgcccagctaattttttgtatttttagtagagacggggtttcaccctgttagccaggatggtctcgatctcctgatctcatgatccgcccgcctcggcctcccaaaatgctgggattacaggcgtgagccaccgcgcccggcccagtatttttgttttatgaagatattacatttgtaaagtatgagcttggtgtcagcaaacttatatccctgtgtacaaactggccgaatcacttagccactttgggccaaatcacttagctcttctaacagtaagaaatcaacaagaaaaataaacatttcaaacattacaatgtgttcatgtattcactgtgggggatgaccagattctcgaaaccacaggttgttcttagtgaaacaagtttgggttggggccatagacttgtgtatttagaatcaatggctgttctctctctgggactttgatttttttcttgggctcatcccctttttgtagtatcttatctttgtcttatttgtataggacttaactgttcccattcccttattagagcaatctaagtgattaccttcataccttttggaattatatgcttcaaaattccaaaaagaatgattttgggctgggcacagtggctcacacctataattccagcactttgagaggctgaggtggatcgcctgaggtcaggagtttgagaccaacctggccaacatagtgaaaccccgtctctactaaaaaatataaaaaattagccgggcatggtggcaggtgcctgtaatctcagctactcgggaggtggaggttgcaatgagcccagatcgcaccattgcactccagcctgggcaacaaaaggtgaaactccatctcaattaaaaaaaaaataatgattttggtggtcgacttcaaataggtaggagaagaaggagagaggagatggagggtcagggagatctaattactctctaaaatcatgctaggaaagataacaccttttaataacactctctgcttttataacatcattctgccaaggagctcaaaggtttcaacaaagttcactttcagaaaacccctttgaggaagacagaatatacatcttctctccattttaaagatgaagaaacaggccgggcacaatggctaatgcctgtaatcccagcactttgggaggctgaggccagaggatcgcttgagctccagagtttgagaccagcctggataacatggcaaaaccctgtctctacaaaaaaaatacgaaaattagatgggtgtggtggcatgcacctgtggtcccagctacttgggaggctaaggtgggaggatcgcttgagcccagggagtcaagtctacactgagccatgattggatcactgcactccagcctgggtagacagagcaagaccctgtctcaaaaaaaagaaatgaaagagaaagaaagaaagaggagaggagaggagatgaggggaggggaggggagsagggagggggggaggaaggaaggaaggaaggaaggaaaaaaagatgaaaaaagaaaaaaacaagatgaaacagaggcagaaagactttacgtaaattgctcatcatgtggttgtcaagtttgaccccaaaacccaatttattgaccaaggttattctttgactgaggcaagggggtccgctctcctgggccttgggctttagaaagctcatctctggcctttctgagatccatccctttctttttatttttcttgacacggagtcttgctctgtcactcaggctggagtgcagtggcatgatctcgactcactgtaacctctgcctcccgggttcaagcgattctcctgcctcagcctcctgagataacaggcgctcgccaccacatctggctaatttttgtatttttagtaaagactgggtttcatcatgttggccaggttggtttcgaactcctgacctgaggtgagctgcccaccttggcctcccaaagtgctgggattacaggcatgagccactgcgcccagctcagatccatccctttctaagggcaaacagtccatggtgcaaaggggccatgccacccagagttatgagtacctgggactccagaattccttgcctggtggcctccacatgcacttccagggcctgcttgggcctcttctatgggtctgtcctgagtgttgatagaaccactgatgtgagtacctgggcttgagccgtggcctggagatcctgttgactgtagcatggagggggcttgtgcagctgaatgtctgcatgcaggtggtgggagttctggaatatgatggagctggaggtgggaagagaagtaggcttggggcagctctctcatgccacctcattctggccaaaactcaggtcaaactgtgaagagtctaaatgtgaatctgcccttcaaggtggctacaaaggtatctttgtcaaggtaggagaccttgtggcctccacgtgcacttccagggcctgcttgggcctcttctacgggtctgtcctgagtcttctatgaatctgcccttcagggcagattcatatttagactcttcacagtttgacctgagttttggccagaataaggtgacatttagtttgttggcttgatggatgacttaaatatttagacatggtgtgtaggcctgcattcctactcttgcctttttttttgcccctccagtgttttgggtagttttgctcccctacagccaaaggcaaacagagaagttggaggtctggagtggctacataattttacacgactgcaattctctggctgcacttcacaaatgtatacaaactaaatacaagtcctgtgtttttatcacagggaggctgatcaatataatgaaattaaaagggggctggtccatattgttctgtgtttttgtttgttkgttttgyttgtttctttttttgtttttgtggcctccttcctctcaatttatgaagagaagcagtaagatgttcctctcgggtcctctgagggacctggggagctcaggctgggaatctccaaggcagtaggtcgcctatcaaaaatcaaagtccaggtttgtggggggaaaacaaaagcagcccattacccagaggactgtctgccttcccctcaccccagcctaggcctttgaaaggaaacaaaagacaagacaaaatgattggcgtcctgagggagattcagcctagagctctctctcccccaatccctccctccggctgaggaaactaacaaaggaaaaaaaaattgcggaaagcaggatttagaggaagcaaattccactggtgcccttggctgccgggaacgtggactagagagtctgcggcgcagccccgagcccagcgcttcccgcgcgtcttaggctggcgggcccgggcgggggaagggcacgcagaccgcggaccctaagacacctgctgtaccctccacccccaccccaccccacccacctccccccaactccctagatgtgtcgtgggcggctgaacgtcgcccgtttaaggggcgggccccggctccacgtgctttctgctgagtgactgaactacataaacagaggccgggaasggggcggggaggagggagagcacaggctttgaccgatagtaacctctgcgctcggtgcagccgaatctataaaaggaactagtcycggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacaggtaagaggctctccagtgacttacttgggcgttattgttttgtttcgaggccaaggaggcttcgggaagtgctcggtttcggggactttgayccggagccccacatccccaccacttgcaactcagatgggaccggaggcggtgttaaatggggagackatgtcctagtacgagctctggtgaccccaggactctgcgctgctgcgcttggggcttgcccgacggtggagaccggggagcatctctgggcgtggagacccgggcgcagtaccccgggctcagaggggtcgggggttcccgggcgtgctgagggcgctgctgccgggtggggagagctgcaggtccggcaccgagcgctgctttgttcggagggccctgagctggctagaaacccttctggttgcaggtcggccagtacctacggagacaaatgccagcactgagtcttcactcggttcttaagaagctggtctgttctgacctgggaattggctatatgctccccsggactggagcggcacagtcccggactgtgaatccgggaactcgagttggaggtgtcccaaacggtccgtggtgctattgctcactagaggccttgggtctttgtttgacctgaggggtagggaggtcctgcctacagtctccgtgcgctcagctgagctggtgtccctggcgcagagcgcggacgagttttgtttccttttctttttyttttttttctttcctttaagtctcggtctgtcgcccaggctggagtgcaatggaacgatctccgctcactgcaacctccgcctcccgggttcaagcgattctcctgcctcagcctcctgagtagctgggattacaggcgcgtcaccacatccagctaatttttgtatttttagtagagacggggtttcaacttgttggccaggctggtctcgaaccctcgacctcaggtgatccaccggcctcggcctcccmaagtgctgggattataggcgtgagccaccgcgcgcggccgagttttgtttcttttaaaaacaagacttaggagagcctgcggagacccggaggtggggtgcccaatcctccctctcccacgttccctgcagccccatcttccagaccgttgctgctggtctctcggggcagcttctgcctgggcgcagatggggaagctgggccgaggtggtgccgtggaatgaccgggagtaaccccggcgggcggcgcagaactcggagctccgccgcggggctgggctgggctctgccgtgagggtgggggtgctgggcgcgcgggctgcggtggcccccggagactggcccgcagcgcctcctggccggaggacctaggaatcggccggctctactaggtgtctttgctcgcggttccgactgtgaatccggtgaagaccggtggttgcagacggggaggaactatgaggttgaggcgaaagcccgttttgtttttttttttttgtttttttggttttttttttgttagcgtgtttgccaactcccaggccattggtaaagcaggaaggttcttggggcggcggacggtgccagggttatgtgtaggtgcctctttaggtatatcktttatcaaaaagaagcaaagaaataagattaaaaataaacaaagaaaaaagttgtctggcactggcagtaattggcctgcctttgcagcactgataccattagcttttaaaatccgacttttcattgacacttcaagaagagaatgggtagtatatacacattcatctcatagtggacaaatttcatatttaaaaaaaccttctgggtactgaaatcagcaagtcacttgccctccatggccgaatccctgcttcccacgaagagaacctcacaaaaatttcccccaagttaaagagtggaattttcttgatttttttttcttttttttttaacggccgtagtttagaacccagacttaaattatgatcttcttttcaaacaaaacttaaagtccttaagttttcatctccccttttatttcaacctattcttctcatacctaccacaaaaataatggaggctttctgttgagaaactttccgtttctgttgagagtatcattctcttgagaaactttctcctaaatcagagaaagtatggaagcatggaaagtattcctgagtagaacytctacagatattacaatatttttcaaatacaaagtttccattgtcagcctgtttcccaagtgcttccacaaaccattaaataattccacaaaccattaaaataattaatgctagggaattttaggaaaacattggtttacaatcagaaggacmggggaagtgggtcttcagccttcacgatgactacaagccatttaagggactagaattgctactgttgtcagagcaatttaggagtctgtatttgagcacccgcatagtgttccagaatgacatatctgactgtaacctggacacgtgtgatatgttgtctcccctgcagatgagcatttgaaatctcaaccctcrtatttctacgagwgcaggcctataatggaccctgggcacattttttttttttttgagatgcagtctcgctctgtttcccargctggagtgcagtggcacgatatggctcactgcaacctccacctcctgggttcaagagattctcctgcctcagcctcctgagtagctgggactataggcgcacgccaccatgcctggctagtttttgcattttyagtagagacagagtttcaccatgttggccaggatggtctcgatttcctgacctcttgatccacccgcctcrgcctcccaaagtgctgggattacaggcgtgaggcaccgcgcccgacccctggacacattttgacttagaacatattttcggtttgtgtgagacagtgcattagtgcaggattggaaaagagtgatcaggaattgattgttttcaaggattggttccttctgctcaaggaagtcccattgtaaacataaaaaaatgaatgaaactgaagaagttcagtgacttagctttttaktatcttctgtagtacttacctttttggagaggagttggttgggatatttttccatttaaattttttttttaaagggatcttctctcccrtaagccgggatacttaagctatatatgtagtggctacaaattaaggtcttcactgttttcatttttagctsctagaataagtgaacattaccttagatagactcttctaattatgaagatatctagatgtctagaaaatatcaaaatgcatgtggtttttgcatttctaaaatacttttaaaaccaaatactttttyttttttttttttttctgagatggagtcttgctcttttgcctaggctggagcgcagtagaatgatcttggctcactgcaacttccgcctctcaggttcaggtgattctcctgcctcaacctcctgagtagctgggattacaggtgcgtgccaccayacccggctagtttttgtgtttttagtagggacagggtttcaccatgttggccaggctggtctcaagctcctgacctcaagtgatctgccagcctcagcctcccaaagtgctgggattacaggcatgagccaccacacctggcctcaaatacatttttttaagtatccagatattaaataaataataccattatagtagttgttatggtcatttactctagcatcaaatgttaaaagatcattctgaacacttgttttgtttatgctgagagaaggcctactccaaaaaatgcaaccatcttcgtatctgcatgtggatacaaccatgaatggccaaagttattgcartgttgaatagacacttatatagcactgtgtggcaagtactgtttgaaatgtttttcacgtgtttattcattgtatttattttgagatagggtcttgctctgttgcacagggtrgagtgcagctgcacagacaaggctcactgcaacctcagcctcctgcgctcrcgtgatcctcatacatcagcctcttaaggagctggggccacaggcacgcaccactgctcctggctaaatttttacaattttttgtaaagacaaggtctcactatcttgcycagactggtcttgaactcctgggctcaagtgatcctcccacatcagcctcccaaagtgctgggattacaggcataagccactgtgcaggtcatcaaatgctaattgaattttcacaacaaaaccatttattgtccctagtttacaagattaagtaaatgagaagctaatttttctctggctatataccttgcaagaggcagagctaagacttgaacccagccagagttctttaactccagcactaacatttcagctgctgcaaccagggagcttttcaaggatgatcaccacattctctacattcatctgctataatccttatcagaatctacagcctgtatcatattttccttgttgctgtgagtgggtcagccaaattctctttaacttgaaaccttggttgcgtagggattgcaacatcctggaaagaatagaataaaatttactcaactcaattttttacttggttcataatgaaaactatactattgcttcagtcagatgtttgcgaatagctgtgtgatctcaaaatgttttcctatgtgatctatakaaaatggaatgatagagtattaggctgtaagggcmtaagaaacaaaggaaaaagagaagtgaactgttagtttagttgtaaaacctaactttggtgaattgtaaaaatttgttataatacaatatgattcttgcttgtcctgtccttgatgaagttgtggaccttttgaaataagctatttctctgttactgctgttactgtttagaaatcaaatttagttttttcttaagatatacgtatttttggaagataaacacagtttcaaagtctgccttgttggctgggtgcactggctcattgttgtattcccagcactttgggaggccaaagcaggaggatcacttgaggtcaggagttcaagaccagcctggcaaatatggtgaaaccccgtctctactaacaatacaaaaattagctgggcgtggtggtgggtgcttgtaatcccagctactgggattgggaggctgaagtagaagaattgcttgaacctgggaggcggaggttgcactgagtcgagatcgtgccactttactccaacctgggcgacagagtgagactccgtcttgaaaaaaaatgtctgccttgtaaaagtgaaataggatgagaaagtgcctttcttattaattggtgtaatgaattagaaataaactctttgaagacacctcttggtaaaaatagttacatttactgttgatttatggtatgttggatatgtttttaagttttccgtgtaataactcagttcattctcatgagtgaaataggtgcttttattgtctttatagatgggaaactgaggtataggcaggctaggtacattattatggagttcgtaagtagtggagctgaagtcgcatcccagacagtttggcttccgtgagtttaccaatctcatggtaaagactttgtcagactatcaaagttttgacaaatgaaatattagcaaaaggccaaaagggattctctattttcatttgagtatcttcacctgaaaatagttgcctgaataagtagcctgcatagaaaggtacattttagaaatacttgaggccagagaatgaaaagcttacataaaattgatttccggtggggccttcagttactctccattctacgaagaccacaaatagcattcaggcaaagagcatttattccaacaatggaggagcaytggatttggttcctaaaacaaaataaagtttgaaatcctgtctttcccatgttgaaaacaaagttggtacaaaaccctttagctttkgcaaacctcctttaagacccgatttaaatgcytccctcctcrtgaagctcttctggatccactcyttcccatcactaagttgaaagtmagatccccttctctttacttccattagacttggattacagcactctttgtatcatgtatttaattctgttttttaattacagttaacatttatttgtcttcctcttgagtgtatgcttctctagaggaaggtctttgattcattctcccctggccttaattcatcccacttaatatggaaaaaatttaataaatgctgacttgaataagtccaacaaggagaatgggaagctcatgtttgcttcctgtcttctaaaagactacttaagataacagggtaatcacagaaaagcattagaaatagagttatatgagaaacaactgtagttaaggctaggtttatgttagactgagaaattttagtgcatacttaagttatttaggccaggttactttttgtagaacaaacatttcagtttcgctcagtttcatttccgtttctgaggcagctgtgatttaagaaaatgctctagtctgtggcattccatattcaagtactttgagttgtatattaatttatttttgttaataagagtgasatgactcactaagtaatttagagatttaaacacttttttaaaaaacagtaacttcatatgcattggatctattcttctataaagtcttttcttggggggtgtttgtttaaaattccccggtgttttctctgccaaatccaacttccaagaagcatttggaagtcaaaacattttatctggttagtcttaaagtccagatattttgtgatagctggtatttagtttatgatatttcccaggaagaactttttagtagttgaaccatttatgaaagacttccttgaagctaccttagagagttgatttagttcttcctaaataagtaaatagaatattagtattaggacatcttggagtatagatgcaaatattggtgaaaaagaacatggatatcagagtcaaattaatgtagattggaattctggttattactaatggatatctgacattaggcaagttgctgatcactctttgcctcagtttcatcatctgtaaaataggtatttgtgtttgtgtataatgtgaaccgtataatataatgcttggcctatagtgaaatttattcatacgmgtgttttcagtgattttaaaagcttgctttaggccgggcgcgatggcttctgcctataattccagcactttgggaggccaaggtgggcggatcatgaggtcaggagttcgagaccagcctgaccagcatggtgaaaccccgtctctactaaaaatacaaaaattagctgggcgtggtggtgcaagcctgtaatcccagctactcaggaggcttaggcagaagaatcgcttgaacccrggaggcagagattgcagtgagccgagatggtgccactgcacagagcgagactccatctcaaaaaaacaaaacaaaacaaaacaaaaatcttgctttatagtttacttccacatcaaattgtctttatcccatgttacttgcattgatatcccagacatgaaaagaaaaaaagatgataacaatgacagttattaaattaggttccactcttattctagatcaccaattcatattactattcagacttggaacattaaattttagttaaactttttttcaaatatgcatataattgtcagtggttactatattttggggaagagattgttgacttctttgaagaaagatacggattttctcttcagaaraaatacacatgggctcatataatccaaattttatgtgtaattacagggtgttcatgaatgcccacaaatccattaagccatgtgaccttggacaagtcattttacttttctgttttttaggttgttggtctgtaaaatgatactacttgacttttaaagagcccttcaagctcttatgtcctctaaccccaggtctgtattcagaagaaggggtggtcctttaattagagccatctagagatctgaggaacatgctgggcattagtgtaacataccatgtggattttgagaggtaaagaaaaaataaccagggaatgcctcagagcattcctgatcagatcgatgacagaagaaaggaatgagagggaggagaggaagctgttgaaatttcctatttacctgctttgagtgaatgaagatttgaatcatagaaccagaaggggttctcatctgaaatgcaaaggaaggaggagttggtttaattcaataagtttcagttgagtaaacatgatttagtgagayactgttcttgcttctgactcaycatttggaaaatctctctaaaataaaattggactctccatctcggacatcattttgggtgtaggttttgcttttttttttgagatggagtctcgttatgttgcccaggctggagtgcagtggcgcaatctcggctcactgcaacttccgcctcccagattcaagcagttctcctgcctcaacctcctgagtagctgggactacaggcgtrtgccaccatgtccggctaatttttgtatttttttaatagagacggggttttactatggtggctaggctgktcttkaactcctgaccttgtgatctgcccaccttggcttcccagagtgctgggattacagatgtgagccacagtgcccggcctaagttttacttcttataatggactcctgttaagccaataggtgatgaaaggaaaccataaccaactcttcaggctcattcatccttcaagaatagcatgctagtacccatcctaggaggagaattggactatacctcatgaggatagtttgaagtatctcagaagaccctcactgggggtaggtcggtaagacacaaagctttctaaagcactgtaccaaatttgttgtttgagagatcataacaaattagaagtggaaagaagaaggagtaaaaggaagaagaggtttctggccaggagcagggagggggaaggagctgctaggaagatgtttggttgtcatatccctgttcacccttgctttgcaaaattcttgtaggatgccaggttgggagtaattgtttttcacaagagtcaaaccacgcttgttttcttgaagaagcaagtctttggagggtggtggcttgaaatctgttggatctggtatttaggtgatacactttgacataaaggcaacactgatgcaagcagcagctttccttggaaaggcagggagaaagtgaaggcccagactgatgagcttacactgacctgcagacccttctccattcccaggcatgtttggtggcagagtttaccttagttggggttaggctgttgtctggtactgtgagagagaaggaagaagaagataygatattaacaacaacaatacatatttatatttgaaaattaaatgcactaatacacctatagtgctattaaacaaatttatttgttcagcaaatgtttgttaaacaccatgtactgtggaaagtactaggtgctggacagaggtcaaaagacttttaagaatctgccaccattaatgatctctttctgcttggcattcaaggctctttgaaataagactgtgacscactttgatagttttgtcctggattataagacacatgctcgaaggaactatagctggttttctcaccagactgattaacatatagtatggtttggtacctgttaaatgagtctctctctacaggttttcatcttctaytttaagaaccccttcctggcattgtttggctcctcattgttctggaatctcatgtccatctcatgtatttgccttggttcacacttgatcttctrctcatattcctcacctactgaaattttacccatcaaccagaccgtgggtgatggaacacagcatgggctagttcttcttatatatgatctcatttaattttcwctggaactctgagataggtagcatttcagcccactcaagttgactcaaatttttgtaatcatcaatatattttaaaataactttatatttgacctgtaattggaaaaccaatatgagttatcataaatgaaaggtaattttaaaaataattaggatgaagacaaattatttttctcacagtctatgtataagataaactattggttcccaaaggccccagctgacaatgagacttctcttactttgttgaaaagggaattagcaagcattaaagaggtgtcaaaaagaagactaaacaaaagcttactcctttttttttttgagacgagtcttgctctgttgcccaggctggagtgcagtggcaccacctcggctcactgcaacctcttcctcctgggttcaagcgattctcctgcctcagcctccctagtagctgggattacaggtgcatgccaccacacccggctaatttttgtatttttagcagagatggggtttcgtcatgtyggccaggctggtctccaactcctgacctcaggtgatccacccacctcggcctcccaaagtgctagaatcacaggtgtgagccgccgcacccggccgcttactccttaatgtactaagaatgttatatataggctgaagaagtgctgaaaagaaccatattttctcatgatgtggttcaatgtttaatactgtgcttgttcatctcctaaaatcctctgaatatcacttaaattcatcctgtgtaactctcccacatttggggaaatactgagcttgcctattattatattagccccatatttcagatgatgcacctgagccgaggagaagttaaataacttgttcatggttccatatttggctaatggcagagccagggattcaaactcttgtctctctgactcccaggtttgtgcttttcccacttggctgaatttctcatgctacctcctccataacacctttcctagaacttttaaggaatgcttcccctgttctctcatagcattttaatgtaagttgccaaagtgtcccagtttgcacccctaccagcaatgtgggagaaaatagcaacatatttttgatgttggggtctagtgttacggtttcttctgctctttgggatgtatattccatggcwactgaatacccaagtcccaaacagttttcttagactcagaaggtcatccacttcagcttcttcatcaaaaagacatattttctggctgggcacggtggctcacacctgtaatcacagcactttgggaggtggaggcaggagaattgcttgaacccaggaggctgaagttgcagtgagcccagatcgtgccactgccctccagcctgggtgacagagcgaaactctgtgtcaagaaacaaaaaaaaggacttgttttctgttccattacccacagtggtagaatggcgtgctaaatttattctccagctgccattaactgcaaattaaaatcttagtctcttgcctctttaatccaggcttcttcatactataccagaatttaggataactattacagtgccctttataggaragaaagaagaaattgtgtctgtagatgtctgttcctttcagcttaaaatggacactgaaatgttaaatattggactggcctcatttatttctcctgtctgttggtccaatttgaatcttaaggcgtctttcaactggaattttttgtttctctcaactaaaaattgttctttgtaagtttgaatcagaacaaaatcctgaatgttgagggtttcctaaaggctgtttctttatgcaaaagcctgaaacccgatgttgatgttggctgcttaaaattaactgtgaatcaaggcagggtttttatttttattttttttttactttaatgattgtgttaattatagtgaaaaccttgagttcacgagaaagaaagcctttggtcaagtattgtttattaagttgtcagtcttgttgcaggatttgcaaatttagtggaattagtgccatttttcagtttacaattccagtcacatttcacatgatcagagcatggctttcttctctgtggagcaaatagagggctgtctgacacttggttccagtggcttccattaagcagagtggatatgtccctggagtctgcagagaagggcatggcactctgaccccagatggcactccgttttgggacattgtccaattctagttcatagcatatgtgaccaacaccagctctcacctgatgtaaacacttagcgcgttgttgcttgggggattggattgtgtgaatttttcaaaactacagttgacagaaggaggctaccaaaaatgaaacccaataattccatttttgggaattattcccacttttgttccatttttcccactttgttctttggcacacagaatgtttgatttgtgaaaatcttaataacagtagttttttctataaggaacactcagaatcttgataatattggaataatacagatccttttgtaggatcctctcagacctcatataatagagttcatgtagtcaatatttaaagaaaaacacccttaagtttttgtttttcagaatcacaagtaagtggatttaaacttgtgatcttattcccctttcttctcttaatttagtgaggcagccagcgagagggtttgttttggttattctaaagaaggagtttgcttgtaagttttggagggcaagacttagactctgtgtctctgtgcttgccctggaactttgattaaattgtcactaaccgagttagctggccctcgccgggctgcagaaatagaagtgtcttgcacacatgacatatgactgtctcaagagctggctggtgaaaggacgttctggagaaggctgccgatactgtatgaactagaactggacaagagcctggagattggataactcagtttggcgcaagtaaagggaataaaagtgttaaggtggcaaaattgtatccaggtgtttataggctccctgagttcctgacttgagcctatctatgggtttagagttcaaggctctttaccagtgctgacaatcttatactcyaggttgaacctccggggaaggtgcccttgcttgatggcatgtttaccaggggttctagagcctcaatcacagattctstctagctcacatgaagttaatgaaaatgaatgtgcttccctacaaattagagaggctttgaggaaaaatcagattaaatgcactcctgcttgaacttatgtttcttagaacacagctggaaattttgtcacacaaacctttactttcagtgacatttcttgactggtttgttactgtagtgaatctgctttaactatcttttcttatcgctgaggttttacttccattctacatgtgattgtggagcgctgcgtcattgtgggttcagtgtagtggagagtaggaagatggtgagacacagtagcttgttgcacattgcttaatttatcagggatcactgatgagttagtacactagagaagattgtaggtagagctgaaaagatggaggaattataaggctcagatttctctctttttttttttttttaagatggagtttcactcttgttgyccaggctggaattcaatggcatgatctcggctcactgcaacctctgcctccygggttcaagtgagacttgatggtctcacttgatggtttcctggctcagcctcctgagtagctgagattacaggcacccactaccatgcccagctacttttttgtatttttagtggagatggggttttatcatgttgaccaggctggtctcgaacttctgacctcaggtgatcacctgcctcagcctcccaaagtgcagggattacaggcatgagccactgcgtctggccaaggctcagatttctaatagagatttctaatggacatagaggctggaggaaatgggatggacaggaaaactgagtcaggtgccaaaaacttgtagggggccgggtgcggtggctcacgcctgtaatcccagcactttgggaggctgaggcgggtggatcacgaggtcaggagatcgagaccatcctggctaacacggcgaaaccccgtctctactaaaaatacaaaaaattagccgggcgtgttggcaggcggctgtcggtagtcccagctactcgggaggctgaggcaggagaatggcgtgaagccgggaggcggagcttgcagtgagccgagatcgcgccactgcactccagcctgggcgacagagccagactccatctaaataaataaatagataaataaataaaataaaataaaaacttgtagggaggtggcagtgtgctatggagrataggtgcaacctctgtgagaatgtagagaaaatagtataagtgagtggtgaggacccccaagagggggttttatagtaaaacaatggtcagaagtggcaacaggataccgtataatgctttcacctctaccaatgcactgggtactggagagcgctccagtttgctctggaaaggccctttctgtggacaaagaatacagaaaagagattcctttaataaaccacccactctgtgtcccacccttgatgaatacttcactgtgaaattgccagaattaatcatggtaatagctactgtacacttactttgttccaggaactggataaatgttttacatacattatcagttctattttttggagaagatacaggggctcagagtccctagggttccagagctggtgagtagcagagtcaggattcaaacccagctttctctgactctaaaacctcctttcttcctgctgaaacaattaactcaagacaacaaaggagttaaggatttggggagttttctgcatggtagaatagacccaaaggaaaagaaagaaagacagtgactaagatttgggtttgtctgccccaccaaatgctttgagcastttcataaatataaatccttcaggttgggagaaggttgaacatctgaagacactgattcttcagagatgtaatccaaacaaagtgatctttggtgatatggtcactaaaccatttatcccaaaattctcttggaaaaccgtcctataacagcagggaacattatccagccaagtttttctgcaaataaagggttgctgatagaggcttgcctgcttgtgtttctgtagctcagggtgtttatgaattcactaatcccttcccttcagatcccttttattctggtgttatgattgtgactgaaaaaaattgattttttttctatgacatagaatgttgaaaggttgatttcttttctagaggaaagattctttttttctatgtgctacataccccccgaccagggaaaaggcaaatagtggtattgtttgctgaagtcttcctttgaaggttgcttggtgtttgcttagtggaaatcagcaggggaagagaggctatctctaacattttgttagagtttcttcgtagttctatagtgatgaaacaaggacttggggtacaggacagatctgctttcagaaatcctggctcttgtgaggtttagaagccctgagaccatttagctggtggcaacgggaatgttgagggtgataaataggatctttggttgtccaagtatcagtgacatgatatagatggagttaaacctttaggatctccttatttatttgtttgtttatttttgagacagggtcttgcactgtagcccaggttggagtatggtggcatgatcataactcactgcagcctcaaactcctgggctcaagcgatcctgctgcctcagcctcccaaggtgttaggattacaggcatgagccgccacacccggtcaggatctcctgtaaaattatattgttgacaacatgaagaattatgcttctcaaaagctagttatagatttgtacaatattcatagatttcttgtttcagtttttacaaattcatagcccttattttgaaaattagctattagcaataattttgtctaggaaattggatgtgtattcaagtgaaagaaggaagtacagttacctattatcttattgtaactaacaatcaagtaagtgtgatgcatttggtactttaaaaactgcacccaagttacagattattggaattaataaaattcactggatctatatatttttaaacggacagtgtgatagcagaacctcttatagaatgatagaattcctctggaatgattggataacttcatttcatccttgacttttaccttggaggatttcttaccccttttggcttctcaaatttgactattaaaatgttgcctttaaaaataggaacacagtttcaggggggagtaccagcccatgacccttctgcaaggccccctaactcaaggtagtttccctggaactgtggtttatggaatgtttcaggagtgtgaggaggtataatttaaggctgtcctagcaaggatacccttaaggatagagggcccagtagcatctggaggccagaaaagttaaactgaggcagtcagattagcttcaggctcaattaagctgatgggtcagcctgggagaaattgcaggatgactctcaatatcccctcccacccccacagcagccacgatctgtctgtctttaatcatgggtgcagtgaacctgttctttccaggtgtcttggccttcagtaaccttgttaggcttgtccctgaacgtggctaccgatccaaagacacatgatcagagaggcaattagagaacagaccttttccaaagcaagcatgttctgttgggcttagaagtttcatgtcctaatattataggaccctgtgcatctctctggagatgaggcacatgagtcatatctgtgattcttgcttttgtgtcaacatctcatgaataggcaatcagagctttggcaccaatgtattttcagttcatatctgatgtagttaaatccacctcctgctttgtagtttactggcaagctgtttttgatataagacatctagaacactgtaaatatataacatttttatttgtctattatacctcaattacgaaaaagacatctagaagcaacctcatcaagagagatactgaggccgggcatggtagctcacacttgcaatcccattactttgggaggctgaggcaggtagatcacttgaggtcaagagtttgaaaccagcctggccaacatgttgaaaccctgtctctattaaaaatacaaaaaagttagctgggcttggtggtgggcacctgtaatcccagctactccggaggctgaggcaggagaatcacttgaacctgggaggcagaggttgcagtgagctgagatcacaccactgcactccaacctgggcaccagagtgagattacatctaaaaaataaaataaagtaataaaaaagagagatattgatagctgttgttggaaatttcaacttccatctcacttctggtaactttttggaagtttgttgaacaaagtggaatacacgcacatacacacacacacatactctcttgtttgtttaaggtttaatgaaatagctgtcatataatcactgtttttgaaagaggagaattagttgctatctgtacattttgggtatgtgaactatttggatagaactctgagaaatgcattcagaacaacaaacaaaatcataggagaaatagctaagtgggaaggggcatataagagttgttgaaaaagttatttcttgagaaaccagctctaatgctaggcaagtcacttgctttgggggaggcctcagcttctctgtctataagattgcagcaggggtgtagtgggaatgagtcttcaacattccaagagattttatctactaatacgacmgtcaaatggagcatgactttgtggaagyctctcctcttccacccagaggggccaatttctctgtcccagtgagatgttgacacttgtatgatccctgcttggagacttccctcttctggaacctgccctggctcaggcatgagggctgactgtcacccttygataggagcccagcactaaagctcatgtgttggcagtgttcttgcgggaaggaaaaagaccagccagcccatttgttactgcacaagcaaacagcttctggtagctgtacagatacatgcactttctttcctcactgtgtttccatagacagatttagtgctgtagaagagtagagggcagtcacgggaaggagttcctgtttttcttttggctatgccaaatggggaaaaatcctcctatcttgtctttttagtgtcatcctctctccccttttcttcttctttataattctcatctctcatctctcctggaaatgtgcatgtcaagttcaaaagggcacaatgttttggtgaggaagaggtgggagaacacgtgccaggtgctaactagggtcatcatttcccccttcacagccagcttcctgtgaaygtgtgtgtgtgtgtgtgtgtgtgtgtgtgtgtgtgtgtgtgtatttcttttgccagcatcactgaatctgtctgctgtctggtattccaggttttggtttagggaaaagtaaaagtaattttataatcccagctgtcatttaagccacccctttgtgggtagcatatggtccactctctcagttcattgtcctaaagatgcttcatcagaaaggaataacttccaccccgttactctctgtccccttactctgctttatttttcttcgtcartcctaccaccaccacccactgtttgaacaacccactattatttgtctgtttcccatccctggtagaataggagccccatgaatgaaggaactttgcttctgttgttcaccactgaatctctaaggtatggaacacacctggcatgtgataggcactcgataaatatttgttgtggctcatgggcaccttgcagagttaaggctgcagttgtttgtggaatttataagtggtaatgaatatttatctactattcctcttccaaggcgatcacacaataatcaggctttacactatccagttcttaggtcttccaagttatgacttgtgaggtatgttaattatgataatagaaggcagtttatttggttcagatttattgatgtgtaatttaccacagtaagacttcccctttacaaaagtatgatgagttttgacaaatggatacacatgtgtatctaccactgccatgctccttttcagtctgtcgtcccctccacccatgaccactggtcaccactgcagtgatttctgtccccttcatttcaccttttccagaatgtcatataaatggaatcatgcagtatgtagttttttgtgtctggcttatttttcttagcattaggcttttgggattcatccaggttgtcgcatgtaacagtagcttattcctttttatggctgagtaagtgtcccagttttatttatatatttatttatgaggaggtgtctcactctgtcacccaggctggagtgcggtagcgcgatctcagctcactgcaacctccgcctcccaggttcaagcaattctcctgcctcctgagtagctgggattacaggcacccaccgccacgcccaactaatttttatatttttagtagagatggggtttcaccatgttggccaggctgatctcaaactcttgacctcaggtgatccgcccacctctggctcccaaagtgctaggattacaggcatgagccactgtgcccagccccagttttatttattcaccagttgatggtcttttcgacaactaattgtttccagtttttggctattctgtataaggcttctataaatattcacaaatacctaggatgggatgactgggtcatataatagtactgtataaccttagcagaaactgtcaaactattttccaaagtggctcttccattttacaattccacagtgtattgagtcccagtgtctccatacacatgctagcacttttaatatttaatttagtgggtatgtaatgatatctcattgtggttttaatttgcatttctctgcagctaatgatgagtgtttctgcttatttgggaaggttttaatttagcagtctgttgtattctgtagatattaataacttcaaaatatcagtggcatttgcagttaaaatttccttaaaaaattggccaaaggtttccagcagtcacttctgccatgcccaaactgtatgaaacaaggctgaggtgtggagattgtcacattttggcaaggagtgatccacttgggtgactgatgagacccagagagcgtacgcctcgggcttgagggtgaggacgggcgggaagtcgactgcatggccctgctggccttgggaggctgcccagtccttagctaaagctggcagttatgggaaacagacttagattctattacgtttttcaggatgtcccaggagtcacctgggaagctcagcagtcctttgtgactttcaagcatatggtagaagctgctgaacacagagmtccctctttggggataatttgcccaaatcatttaatcaggcttgagaaatgagttaccacaggtccaggagtgctgccacccttgaattctgacaccctatttctcctatccgtctcttaattaattaagcagacatccccaagtgcttacgacaagccaggacccttttgcatactaaggaaaacagggatgaaggaaacagaaatggtctctgctctgactcagaaggtagaaatcctctttcccagccaagtcttcctagggagcacgtaggaagggctctgaacccacgtgtcagttgcaggggaggatatcaggaaaggacattgaagaagtggagacctaagtttgagacctaggcattagccaggctagcagtgcttgaaaaagtgtcttaggacaagagaactcaccagtgaagtcccagtggtaggagagcgtgcagcatattctgagcctgtatacacatctccagggcattgcttagcaggtggggagtggcaagagagtaggctggagtcacagaagggaggccaggtagaccttggtgagcactggactctatgttcaggtgctgaggagctggcaaaaggttttaagtcggggagaggcatgttcagatatttggtctagctgagtaactttgggtgctctgtgacraatggttgggagaccagtgaggtggcagttgcggtcatctaggagcaggatcagagtggcctattgactgggatgactgtgaagtgggatcctttccagccagtaactggaaatgtgtatgagggcagaagtgagtgtactgcatttgaaacattgagaaatctagtrcatagtactgtctcttttatatcttttttttttttttttttgattttggtttgtttgttcactaacttggaaaactgatgtggaaatgtccctttggcttcagttacctgagcagaaggggccgggcattgccaaactctcctcttaggacagaattgctcccagtattgatcattgtgttctgagwtgggggagcaaattgtgcaggaggccaggtcagtgccaaggtgggtgggaggaattggagsaggaagcttgcctaagtgtgcccagcaaagccacggtagaactttctactgtggctctatgctacttcttagcaaccttctccatgtgcttcctggagagtccttggagtcagaacctttttcttgaaacccagacactttacttccaagaaaatgctgtccaagaaaactcatccttcccttcttctcatgaacgttgtgtagaggtgtgtcttctcttcctttgagcttttccactcagggtttaggggaggtgatattctatatttgggtttggctctgggtactgcaacactaggctattaagatttcatccttactgctttgcccctcctatctttccagaaacccacaatggatttgctagaaataatggaacgtcctgtttggacaggatataaccatttctcagctagaggatattgttggaatgaagaaagataaatggggagaagggaactcacattgctttggcacttaaattaagccatgtactgtgttgggaaattatttatattatctcgttgaatccacagtagaacacagttgaacaccatacaaggtaagtattgtcatccttattttaccatgaggaaattgatgcttagagagcataaagccttggccaggggcacatagttgggaagccggggctaattcatgcctgggctctttctgatagttttccttttttaattgtcccctcctcattgttaccttggggatttcaagagattcatgtagcttctaaatcaacgaastgattcctggagagcagcttctgtatgagaaaaatctagctaattatttatttcagtgtctctggaatgcaagctctgtcctgagccacttagaaaacaatttgggatgacaagcatgtgtctcacaatgctgctctggttgccagtgctgtgctgccagttgtcatctttgaacaaactgatgcagtgctggtttaactcttcctctttttggagtaagaaactttggaggcctgtgtccttctagaagtttgctgagcaaatggtaaggaaaagaaataggtcctaaggcttgactatttcagagaatttcttgatttattggactgtcaatgaatgaattggaatacatagtggtaggctgtcttttcttctcagacactgcaatttcctccaatctcttgacttttctagaagttttaatccaagtccttgttgggtggtagataaaagggtattgttctactagagactgaccttggcatggagatctcatttggactcacagatttctagtctagcgcttggttttgtatccatacctcgctactgcattcttagttccttctgctccttgttcctcatgcccagtgtcccaccctacccttgcccctactcctctagaggccacagtgattcactgagccatttcataagcacagctaggagagttcatggctaccaagtgccagcagggccgaattttcacctgtgtgtcctcccttccatttttcatcttctgccccctccccagctttaactttaatataactacttgggactattccagcattaaataagggtaactgctggatgggtggctgggatacacagaatgtagtatcccttgttcacgagaagaccttcttgccctagcatggcaaacagtcctccaaggaggcacctgtgacacccarcggagtaggggggcggtgtgttcaggtgcaggtggaacaaggccagaagtgtgcatatgtgctgaccrtgggagcttgtttgtcggtttcacagttgatgccctgagcctgccatagcagacttgtttctccatgggatgctgttttctttccagagacacagcgctagggttgtcctcattacctgagagccaggtgtcggtagcattttcttggtgtttactcacactcatctaaggcacgttgtggttttccagattaggaaactgctttattgatggtgctttttttttttttttttgagacagagtctcgctctgtcgccatgctggagtgtagtggcacaatcttggctcactgcacctccgcctgccrggttcagcgattctcctgcctcagcctcccaagtagctgggactacaggtgcctgccaccatgcccagctaatttttgtatttttagtagagacggggtttcaccgtattggctaggatggtctcgatttcttgacctcgtgatccgcctgcctcggcctcccaaagtgctgggattataggcttgagccaccacgcctggccgatggtgctttttatcatttgaaggactcagttgtataacccactgaaaattagtmtgtaaggaagttcagggaatagtataagtcactccaggcttgaggcaaaatttacaaatgctgctgactttgtatgtaaggggaggcattttcttagaraagagaggtaggtctctgggattccagtatgccatttccatcctcagtgtttttggccacctgagagaggtctattttcagaaatgcattcttcattcccagatgataacatctatagaactaaaatgattaggaccataacacgtagctcctagcctgctgtcggaacacctcccgagtccctctttgtgggtgaacccagaggctgggagctggtgactcatgatccattgagaagcagtcatgatgcagagctgtgtgttggaggtctcagctgagagggctggattagcagtcctcattggtgtatggctttgcagcaataactgatggctgtttcccctcctgctttatctttcagttaatgaccagccacggcgtccctgctgtgagctctggccgctgccttccagggctcccgagccacacgctgggsgtgctggctgagggaacatggcttgttggcctcagctgaggttgctgctgtggaagaacctcactttcagaagaagacaaacagtaagcttgggtttttcagcagcggggggttctctcattttttctttgtggttttgagttggggattggaggagggagggagggaaggaagctgtgttggttttcacacagggattgatggaatctggctcttatggacacagractgtgtggtcyggatatggcatgtggcttatcatagagggcagatttgcagccaggtagaaatagtagctttggtttgtgctactgcccaggcatgagttctgatccctaggacctggctccgaatcgcccctgagcaccccactttttccttttgctgcagccctgggagccacctggctctccaaaagcccctaatgggcccctgtatttctggaagctgtgggtgaagtgagttartggccccactcttagagatcaatactgggtatcttggtgtcaatctggattctttccttcaggcctggaggaatataataactgagacttgttttatttctgcagagggttctaagccattcacttcccagatgggccaataatgctttgagtaatctggagatcatctttaatgcgcaggtgaatggaactcttccacagagggatgtgagggctgtagagcagagtgaactccctgaaactcagacgtcagctctttgtctctctatctctgaacacccttccttagagatcccatctctaggatgcatttctctgtagttagtttctaagtctcttgttcctgttctgcctttatttttttttcctggattctaagccagtatccccacttggctgtcttaatgtagcttaacatgtctgtaatcaaaatgatcatctttctgagattcaaagggctataagggactttggagagaatttcattcagttttcctcaaactagaataatgcttgcactgtctgtaaaagaacaaaagtgtcaaagcayccttttgttcactaaatttccttttttattatagtgttacttaaatattaggaagtaaaagtaggtataaacttcttataggctgttattatacaactatatgacccatacatatttacaaattaagtgcagccaaaattgcaaartcaataccattcaaattaataccttaaatgtggtgaggcagctgttgttcaactgaaaccaaattataagttgcatggcagtaaatgctatcatgctgatcattttgagtttggccagtctatattatcatgtgctaatgattgaattctccacccatttttctacttgtatgaccttaatttgatggcacctgttccatcctcatgagtttgctacaattatactggtgccaacrcaatcataaacacaaatataaacttgggctttgaaatcttgtgccagaacttggctttaaagtaagcatttaaaaaatccatatgtgtttattagactttgtttagatgactgttgaaatgaaaacaaagtgtttaaaatcctcttagagaacttaaatataatccctcagcaatatgtatacagatcttcctttgagaaaaactgattgtgttcagcctctcatgttacaaatggggaacctgaattctgaggtctctagtgagagaacagggactrgaatctgtggatcctatctgttttaataataattgtaaagtataatagataatattatattaataaaataaaagcaaacacttagaatgagcttccatgtgtgaggcactaactgattaggcattattaactagatttattccttttaaggccccgcgatgtactgttatttccacatgttgtagctggggaacgtgctactcagagaggttaagtaacttgtctgaggtccacaccactaacaaggagcacaggtagggttcaaatccagataatctgactttggagctggcactctaactcaatgtgcctaatcgcttttcagtggtgtcattattttgcctattctccatctgagaatattgaagtttctgactccttccttgcctttctccctgcctcccgtgkttatccccaggtcttggtgttccagtcctctatgtccgtccttactcttattcctttgctacagtgtgatccagggctcctgccccttcttatcctggtagagggggcccacttgctgggaaattgtctccgccatggtttatccatgttgtgtgtccattagtgagtagtgggaagaatcatatcatgttggcaatgaaaggggggctatggctctggggtagtctagtctgaacctcttattttacggatgagaaagctgaggtacaaagcagggaagggatttcttgaggtcacccagccagcaactgagctgcaaccagaagctgagatccccaggactagggccgagcctcattctgtcccatcacagtgacttttcttccctcctccaaactatttttattttttatttttttgcagctgcttagcagcttgaagttagaagaaagggcagggaaaaggttttccgtgcttagccagggaaggaatcctgcaacaggatgtggggttgggtcattcaaattgggccagactccactggtcttgttgcttcttgcttggtattgcagatgggtttaaaagtgttaggattagagagataggcaggtttagccaaaggcagtttgtagccttgtggcagagttctttttaaagaaggaagtgggatgcaacaccctgacacaaaggggcttaagttgttataccactgcctgctaacctgttttccttaactctcttcctgatttctaaaggaagtatattttgctgaatcagaaagaaaagtgatttatttcargttgctgatgcttagattgttagagttgsaaagatctggcttgcatcttgtacarctgacagaactggggctcaggggggcacaggtgcccagagttggtcagtcaggaaagtagcaccagaaccagtctcctggtggccctacagttgcagacccttttttgctttgctctctgtgtatactaaagcttctatgtctctgaatctcaagttctgactggtagctactttccaatccacctggcttagatttctagattatattgtttagacgtcagaacctcttaagggttttggggccacttgttagctcacatagtgagaaccagccctgcccattaggtaggggaagaagttagcagtccatgatagctgttgcctgcagcrtayggaygttcattgcrcagttcctgtctcctgagatcctggagtgtatacgcttggcctcagagcccagcacagagcctggcccttgggacatgcttagtaagtatttactgaatgagtgggaaatgtcttaaggcccattagtttgcaggtcttgaggaggctcccttgcactaggaagaatagaaagcatacataaagcctgtgtgctgcygccaggaagactagaaacgctatgttcagcctggagctgaatggtataccccagagcaaccctgttgaaaggcagtgcttgccttttcattctgtgtcctggtttgctggtaactcctgggtcccctgcctctcctgtacccccattgtgcagactgaggggggaccatcagccagggttagttttccgctgtttctgttaggcaaagaataaattgaattgagttgtgaaagttgggtgcaaagctcagtttgggtccaaagtaacagttaacttgtgtgggtggcaggtattcagtacaaacagggctggggacaggaaggggaagagaacttcagagctttcacgatcctcatctggttttaggctgatccagaggccaaggtccccatggaacaaactggacaaagtgagggtggccacatggcctcttttcttttgcctttattattaattttctcaaatagatctgactagtcatgtggctgggaaaatagttaattgtgatttttttttttttaaactgagtctcactctattgcccaggctggagtgcagtggtatgatctcagctcgccgcaacctctgcctcccgggatcaagcaattgtcatgcctcagcctcccgggtagctgggattatgggcacacagcaccacgcctggctaatttttgtatttttagtagagacatggttttagcatgttggccaggctggtcttgaactcctgacctcaagtgatccacccacctcagcctyccaatctgctgggattacaggcatgagccactgcacccagccagagtaccactatttgggcattctttaatgaaaaagaatgaactatccaaaaattaaaactcctcatttatgagcttttagagaattttacagagtagatggaaactctctgcatcctttccccacttctastttcacctgacacatttcttccctgtccttactcctgggccggcagcagtggtcatgattccaatcccagcttggccaccatctgcctcagtggcctaggaaaactcctttctccagagctttagttttctcttctacggaatgaagaaagttaaaacaaatagacatttattgtttcatttggataaatatctattaagcatctattacttgtggtatggttagctgggtatatagtggtgaagcagctgggcatgagtactgctttcgtagagcttacagttcagtgaggccagcagatgtgaaacatatcatcacacaaataaaaatataactatcaactgtgatgaggattatgaaggaaaaaatccggcaaactatggtactggtgttagatactagcaggtgtgggtagggatttcatttagattkacaggtygtcacattaaagctgagagccctgaagttcaagcaatggttagccaggcaaagatcagaggcytagagatagggaaatccattccaggcagagagactgggggtgcctgtcccctaggtcagggaacagaagaaagccagtggcactggtggagtgaataagactggcgggggatgagttggtagtagacatgaccagatcatttagggccaattctcctggggaaggagaatttaatttaatatttatttatttatttatttatttatttatttatttatttatttatttttcaagacggagtctagttctgtcgcccaggctggagtgcagtggagcaatctcggctcactgcaacttttgcctcctggtttcaagcgattctcctgcctcagcctcctagtagctgggattacagacgcccaccaccatgcccagctaatttttgtatttttatagagatgcggtttcaccatattggccaggctggtctgaaactcctgaccttgtgatcctcctacctcggcttcccaaagtgctgggattacaggcgtgacccacagtgccccctgagaatttaattttattttatgtgcaagaggattccctgaggtagtcaggccacattgtctggtgactcttgggatagagggaacttgaatgacaaaggcccaagaaagcaattgtaatcattacatatacatggaccattttatgctgttttcttctttcatttaacattatttagtgtgcgtgttcacatatttctaaatcatcttctgatttagaataatgatttctgatgtgtaggctgtgttttatagttttgaaagtaatactttgatatccattactttcttgattctcacagcaattctgaggtgtatgcgttgcaatttctgtttcacagatgaagagagtattgttaataagttaatggccgggcatggtggctcacacctataattccagcactttgggagaccaaggtgggcggatcacttgaggccaggaatttgagaccagcctggtcaatgtggtgacacccatctctactaaaaatacaaaaattagccaggcgtggtagcacttgcctgtaatcccagctatttgggagggtgaggcaggagaatttgcttgaacctggcaggtggaagttgcagtgagccaagattgcaccactgtactcctgcctgggtgacagagcgagactctgtctcaaaaaataaaaagttgctaagaggagggctgggatcttttggctccaaatctactgtgggatgatgcctttgacattcctgatagctgtgcagtaatccattaacacagtttttataagttcaaaccctgttgccaacatttagattgttccatgtgtgctgttacaaataaattactataaagattctatacatttaatcttttattatttttgtattatttctgtaggccaaaatctgaggaacaggattactaggttgaagggaaatggcccttgaagtgtctgatcagatgtctttccagaggatccaaccaatttaaatagccaccatcaatgcatgagactttgtagttcagggaaggcaggcctggttttaaaaatcatttcccctctctagcatttttctgatgtgatccttaagatttcactttagttttcccaggtctcattggcatgtatgctgttagggatgggtctaaaattaatttttcttcacattcatatcatgtcatcccagtgattatttaataaataatcacttgattaaatagtgattccttttctagttatttttgggacatttattaaaacctggatatggtggctcatgcctgtattcccagcactttgggaggctgaggtggggggattgcttgagactaggagttcaacaccagcctgggcagcatagcaagactccatctctataaaaataaggaaattagtcaggcatggtggtacttgcctggagtcccagctacttggaaggctgaggtaggagaattgcttgagtccaggtggtcaaggctgcagtgagctatgaccatactactgtactccagcctgggcaacagagtgaaactctgtctgaaaaaaaaaaaaaaaaaaaaaaaaaaaaaaaaaaaaagatgtgtagggagcaattttggagttattcatttggtcatttgatatgtagttttagttttggbgctgatagagcccagaatktaccctgaatttgatgaacattctgatatatgggggagctcattgtcccccacttacctttttgcctctcagaatatcttttgatatttttatctgttttttccccattgaatgttattaccttatcaagctcaaaaaagtaccctatcgctattttaagttcagttgtgttaaatctataaattagcttgggaaatttggatattaaatgaactcatgaagaagcagagtttagctctccttaattctcatcttcctttatttatcctactacagttctgtggttttcttttatgtaagaagcacatgtttggctaagttaatgcctaggtttttttgtttatgtgtccattctcactgtggatagtattctcttttccccacattatattaatttaactggttttcagagactaatagcaatgctattatttaggagaatttaccttggttctgattaacttacccatacttgcaaatcatttgcagctttttagttaactttgtgagttctcttagatttaygaccatgccagaaacagaaaggatattttcatctcttcctttctgatgtttattcttcttgtttcctttttttatcccccattatattctcaagaatctctcaatactaagaaatagcgacttcatttttcagcgcrgagtgcattattttggctaccatgattcagaagcctcttgcctaaggcccaattttattctgctagttttctctgttctttgtacatggcccttgcgctgccctaaccttgaattaacgtggctaaatctcaagaatttaagagcaccgtgactgtgtcctcaggctagggagggaaatgggttcacagagtgactggattgtggtctatgaacttcggcagccagcagcaaaagtcaggcatgaataatcaagtggacagtgaacatctgtagtgtgggagatgttggcataactatgaatgatgattcaagagtggtttgatgcatattgaataacatgatgataagtactagactctgtgctaagccttctatgtgaaatacatttaattctcataataactctagagcagtggttctcraccggggccggttatccccctaccccaccccaccctcacccttccaccagggacataacatctggagatatttttggttgtcacaatcctgggaatgtatgtgctgatatttagaggttgaggtcagggatgctgctgaacttcgtagaattcataggagagtctctcacaacacctatctggccccaaatgtcagtagggtcactatcaagaaaatctgctctagcagtgcctgctcatattatccccatgttgaaatagcaagatgggaagtgcaaagtggtgcttcggtactcttggagcagctttgactttggtgagaaacgccttttawaaacaatgtttcttcccatcttcccaccccatggggaggtgtggggttgggtgggtaggcaccaaagcaagatttagaagagttttctgtaggaatttataatggtaaaggatcaacttcatttccaagctatttatgagggtttatgtttaggaaaagtgctaagcttagagaaggaggagaaatctgattttattaatgagtgtagccataatggcatatcctggcagaagtcaastttggtttctagagggaggctattatgaaaagaaatacctggaacattcccctgggtttggaaggtgagttctaggttcaatgatgggaagaattttagaggtccaagataaaagggcaaagattaaattttgtctctcatgagttctctggctcaggtggtgtgaactttgcagacagtctytttaattcactcatacatgctagtctcccagctcagcaagggctttgagagagcaggtgtctgtatgctctggtaagtgaaggcaaagtgcataaggaggttggggtccataatggcgaagagaaggagcccttcagtcagagtggctttgaatcttggctctgccatttgccaatcttggaccattgggcagtgtattaactctttgaatctcagcttcctcttctgtaaaatgtgtataacaagagtactaattggattgtttgatgattaaatgagttaatgtgtataaagcactcacaaccctggtacatagtaagacctttcattattattatcatcatcaattttttttaacctcttttcctgatctgcttacactcaccagcttcagctgctccaaatggcttgtaagattttttgtttgccctttgctgtcagttgccatggggaagatccattcatttttttcagtcaaccaacatattttgagcatctgctgccctacaggatcctagatatgggggctgcagagatatccaggaacataagccttgattaattgggtcagatcagtgctcagcagggctggcaagtgctaggtttcttttaagtggcatatcttaaaaggtatatgtcctaaacatagctttgtgatggcagcatgatgggtacaaaagcacacacttaagtgtcagtagatctgggttcaaacattggtgcagtttcttatggctcgtaacttgttcaaacctcagtttcttcacttctaaaacggtaatgatacaacctacctcacagggttattatgaattaaatactggagatgagatacacaaaacgtcttgagtacacagtagctgcccaatattggctgtaagtattataaatctacaagctgtgaattaattttacctctstggatcctgttgatatttctagaccatkccacctagtggggccatttcctacctgagtcacccgtggtgtcaaatagaatgtcatgtggcctcctgagttgggtagaattggctgctcatctcaaccccgctactgactatctctgtgatttacccttcctccagccttagccttgctacatataaaatcaagacaataatrtttcctatctcacagggttgtcctgaggattaaattaagtaattaatataaaatgtgccttgtacatattgggccctaaataaacagtagctactatttrtccttaaagtacaaatggtagtttcagagcttcaaggctgatggctatttatcttactcatactctttgtttagcttcatttttttcccctaatttcattagtattttcttttcttttttttgaggtgaagtctcactctgttgcccaggctggagtgcaatggagcgatcttggctcaccccaacctctgtctcctgggttcaaacagttctcctgcctcagcctcccgagtagctgggattacaggctcccgccaccatgcccagctatttttttgtattttcagtagagatggggtttcacccttttgaccaggctggtcttgaactcctgacctcatgatcaacccacctcagcctcccaaagtgctgggattacaggtgtgagccaccacgccmggcctcataagtattttctaaatttatttacagtcatgccatttaaaaggaaagttgtattcctgtctttgttaatatttataagtgattttattcagctacaagcttggaatggcatataattttgtattctgcttttttcacttaatattacatggctaatgatttctgtgtttcataaacattattctgatgatggcatgatatattgttgagtacatgtaccataattgaatcatttccctattgctatgcaattaagttgtttccaatattttgcaattataatgtttcaatgaatgaataactttatgcatatagctttttgatatcttaagttcagtttcctaggatgaatttccaggaatagtaattgggcaaatgggataaacatgactcttgaatacgtattgttaacattgctttcccaaagggctcaactgatttatatttccgtgttcattatcttttaaaccagctcatttactcaccaaacatttttaaagccattatcatgtggtaggcttagtaagaagaaagtgaccctaagggagaagcttatatataaatagggtccctggtgtaccaagtgctgatacagacacaaagtacctggggaaattgagatgagggagtcctggctcagctgggagaaaagttcattttcatagagtcatggttttgttctttggcagaaagaaaattgctttcttccccacccccacccccagctttattgaggtataattgacaaataaaaattgtatatctttaagatatgcaatgtgatatatatgtatatctcaacttaaaaaataagctacagaataaaaaggtgtttgctattaaaaaaaaagaaaaggctgaatgtcattcccaagcttggaaatttgagtatgttgcctctttgggattatttacagaaatattagcaagaccagccccatctttggtcttgagtactccactgtcagcatgctttcttccagagagggatccatttgcctttatttttcattctgttgtgccgtctatgcaaactattcttgatagttttatggtaacagtgtttttttgttccatgagataatttatacatgctcattgtggaaaatttagaaaagacaggaaagtattaaaaacatcacttttttttttttttttttttttttttttttaagagacagagtcttgctctgtcgcccaggccggagtgcagtggcgtgatctcagctcacagcaacctccgcttcccaggtttaagtgattctcctgcctcagcctcccaagtagctgggagtacaggcatgcaccaccacgcccggctaattttgtatttttagtagagatggggtttcaccatgttggccaggctggtctcaaactcctgacctcaggtgatccgcctgccttggcctcgcaaagttctgggattataggcaggagccactgcgccagccacacctacgttcttatcatcctagtacatccactgtcattatcttgctgtatttccttctgcccagtctcactctgatcatgcagtggcgtgatcatgcagtgatctcggctcactgcaacctaggccttctgggttcgagtgattctcctgccttagcctcctgggttcaagtgattctcttgccttggcctcccaagtagctgggattacaggcatacacccccatgcccatctaatttttgtatttttagtagacacagcgtttcactaaaattttgtatttttagtagagatggggtttcaccatgttggccaggctggtctccaactcctgacctcaggtgatccgcctgccttggcctcacaaagtgattacaggcatgagccactgcatccatcgccaaaaagattttttaaaagagtttaatgtagaaccatatcaaaggtctttggaaataaaaaacagttttttaaaaatatcagaaataaaacaacaaataaataaataaataaaaacacccaaaacaatctgaagcaygagcacctagcagaaaggttcaattatgatctattcatagagtggaatatcaagtagacattacaggacatgttttaagattatattttatgtcatgggaaatgctctcccagtatgatgttaaatgaaaaaacagaatacaaaagtatatatgctgcatagtctcaatattgtagagaaaaaatattatttatgtatgcatgaaaaaagacaaaagatgttaacagagatccattgttacttcagtttactagggattgtctctgggaggtaggattaaggtgatttatatttacctttttaaacttttctgtatttttttattttcaaattttccataaaaatataaggacttgaagatcaagaaaaaatttctgctttggctcagtgcagtggctcacgcctgtaatcccarcastttgggagccctaggggagaggatcacttgaacccaagagtttgacgttccagtgagctatgatctccggatcskaccgcctggacgatggagcaagaccctgtctcaaaaaaaaaaatctttgctttttttttttgtttgtttttgagacggagtctctctctgttgccccagctggagtacagtggcacaatctcagctcaccgcaacctctgcctcctgggttcaagcgattctcttgcctcagcctcccaagtacctgggattccatgcacccaccactatgcccagctacttttttgtattttcagtagagacagggtttcaccatgttggccaggctggtctcgaattcctgacctcagctgatccaccggccttggcctcccaaagtgctgggattacaggcatgagccactgtgcccagcccaatcttttgctttttttaaaaaaagaagacaaaaagggattttataccagtattatcttggctgtgtgactctgaagccacagttgtaagttataattactctgaaacacaaggccctrtgactcttttgggctctttggtgtttatcttgattacaacgttggaatatagaaatgaaaggaatgggagaggtgatagacttcaggcagtgtaactagttgtctgaacactactggctcaattatattgtgtctagtgatttccatcttgtccgtckgctaatttatcgcctggtaactcactgaggcagggttttcctttggagaaacctcattgttttaaccagtgtatcatgcttgtttagaagttcaatgatctttttaactcatcggagaagatgatgaccagacctggacagatggggaaggactttgcactctctctttacagtcctgagtgcacacaggtcaatatggaactatgtgtgaattttcattgtctttgagagccctcttctctgccccatagggagcagctttgtgtgcaattagaggagcaagggttgtgtgtatttagcacagcaggttggcctggtcctctcctctcaacatagtcaccacatacctggcactatgctaaggctgggaatgcagacagatgggtgcctgctttcagagtgctcaatgtgctgaggaagccagcaacagaaacagatgatttcaggagctccaggaaaatgctacaggaggagtgtgcctgggttactggagtagcacaggaggagggcttctagctcaggctgagattttagtaaaggaaattatgccacgatgaatcctgaagaatgaatagaagtgaaccagataaagcacgataggaagcatcttcccttacctaagggaagacacagaggtatatggaatggtatgttaaaaggttgggactccaaacagttctgttaaagcttagagagtggtgggagagactggagaagttgattaattagtaaatgaagttgtctgtggatttcccagatcccagtggcattggayatccrtatyatttttaaawttacagtgttctatcttatttcccactcagtgtcagctgctgctggaagtggcctggcctctatttatcttcctgatcctgatctctgttcggctgagctacccaccctatgaacaacatgaatgtaagtaactgtggatgttgcctgagactcaccaatggcagggaaaatccaggcarttaacgtgggctaaattggacttttccaaagatgctgtctttgggaaacatcacacatgctttggatcagaaaacctaggcttctaatttgttgrtaaggcatgaactcaggagrctgttttcagtcctagtgaatggtgataattgtaattrtaacagtagacaacatctcttttacacattttaaatcatgaaaatagaataaccktactgataattttagaaagtggtgattaaaagcacatttaagataatgccttaacacctagtcttttccatatgcatgatgtcttaatcacacattgcaaatcatggaacacagaattttaagcagcatttgtgtagaacttctcagttttactaatattattttattttattctcataacaaccttgaatagaactcagatcatctgtcaatcatgtattttgataacagcctttacagtgagcatagaaaatacagtagtggctaacaacacargctccagatgtcaggttatctgrgtatgaattctggtgtcagcattcactaagcatatgaccttggacaagtgatttaagtttcttttaaacagagaatagtaatacctacctcatattattattgtcagtgtatcatcttacaatcacagtctttctcttagggcygggctcagtgggtggattgacactgcagaaatggccagatctaaaggatcaacatttacgtagctgggaaatgtagctgggacttcagtttcactgcsctrgtgatttttcctaccactaagcagctcagtccatacccctacgagacccacaagcttatgagatactgttcttccaggaaagcagtggggccagggccaccttttaattgtgtttcttggcctggtcccatctttctcacaatayatagcaacagttatttacttgctgattttctaatgcacatcacacatagtcatattaaacacacacacacacacmcacacacacmcmcacccctcaagaaacattttctgagrcgtgatttcctgatttcatcaaaaaagaaaagagcgggccaggcacagtgggaagtcaaggtgggtggatcacttgaggtcaggagtttgaaaccagcctggccaacacggtggaacctcgtctctactaaaaatacaaaaattagccaggcgtggtggcgcacacctgtaatcccagctactggggaggctgaggcaggagaattgcttcaacctgcgaggctgaggttgcagtgagccgagattgcgccattgcactccagcctgggcaacagagtgagactctgtctcaaaaaaaaaaaaaaaaaaaaaagcataaactgaaatttatatgcaatttatatgcctgtgagataattctgttttctcttttggaaccccaaagagatttttttgattgatgagcaaatacattttagattttatttaagcattatgccaagcaccactgaagtataagtttcaagggcaaactcagttttttcatctactagacgaatgattttctggaatgattacaagcaggcaagatggtgtagtggaaatagcaaatgtcttcggcatcagacaagttggggtttgtttgtatcctgcctctgcccttcaccgaggttgtgatcttgggcagattgttgagttttaacctagattcctctgactccagatcataaattttcagaaaagttctgaaattcttgtatatacwgatgrtaaatgagacttttccttacatctatgcacttctttgtttgtttgttttgagatggtcttgctctgttgcccagactggagtgcagtagtgcaatctccgctcactacaatgtctgcctcccaggttccagtgagcctcctgcctcagcctcccaaatagctgagactacaggcatgtgccaccacrtccggctaatttttgtatttttagtagagacagggtttygccatgttgaccacactggtctcgaactcctggcctcaggtgattcgcccgcctcagcctcccaaagtgctgggattacaggcatgagccaccatgcccggccatatccatgcacttcttgcaaccttaccttcttttctcatcaccctccagggacctagttggaagagcagagttaaaagttaaggtgaaacttggagaggtgtcttgtccctaggaacaaaggactggtttgaaattctctgtaaatcttccccagttcaaaccagagttatcaaggtcttaaaaacttccctgggtcctgagagcccattatattatttacttgtcttcctgtacacccactgcctagtcctgatcctacttttgtttgcaaataggatggggcacaacgtacaaggaagggcctttgccrcccctgctaagggataacctgaaataccttcaccatcactgccctgtgctgcttttcacctatgccagtctgtctacagtgccagtgtctyctggcattgaaaggggagaatcttttggtcctttgagtatttggttgggttacataaatctccctgaatgaagagcagctgacttaggcaaggggccttgtttggttttccttgaactattaacaggaagatagggagattaactgtgtaaatgttcaataggccagagtccctgcagagggtggccacagtgatcagatcttatcacatccttgctttggrtgttgcctctctggttggagtatggatagaaaagaaagaaagaccctatattgaaaygcaaagtgcagcaagtcctgactttggattaacttctcagcccatttgcatgaaaataaaaagatgaataaaacarggttcccactttggagggaggtggtagctgtgagatggaaggagtgttcctgctgggcaayagcagagtaagtgctggggtagattcaytcccacagtgcctggaaaatcctcataggctcatttgttgagtctttgtcctacaccaggcactctgcaaaaacgctttgcctgcaaggtctcatgcgatgctcaccacagctctgtgaagttaattgtacttttatcaccattttacagatgagaaaactgagggtatggggtcaatgacttggctaaagtcactgcttagcaagctgcagggactggatgtgaattccaattggtttgactccaaagcctgtgaagctacttgttcttcaccacctagagctgtggttcttgataactgtgaactcttttggggtcacaaatagccctgagaatatgatagaagcaggagctctggcctttctgtccatacctgaacaggtccttgggttaagagcccctcgtccagggcctattaatcttgatcctcataagcagcatccatgtatwamggccgcaaaccaaactgtgccagaccgaatcctaggaccaagcccaaatatgtcccatcatccttttggtaagaagctcattgtaagaaagaaagaggagagcaagaggatgacctagtgcatggggcctcattgttttaattagtgacaaaacaacaataataacaacaaaacccccgaagcttcacagatgacatcagaccccaagcctgtgtgtttttcaggtgcccttgaggagctttgtagctggcagaggaggtgaaactgacaaatgtttggcagatggaggagagtaccagaggggtttgagatgagctaaattycaatctaaccgcaggtgtgaggaagaggcttggattgggaccatggagatgggggttctactcccagtcacgccagctgactttgcgagtgttctttgtcagtcactttatcttattttatttatttttatttttttgaaatggagtttcgctcttgtcgcccaggctggagtgaaatggcgcgatcttggctcactgcaacctccccctcctgagttcaagcgattctcctgcctcagcctccagagtacctgggattacaggcgcctgccaccaagcccatcgaatttttgtatgcttagtagagacagggtttcgccatgttggccagggtggtcttgaactcctgacctcaggtgatccgcccaccttggcctcccaaagtgctgggattacaggcgcgagccactgtgcccagcccacttcatcttaccrtagttacctccttagagtatgaaaaaataggcttagggcatccccaagtcccctctatgtctgagagctgaggctggctgtcaaagaggaactaaggaygccagggactttctgcttaggacccctctcatcacttctccaaygctggtatcatgaaccccattctacagatgatgtccactagattaagaatggcatgtraggccaagtttccacctgagagtcagttttattcagaagagacaggtctctgggatgtggggaatgggacggacagacttggcatgaagcattgtataaatggagcctcaaaatcgcttcagggaattaatgtttctccctgtgtttttctactcctcgatttsaacaggccattttccaaataaagccatgccctctgcaggaacacttccttgggttcaggggattatctgtaatgccaacaacccctgtttccgttacccgactcctggggaggctcccggagttgttggaaactttaacaaatccatgtaagtatcagatcaggttttctttccaaacttgtcagttaatccttttccttcctttcttgtcctctggagaattttgaatggctggatttaagtgaagttgtttttgtaaatgcttgtgtgatagagtctgcagaatgagggaagggagaattttggagaatttggggtatttggggtatccatcacctcgagtatttatcatttctgtatgttgtgaacatttcaagtcctgtctgctagctattttggaatatactatatgttgttaatgatatcatgcagcagacgtgcatctgaatgggctggctctaggagctagagggtaggggctggcacaaagatgcatgctggaagggtccttgcccataagaagctgacagccaaggctaggggagttctgtcttctctgcatcagntcacctctctcacctctgtcactgccccntcagactacaatgtctgcaggtctttctcccctgagtgtgagctccctgagcaaagcaggatgctgccccttccctttgtattcctggctcctggcttcagtgcctggacataagtatgggcataataagtgtcccccaaatgagacattgaggattcttcaaatgcacaggaccgtgatgtgagttaggacggagtaaggacgatgggatgtggctcaggacaatcctgaggaagctgcagctgcggcangcagggccacactgtcatgttcatggaccctagactggctttgtagcctccatgggccccttccatacacaaatattaaaaattatatttcatgactgcattggtataaagatgaatataatccagaccagattcatgattattcatacatttttagtgtattaacttttaattctgcttttaaaataaattaaaacattctaatatgcccttaagagtatcccaggcccaggccactgagcctactgtggttcatggataagttggccctgggggcatgtgtgtgcatgcatgtgtgtgcacatgcatgatgagccgggccttgaagggtggtragatttgggtgtgtagaccaatggagaaaggcatttggggcagtgatgatgggtgggggagggaacatggtgatgaatggagctgggtgtggggagccatgggagtgggttagggccagcctgtggaggacctgggagccaggctgagttctatgcacttggcagtcacttctgtaaagcagcagaggcagttggcmtagctaaagcctttcgccttttcttgcaccctttacagtgtggctcgcctgttctcagatgctcggaggcttcttttatacagccagaaagacaccagcatgaaggacatgcgcaaagttctgagaacattacagcagatcaagaaatccagctcaagtaagtaaaaaccttctctgcatccgtttataattggaaattgacctgcaccagggaaagagagtagcccaggtgkctggggcttgttcccattagatcttccccaaggrgtttttctccttggtggctggcctgtggggcccctctccaggaggcattggtgaagaaactaggggagctggttgccacagacagtgatgtactaatcttctctgggaagacagaagaaaagtccccagrgaagaatactacagacttggccttagggacagctaggggtgcagattgctgccaactgcattttttctgaagttggccatatggttgcagtgaatggatttatagacagagtatttctgtgcatataagagcaattacagttgtaagttgatatggataagtgaaagttaagcacttctttctaaaaagagaatgcaattcattttcccctaatcatttcaattagtctgatgggcatttgaacttgttrtctttaaaaagtgaaatctttacctctgatctggtaagtatccaggcaatttcttgtgtgccacccaggaggtatctggggagtgggcatttkctgactgaggcattggctgccatagcatcagagcagccttccaggcagtggcctggcaaggggacagaggctggtgggagcagctggctgagtgcagccagtaatggcatgtgcatggtctgtagagaatgtagaagcaataatgaagccgataaaagctggtctgcattttattattatcatgcgccggtggttctaaacaatgtcagtgataaattactcctccccatcatggaccaatggctgccactgctccagggaagtgctttttattccgtttggtgtttagggagggatggagttggctggcctttgctgaaaggcctaccagtttgttttctatttggcaaaagaagaaatgataaagttctagagtttaaaccagactcagatttgagttttttttttttttttttttttttttttttttttttttttttttttwaaggctacaraactgtgctttccttgggcagtaaaagaggcaatgggcaatgkgggacctgatgacaaagggaagcaaagctgtcttaggggtggcatggaggaggtgctgcttcacagcagagagaggtatggctgtgcttggagtgtccacttagacaactcctggctgtgcagccaggccatcgagatgctgtttccttgacctgcaggtcctggtcttgcacatggatgtttcttctggtgcaggagacagaaaggtagcaacaacccctgatcaaagcctcagtccttccttatttactggagagcccctgctgattgaccagaggcacagctggggatatttcctttacctctgtagcaagagacagcgtggtgcagaggaaagtgctagcatacattaccctgtggctgcatgactttgtgaataggttagttagcaccctttcagccacttcttcttacctgttaatgagawaaaacatgtaattgcttaaraacagtatttggcacataggaagcacttagtgaatatgaattatgattttttttggagtggtgacatctcaaccaagccatttaacccctcagccttactttcctcaactataaaatagcagctaacttgaaatgtaaactataaaacctaatgtagtatctggcacatagtagattcccaataaatgagagccagtattctttctaagacagtgatgcatttctgagcacctggccttgttcttctgccttgcaatttatgcagcagttgaaatagactggctgatgggggtaagttgtcaagcagactttctgatcttagtggaggagactgccttaaaacaacactaatttcctttttcttttcttttcttttcttttaagacagagcctcgctctgtcaccaggctggagtgcagtggcgcagtcttggctcactgcagcctctgcctcctgggttcaagcgattctcctgcctcagcctcctgagtagctgggactataggcatgstccaccatgcccaactaatttttgtatttttagtagagatgagatttcaccatgttggccaggatggtctcgatctcctaacctcgtgatctgcccgcctaggccttccaaagtgctgggattacaggcatgagccaccatgcctggccttctttgagaagctggagacatgagttaaktggtgaagaagccaaatctgtatctaaaaaccctacagtwgtgtgcagagctctgaggagagaaggtcccttagattttgagtgtattattatgtcagtgcttgttttacatctctctgttcacgcagtatgtccccttttctgccttgcagctgtttcttaaattctttctttctttgcttgtcttgcagcacaaaacaggcttcagtatagggggaaatgcacagaaacactgccttttcctacaggaaatcagtaactttttactgattttgtttttatttacttattttatttgtttaaatttatttttagttttttttttttttagagacagggtctctttctgttacccargctagagtgcagtggtgcccttagagctcactgagctcactgcagcctcgaattcctgggctcaagtgatcctcctgccttagcctcccgaagggctgggatgacaggcatgagccactgcacctggccaactttttgytgattgcgaatagcactcttgtcaatttcggagagaagctgagactggcatatgtcagtatggatccccacttagagacctgtgtttatctgcactgacaccccatcacagcatgatgagcttggccctcctgtgctgtctctcccagggctgggaggatccttgaagctgatctggtttggagctttgtcctcattcacctcctttaccacacacccaccttcccagggcggggatctaccactcactaagtagcccattctgggtgttgacagctctaattgttagaaaatattcaccaccctgttatgctttctagagaacaagtctaattctrttttccttgaaatagtcgaagacagctctcatgtttttctttccctgttttcccaaagtccatgattttttaggcaaaatggcctcctttcctcttatggaatgtttttcctccccatttctgcctctcctctggttgtgtttcagtatgtctgtgtgcttcttgaagtttactggaaattatgaaagtattctggcacagaggaggaagggatttttgcctcccttgttctgagtgctacatttccgttaatgcagtctgagattgtattaggcattttggcattcacgtcaccttgttgactcatattccatgtgcactcaaacaaaattgtgattattttaaataggcagaattgcaagttacgtgttctccatttctttgttgtattgttggctttttgaactaaagggaaaaatgtcttttttctgttttacatgtttagattccctatgctatcctatcctcccaaaaccattttagattctgattttgccatgtattatatctgatactcctttctcgtcatctagagatgtgataaacaactctctttggcctcattccagtcatcgataactgtgggacaaagacttgaagcttggatcagtccagtggagactaaccacccctgtagacccttttttcctcaactataaaatagcagctaacttgaaatgtaaactataaaacctaatgtagtatctggcacatagtagattcccaataaatgagagccagtattcttctaagacagtgatgcatttctgagcacctggccttgttcttctgccttgcaatttatgcagcagttgaaatagactggctgatgggggtaagttgtcaagcagactttctgatcttagtggaggagactgccttaaaacaccactaatttcctttttcttttcttttctttcttttttttttttaagacagagcctcgctctgtcaccaggctggagtgcagtggcgcaatcttggctcactgcagcctctgcctcctgggttcaagtgattcttgattctgtagacactaccactcaggcctatattgtaatcagtgctgggccactgggctcctgcttctgtgatccagttgggaagtttatcttgttcttcccttcagcttgcatctgctaaattcgctggactatacacaggtgatttgtagatatggggatctctactcaaatactctcatgatttccttggctagagcatcattttatttccacttattggaagagaccttagagaccagttagttcatttatagataaattagttgattctgtcattcaacccttatatattgagcgtctcctatatgcgaatcactgttctaagtgccgagacacagaggtgtccaaaacaaatatggcccctctccatatggaatttctattctagagaagaatctgacccagaagggggaagtgactgtcccaagtctacacaaccacagaagggatattctgggaataaatcacggctaaahccccctgctgctccaggcagttctccttctacagtgctctattgtgctgttttaataatctttcaactgggaagaactcccatttcaggaattaagcygtggacaaatcttttaattatccttgaaatcatcctaataagaaatccaaggaggaagtcttacagggtgcctcacccacttttctcatcactggaactttttagacattttattattttcttcctaaaccagagtacaggcacacaagttgagtggtgtggtggctaaattaattaatgtttgcaaggcagtgtgagaagcattcattcatcttaaatacctatggtgactgcaactcagatgtaaaaattggataaatcctcagaaaccctagggaaagtgacatgtctgtattttgtctctgtgagatacagactggcagagataagtgtttctctgggtgagttttgtgtggtatctgggatgattttaggcagtacgtggatgagaacttttaattttaacccacatccaattgcaatttcatggaaattattgcttaggaggatgttcaacaggaaaaatataattaaagttaattcaaaagaaacattttctgtgaatatggtaaaacttgtgagagtagtttgtaaatgattgaagattggaaaacattggtataagagtgagtgtggggttttgtattaagattcattttgggaagaaatccatgctgcatccctcatgaagtgtgaactttgggcatgtgttgattctttctggcccagagtttacctgaagattagctgccctgagggtcactgagcattaaattagatgatgtctgtggatgactgatagtgaagctcatagcccacagttgacacataataaattcgagttgctttgcttccccttctgttcctggctgactgtttggcctttgccacttgttcggcctctctgggccttaagtttctttgccttgaaattggaactttctttggtgaaacaaccagaaaatgcttcagcccagaaacttggtcagtacttggatgggggatcacctgggactacccaaggatgtgggctgtctgctagactatagccccttgagggcaaggtgggcgccttgctcatggttccatcmtaagccccagcacagtagtgggtgcatggtgagccattagtgaatctttgtggaatgaaggtgggagaaaataaaatacctgtacttcacagggtattgtgagggtcaagtaaaagtgctttaaaaaattgtattatatagtttattcccttgtgttagcccaggtcaacagagcctacgaataataatgatgacagaagttcttcaaaaagtcttggccttctttctttcacaaaattgccccccagagctttctggaagggcagccatgaacccagaggcctaaagtagatttactgggaagctaaaaatatttactttatttttcatagctcctttcaaggtcctctctgggggtcttagcaatatgtttacacagtggtatgtttttgtaaggtttgcaaaagtaagattttttaaaaatactatcttgttttaaaaagagagccccctaccaacttgtgtcagcctcaggcccccacctgcatctgctcctgccagggcatggtggggcaagaagcactgctccccttccaaagcttccttccttgccctggagtcatcctcactccccactccaagccacctgccatcgctgtgccccctctctggtgaatctggcattcttaggtgggctgagaagcagactggcccaagctaaggcctttctgatggggttgttgctgctgagaatcatgactgggtgggagaaggaggtgaccctttgctgtcttatttttactgtgtatttccttttcagctacttaaaatgtattgcttagtgatacctaatgggttcattagcctgcttcctactgaacatttccgctcaggcatccacttggtcccaaggcctgctcctctcccatattctgaaatctggactacagactctcattcaactccaggttgcactgtggacacagtcccctcttgagcaggtacctccttgcagtggttgggacgtcctacttggctcatagttgggaagtgcatatgctggagctgaagcctcttgccttcccgggatagggcgtcctcacatcccctctgagaagttccccagcttccctctgttccccgtttccacacttagcgaggctcttgtccactgctacatcccccatagccagtccctcagccttgccaytgcttatgctggtctggaaacaattcctagacttgtggggcatctggggaagttctccatctttttttagctggcatgacccaagtggtgtgggcagggctgtggattctatggtgtggctggaagccaggtagcctctctctactgtacatggaactcagcaacttctgagtcaagcaagatcttagctctgcaggtgtcttgccctgtccaaagttatggccacaccagtaccttttaactctagaagcccagtaagtgttttgtgggaccgcaaagatcattttctagacctgctgaatatgcctagaacgggtagggatggctttcacgctgttcctagggctgacaagtcacacgtttctgggggtacatacacaccgcggtccctgtgaatggcactctccatgagaactgtgatgatttgagttgaatagtgcacagcctacatggttctctgccatggcctggagttccttatcttgccttctccagtgaggactagggctgcaactggcctactttggctcctgacttgggggattctgaaataccttttttttttaaggttgtggagctctctgaagcttataaggattttgccaggaaaagataagaaatatctttgggcattttgtcactgtgctggagatgaaccctttggaggacatatcaccttgttgaggtcaaggggcggaaagggacaggactggcagagagatccggggcagcagcctgccatcccgactgagtatggagtttctctctcccttcagctgcacttttgtgtggagtcagtggctcagctgccacttcccttatgttcatggcatgaatctggcttgttaggcctttcttttttttttttttttttgagatggagtctcactctgttgcccaggatggagtgcatggagtgtagtggtgtgatctcggctcactgcgaccaccgcctcctggattcaagcgattctcctgcctcagcctcctgagaagctgggattacaggcgcatgccacaacaccctgctaattttttaatttttatttatttattttttttcaaggcagaagaatttttcttagtacagaacaaaatggaatctcctatgtctacttctttctacacagacacagcaacaatctgatttctctatcttttccccacatttcccccttttctattcgacaaaactgccattgtcatcatggcccattctcaatgagctgctgggtacacctcccagatggggcggcggccgggtagaggggctcctcacttcccagaaggggcggccgggcagaggcgccccccacctcccggacggggcggctggccgggcgggggctgccccccacctccctcccggacggggtggctggccgggcgggggctggcccccacctccctcccggacggggyggctggccgggcgggggctgscccccacctccctcccggacggggcggctggctgccctgctaatttttgtattttcagtagagatggggttttaccatgttggtcaggctggtctcgaactcctgacctgttgatccacctgcctcagcctcccaaagtgttgagattacaggcatgagccactgcgcccggctctgtttttttgtttgtttgtttgtttttgtttttgttttgagacggagtcttactctgttgcccaggctggagtgagtggagcggcacgatcttggttcactgcaacctctgcctcccgggttcaaacaattcttcctgcctcagcctcccgaatagctgggattacaggcacttaccaccaggcctggctaatttttgtattttttagtagagacggggttttgccatgttggccatttgaactcctgaccatctttgaactcctgaccatgtttgccatgttgaactcttgacttcaggtgcgttggcctcccaaagtgctgggattacaggtgtgagccaccatgcccagcctgtttggcctttctgatatggctctgactaatctttttggaaattagtccccagggttatactggattttacttagggaaaagggtcatgcctctctggctgtcagatttactgatagtactaaggactcagtggggtggacctttgattctggtttgatttttgaaaatcaaaaagacgtgagctccagggagcagggtggctttggtgacatggcaagatagttggctgtggcagggagttgagggaagtgggtagaaaattaacatcttgtaaatattccctgggaaatataccttcgtgttaagagaacagacttggcagccagatggcctaggttcaaatcttggcttgatgcttatcagctgtgtaaccttggataattccatacatctctgtgcctcagtttcctcaaatggaataacaatagtacctccctcaggactattgtggcaaattaatggacgaataaggggaagcacttagtacagtgcctggcccagcataggtaccaggcttgttcttaagctcactgcatttttacaatcatcataaaatgcaggggatacacacatgaaggagccgaagttcagagaggccaagtaacttgcctaagaaagcacagctggcaaggggcagtaataggaccagaattccagtttctcrtgctctgttgttgttatatcctaaagagagcagctctgagtagccagaagcttccctaaagtcacaggacatggggcatgggctggctgggatgagaaaggagacaagagggcttctgaaagaaatgccagattcactccacttcctggcttcaggcaccgatggaatgtttcccaaggcccatctagaaagaacatcctgtgactcacagccacttctcattttctgtctgaaccccctcacccattcaggcagctgctaaagttgaggttacagcctcagactatattttctgtccttgtggaaccccagtgtgtcatcttgttgggagatctggtgatacatgtgtcaacattatgtcatcaaaatggaaattctttgaaatctttaggtgattgcaattcacgttctgtatgtatgcacttgtcaaaagttttgatttgaggccttagaattttatatttggaaacctttccactaccatgagttttcccagacctgtcaaagccaggctgcatctcagaaaccaggtctttgatttccatccagggcaagggcctgggcccagctgggctgtaagcaggtgggggtggggagcaacgctgcactgcaatgttgaaatattacttgaactaaatcaaatcaaagatcagctttactcagacaagaatagaaaacacaattgcattcgattacagaatagtgtgtatccccacaaatatcagactgcctttaaaaagttttgaattgttaacatcaagaacagtgttgcgtgtctcctgcttttccagcataaggtttatttattctgtgggtggcaaagagcaatttgggagtccagtttgtttctcattgaaagctttcccatttctggtcctcttgtcactgttgcattgaggcaccaaaaggcaatctcartgcgacactattcaacagactaagttgcaccggataatgataccattttacatttttcatatattattacattgaaggcttcaaacagcactagcaggggcaaattggtattattatctccatttcattgatgaggaaaccgaggctcgaaagggtaatgtctgttgtccaagattaaagagtaaagttgtacgttgaatcggggtctgactcctaggcttagcattttctccccacactatgctgccatgttgcttattccaacattaggaagcataggtgccatccccagcttttgaggccaatatcaygatgaagcatttttaaaacatctcattaaattgctgatatagtggaaagaaccaaagctttgcagtcaaagctgtttgggttcaaatttaccacttgtttgttctatgaccctgagcaagatattctccagatctgtttcctcatttgaaaaatgggaataataatacgtttctttataggctgttcttaaagattctggaaaataatgctaatagtgtgcctaatgcttggtaaatatgagtcacttttctgtgcccacaaagcactactatgtcccttaataaattttgttaattttaaaagttagaaaaaaattaaactatttatacattgtgtatgttaattcttccctagaccagccttaggaagaatctcatccccaacttgtaaactcatctttttccgttctttttgtgcctggacttctcagggccctgcaggctgattctagtcccatgttgtgtggtgtttgaagtgtctggtcccttttttcagtgagagaccagctcatccttgggaactgaatgcctcaaactctcttttctttttctctcttccccttctgtttgatgtagtctttcctgtttctggactctgtttcttcatacttcctatctcttaccttcttttcactccttttgtcttccagctgtcctctctcatttttctgcctctctggtcttcaggtagagttttcatctcagctatcttcttgctttttctgatgttggttctttgtttcttcttctcattctgttcaggtccaaaattcatttgggtcaatgttatgtcttagtgttatcttccatttccttctgagcttcaaagccaggctgactgtgcccttccacgccctggccaktgtgaccaggacatcctttccctctggggctgcactggctctttgggggaaktgttaccattcagggtcttcaaccctcattctagggacttccagtaacttctcccaccttccctcttctcagtaagacatgggtattgtcttattctgtttstgctgctagaagaaaattctcgagactgagtaatttatacacaatagaaatttacttctcacagttctggaggctgggaaatccaaaatcaaggtgttggcaggtttggtgtctggtgagggctgctctctgcttctaagatggtgccttgttgctgcatccttaggaggggacaaacgccatttcctcaactggcagaagggactgaagcctctccctcaagcccttttataggggtcctcattgtcaggcctctaagcccaagccaagccatcgcatcccctgtgacttgcacatatacgcccagatggcctgaagtaactgaagaatcacaaaagaagtgaaaaggccctgcctcgccttaactgatgacrttccaccattgtgatttgttcctgccccaccttaactgagtgattaaccctgtgaatttccttctcctggctcagaagctcccccactgagcaccttgtgaccccctgcccctgcccaccagagaacaaccccctttgactgtaattttccattaccttcccaaatcctataaaacggccccacccctatctcccttygctgactctcttttcggactcagcccacctgcagccaggtgaaaaaaacagctttattgctcacacaaagcctgtttggtggtctcttcacacagacgcacatgaaactcatggtatctgtgaggggccctaatgctattggtgagggcactgctcacataacttaatcaccccttaaaggccctgcctcttaatactgtcacattggtgatgaagtttcaatgtatgaactttgaggggggacacgttcaaatcatagcaggtgtgctattgccttactagcaaagtaatctgggggaagatgagtaatgtctcgttccacccctgattccagtgctgactgattctggagtggcagagagggttggaggctcaccgctctgctcacccsaccctctggccatctyctcttagaatgcaagggcagggattttgttacacagcgcctcttttgttataggctagctcctgccttcaaggagcactgagaaaaatattatccctttgaaccacaacactagtattttgggtactgtagccattcagaagtttgttgaactaatacaagtttatattatttgtaaaatactagaaggaatgtgtggttcctaaagttatggtattcccattggttgaaagagaagactctggcttcctaatgccttggaaggttcagggagcataagcctaaatatcctggtttctcttgggaattcttcacagcttgtcatctatgactttatccacatttattttgaacatgtttaattttcagcttgtattttctcaaggagtatgtgtgagtcagcattcagagtacttaacacacttagtgtcattagtgataacttaacccacacgtataggaagctagacctccatttacagaaaaatggaggctcagagagcctaactgactttcccaaggccacataactggaaaattctggaactgagttttttcaggtatgtcttggtatccctcggtgagccttctctgtagagaaggaagtgtctcctgggttggaaagcccaggccgggatgaacagcatgggtgtccttaggctgtgtgtaccacacacccctggcctactctcccctgctctaaggagtcacctgaaggagcagctgcatcaccccgcctcaccccttctcctcagcacccaacaaccaggtcttcccagagagtgctcagctattggtgaagcaggcatcgtctattcttcaagaagacagcagagcatcaggaaaacaaaacaccaaaaaaataccataaagacactggagtgtatttgttaccagcccttgtataacagagaagtatttcaaggtcttatttgtaaggctggacaagctcaggctgattaaaaccacgagttagaatttgtctcccgctcccaggccctgctcagttgacagctcctagcaggctgggaggccccaccccacccccaccccaggggtccattgaagaagaccatctgggcctgggatgctgatgtgattttccctacttctccttttttttcatttgcctcctccacccacttctaaagcagctgattgctctggttccttttcatgttgagcaaaagagaagacagatcttgaaacctgagctggggactggagggcactgaccgagagtaaccccgtctggctcagctcagctcagcaaagggctttcctcctccgccttcctgagctgctctccctcctctcctttcctccttctttcccagcctcccccaagctccttcacccctctcttccctctcctccctcctcccaccttccttgtcctctatgctcagagaactgaaggaacactgaatggcctggaaagcaggacctcgcccccaccccgcgtcatacccctccgcctgcacgtgcaaatgtgttcctcagcttggtcccagaggcctggacctgggtcccagaggtcccagctggttccccggcttggtcccagaggcctggatgtgtggcaagaagctgagggttctgcttcgtttcttccagcccacaaacacacatgtcacctgttttttgttctttttcctttcctttgccccactttacagaagctcttggctaattggtaggtcactgtttgctcctccaggcaaaaccaaggaggctgagctcagcaggtcaagtattttggtctgtattgaagagactgtggtgggagagccctcttgaccttctgctggatagtgactttctcttctgctggcagcagtagcccagctccgcatcctgtgacagaggtcataccttccagttacccgagcgaacacttggagcaagtcagctttttcccctgaaacagcacgttcacgttcttgatctttggtttgcacaacaacctgtgaatgttattagccccgttttttttgtttgtttgttttttgagacagagtgtcgctcttgttgcccaggctggattgcaatggcgtgatctcggctcactgcaacctctgcctccaagcaattctcctgcctcagcttcctgagtagctgggattacaggcatgcgccaccacacccggctaattttgtatttttagtagagacggggtttcttcatgttggtcaggctggtctcgaactyccgacctcagttgatccacccgtcttggcctcccaaagtgctgtattagccccattttatatccaaggaaactgaggcttagggagatttaaataggggggaaagtatagcttcatgattacacagtcaggaaatggcagagctgactcttgaattcagaccctgtgatgctgtatccagtgctgattttgttttgccctgtgttcctttcagtgtcaggtaagaagacctcagagatcatcttctccaacccacacattttactgattataaaatccaggtccgcattaactcattggccaaagttaagtggctaaatgactctcctgttcaggaagtattccctgtcttgtgtggaatgattggtctttcgtccaggtcatcttccacctatatccatccttgcagtgactggtggatatgatcattcctggtgattccctgtaaaatactagatttatttattctttcataaagttatgagtagacaaatcagtcagcttcaacctttcctttaccttatagatagtatcagcagaaagaactcaataattctgtcttaggaactcagccaggctaatatgtattataatacacacatacatatgcacacacatacacacatgtgcataccttagatcacaaattcaacatctcaacttagccgccaaagccacttctgtgtcttgtctattctgaatatgctttaaggttaaattagccatgaatctgttcagatcagtcattcctgaaaatgatgatgatattagccatcctttaccgggcaccttactcagtgcccggcattatactaggtctgcaggtacatttgctcatttaacacctagctcagtccaatgaggtggatgccattgtcatctccattttatcatttaatcaactcagccttcctctctcctgttccccactctgcttctagctgccactcacctgactctcctcttgatctgggctgacgtggctgagtgggtttagcagaactcttgtgtcctctttacttggtttgtttcaagttcatgtcctgcttcatcttttccctaactcactgcaaggtgaattttcttctctgcaatcggcaattccccaaatcacatcaggtcattaatttattcactcatttgtattcattcattcattagttcatccatccatctattcattcattcatccaatttactgagtgcctcctctgtgccaggcactgctggctttggaattaaaaaccctggccctcaaggaatttctattcttctgggagcaggatatttacatgggtgactgcagcttgatctgtgtggtactagtggraaacataggatgttgggcacaaaagagtcacaaaacgccgggcgcrgtggctcatgcctctaatcctagcactttgggaggccaaggcgagtggatcacctgaggtcaggagttcaagaccagcctggccaacatgatgaaaccccaactctactaaaaatacaaaaaggaataatagctgggcgtgatggcgggtgcctgtaatcccaacaactcgggaggctgaggcaggagaattgcttgaacctggggctttggaggttgcaatgagccaagagcgggccacttcactccagcctgggtgaaagggtgaaactctgtattaaaaaaaaaaaaagtcacaaaaaagggctggccacctaacccagcttgaggatgggaaggccagggcaggcttcctggaggaggtgactcatgggccatgtcatgaggatggggtaagaggagaaggtatgtttcagacatctggctttcttaatattcttggctttccacccattttcctgccagcaacataggggagaagactgagaccagcagatacaaagccactgtactctgtcctcaccccctccttttttctccccttcctactacccagatctgaggttttgagaaatctcttctctaattatctgcttgttcattcatttgttgagaatctactatgtgcatagcattatgaccacaaaatgtcctggtcgttgtcatcatgagaggtcttaccccttcctctccagccacttctagggatttttgactctgtccttttccagaacttggctccagtctggttgctcgccatgaagcacttacagataaacctcatcttgggccagtgcttccatttactgtctccttttggcttgcttatccttccttctgccttcttgaattgatttgcctctttatctcycctttcagccttgaaagttcctcgaaggcagggactgtgtccccatcttttctataaatggcattgttgtacattggtaaagttgagtgaaaaaatctttttgataatcacaaattattaccatatattgagcacctaccatgatgagtatctctgatcttcatatctttgaaatgtggatactattaccttcacttaattggtaagaaaatttgtgctcagggaggtaaagtcactttctcacagtcacacagctatttcacaggagagtgcagtatcaaatttaggtttttctggtcccaaaccctgatgtttcccccacatcattgtttctcagacttggctgcaatcacctgaaaaattttattaaattctttttttttttttttttgagacagagtctcgctctgtcacccaggctggagtgcaatggtgccatctctgctcagtgcaaccactgcctcccacgttcaagtgatcctcctgcttcagcctcccaagtagctgggattacaggcacccaccaccacactcagctaattttgatatgtttagtagagactgggtttcaccaggctgatctcaaactcctgacctcaagtgatctgcccacctcacccagccaggttttattaaattctgatgcctgggtcttaccctagcagttctcattagttgctccatggtgtggcctgggctttgggatttttgtgaagcccccagctgagtctaacgggcagtcatgtttgagaaccagtatactacaccatgttgccttcctgttttcacacaggttggtgctagtgtgtgagtctaagcctacatgggtggatatccacgtgatcaggctgcaagttctttgtagtggaggatctttggccctccctgctgcttcccaacccagcgaacctaccacaccatgcacgtgcacagccaagggttgttgactgtttaatcagtctctgggttcttatgtctcatccgggggattcactgataggaggctggagcttgatcacatccagatgttctcatcttcagagcctgttaacataacagaagtcttataaacatgctgagcacactcactggtctggagagtgttgcaggatgacctaggcccattgcaggggtggcctgggtcgccctcccacacttctgccaccctgcttgggaaggagggagctgttttgaagttccctggtgcaatatgatgtattgctctggctctgctcaggaggaagctatggcccacctagtcagtgagggttagctaatacgtgtattctgtttctgttgaggtttcacagaggccttttttgacccttcattttatagataaggcagtggaggcacaactacatgaaatgactcgacaaataaatggatttagaacccaggtttctgactcccagggtggtgctttttccatggttgtacagtgattaatgtctaccttttcacaccagtcctcaactgaagacaccagcttacaccttccttcctgtttctcccaagaacagaaagtgaccccggatgtcgctttctgttcctgggaaggcagttccagtggttagaagtcctgttcactcctggggtgtggcctggggatggtcctgacatccctgggctcttcctggacctggccagctaaaaggaaatctcctatgatggtactcagatacttttggaaccttgtcagccctaatcccatctcctagtgtttagtattcagctacccttcactgggcagtaattctgtgccaggcctgatctgggcattggtggtactaagaacrcatattccctatcctataggcatagtctggtagagacaacatgcaagtaaaacaatgttccttaaactgtggttccacacctccctcccccaacattaaaagtgtaagggatgcttattcaaatgtagatttgtaggctctgcactctagacccactatttcagaatctctggggactgggcccaagaaactgcattttcgcatgctccctaaatgaagcttaggtgctctgaggtttgacaactgcagtagagagcctaatgctaacagtgtagagtcacatgtgatgggaagcatcaggtaggtagcagtttgcaggagcactgattctgagggacactaactgggcctaagaacagctactggctgtcatgaggaataactaggagctagccatagaggggtagcagtgaatcatttctctagcgatgtaaatcttgctcaatttattctgtctatataactcaatattactgaagtttgcctaaagcagaatacacctggatcatacagcatttatgagagactggctgggctgtcaggccctcctgttactttatctctgcatgtgaccctcttagctccgcggattaactcctgtcctcattaagcctcacactgtagccccattttcagatcaaacctgtttctcttctggtaaatgatttcagtttgcaaagtttgccctctagaggttgcttagtgcctggccatgtgggctcagttcatgtggtcctgatgagctggttttatctttattacaaagaagttaggctgttaggagagtgggttggaaggagaagaggtagacagccaaatgagatgagtcagggaaaactatactgtttcggagtcatagggctcctaccaagcatctggtcagaaacctctcattttggagatcaagaaattgaggttcagaaagatgacatgaggtacgcagggacgccaccagacacagcctccaactctagaaactaaaattctggattcttagtgctgctttttctgttttgttgcactggattgaagccttttctaactgtactcagagggcctattatttagggagattcygtatgaaatcctttagcaatcaaatcatttaatagggctgatggtttaaatatatgttaatgtgttttcctaaagcctggcagacctgggttttggagctttgtatcacatgttttatgtttggaatgaaaatgagaccatgtctgtgaaggcactttgatatgcrtaatgcactctgccagtgtttgtcaaaacatggtccccaggtcagcagcatcagcatcacctgtaagtgattctccagtcgcatcccagggccgctgtatcagaaactctgggggtgggggtgggggtgggggtgggggtgggggtgggggtgggggtgggggccggcccggcccggcccggcccggcccggcccggcccggcccggcccggcccggcccggcccggcccggcagtctgcattttaacaagctctccaggtgattctgatgcatacttaagtttgagaaccattgcttgttttgcattaaacaggagattagtctctgcagcttgtgggaataaagctttaaatctctccaattttagctctgtgaaaaggcagtggggagacaggaatgaacggactagtgccacaaagctcaggtggggtgggtgagatcatttagaagagaaagaccgggcatggtggctcacgcctgtactgtcagcactttgggaggccaaggcaggttggatcacaaggtcaggagtttgagaccagcctgcctatcatggtgaaaccctgtctgtactaaagataaaaaaaaaaaaatttgccagtcatggtgatgcatacctgtaatcccagctactcgggaggctgaggcaggagaatctcttgaacccgggaggcgggggttgcagtgagctgagattccaccattgcactccaacctaggtgacagggtgagactccgtctcaaaataaaaaaaaaaaaagaaaaggaaaggctgtgtgtgtgtgtatgtgtgtgtgtgtgtgtgtgtgtgtgtgtaacagcaccatcacactgtttgagttgaggagcacatgctgagtgtggctcaacatgttaccagaaagcaatattttcatgcctctccygatatggcgatgctcccctatctcattcctgtgtgtgtttagccaggcaactgttgatcatcaatattatgataacgtttctccactgtcccattgtgcccactttttttttttttttgagttacttactaaataaaaataaaacactatttctcaatagacttgaagcttcaagatttcctggtggacaatgaaaccttctctgggttcctrtatcacaacctctctctcccaaagtctactgtggacaagatgctgagggctgatgtcattctccacaaggtaagctgatgcctccagcttcctcagtagggctgatggcaattacgttgtgcagctactggaaagaaatgaataaacccttgtccttgtaatggtggtgaaggggagggaggtagtttgaatacaacttcacttaattttacttccctattsaggcaggaattgccaaaccatccaggagtggaatatgcaacctggcgtcatgggccmgctggttaaaataaaattgatttctggcttatcacttggcatttgtgatgatttcctcctacaagggatacattttaagttgagttaaacttaaaaaatattcacagttctgaggcaataaccrtggttaagggttattgatctggaggagctctgtctaaaaaattgaggacaggagamtttagacaagggtgtatttggagacttttaagaattttataaaataagggctggacgcagtggcactgagttgagaactgttgcttgctttgcattaaataggagatcagtccctgcagcttgtgggaataaggctttaaatctctccaattttagctctgtgagatggcactggggaaacagaaatgaacggactagtgtcacaaagctcaggtgggatggacgagatcacttcaaaggtctrtaatcccacgtctataatcccagcactttgggaggccaaggcgggaaaatcacttgaggtcaggagttcgagaccatcctggccaacatggcaaagcctgtctctactaaaaatatgaaaattagctcagcgtggtggcatgctcctgtagtcccagctactcgtgaggctgagacaggagaatcgtttgaacctgggaggcggaggttgcagtgagccaatatcacgccattgcactccagcctggctgacagagtgagactccatctcaaaaaaaaaaaaaaaaaaagaattttataaaatcaggaaataatattagtgtttatgttgaattttaactttagaatcatagaaaacttcctctggcatcattattagacagctcttgtgcagtgggtagcaccagacccagcttgcatggttattgatttttcagagacactttttgagcttattctctggcagaaaggggaactgcttcctcccctatctcrtgtctgcatactagcttgtctttacaagaagcagaagtagtggaaatgtttattcttgaaaataagctttttgcttcacatgatctagaatttttaaaattagaaaaatgtgcttactgcgtgcccttctgaaactaggaaaatatgccttgtgtttaccaattgtgtggttaggagatgggccaaaggcatcaggcttttgaaagtagttgcatttagcataatttccattgccccctgccaatttcatatctgtcacatctaatcagtttaaaataaggggcatcctaagcatggagatggtccttggatggtccttggagtttctgtattktcagtattctttttyttgagcatacaagacatttattgaaaaattcttgggatcaatacttgtgtaaggaaaggaaagggaacaaagcatgattgggcagaggcagaagatgacatcaacaaaggccctccgttgtcagtattctttttttttttttttttttgagttggagtctcgctctgtcacccaggctggagtgcagtggcgtgatctcagctcactacaacctctgcctcccaggttcaagtgattctctgcttcagcctcctgagtagctgggattacaggcatgcaccaccacacctggctaattgttgtatttttagtagagacggggtttcaccatgttggttggccagactggtcttgaactcctgacctcaggtgatccgtctgcctyggcctcccaaagtgttggaattacagacatgacccactgcacccggcctgttgtcagtattcttaaacatagacactaactgtaggctgacagcctagcagcaaggaccagttaaagaaaygagtagaactgaagtgtgcttgagtatctctggcagtcagcaaaaacttaatgggratcatggtaggccaaatgttctgcagtatttcaaaagctgcatgggttttgagaggcttttggtccatcactcaccttaggttgttctacaagcacatcagcctgccccaatttaaacagggcagttagtaatggtgtaataaagagtctgcattgttcattccttcaacaaatactggctataatgtttcagcactgtggatgcaaagtgagcaggataaacaggctcttctttcaaagcttgtggtccactggaccacgtatgaagtagaatagtttaggyccagaaaggcaattaagtaaaatatgaccaagaagaggctctctagtgggtttggtataaagaaaagataagaatgatttagaattggcctatcaatgagataagaggcctggctttctggcactctgctctagggcaagtaaaatggagaattccaaattctgaaattgttagaacatagttctgtgtcttagttaaatatctacacttacagataaatagcataaatgctttctccccatatttcagcccagtcctacttaaagacaacataaattgcaaaatagtgaggatgttgttcatctaataaaagtggttccaggaattcagactctggattcctgtttgccaaatcatgtgtcccactcttaagaaaacgagttggactctggatttttctttgcaagagggacaagagtgtgggagatactgagttaatgcaacttgcaggttttaagtgtcctgtcattgtgccttgtgctttgatacattctgagkttcagtaaagagacctgatgcattggactgttgcaatggaacctgttttaagatcttcaaagctgtattgatatgaagttctccaaaagacttcaaggacccagcttccaatcttcataatcctcttgtgcttgtctctctttgcatgaaatgcttccaggtatttttgcaaggctaccagttacatttgacaagtctgtgcaatggatcaaaatcagaagagatgattcaacttggtgaccaagaagtttctgagctttgtggcctaccaanggagaaactggctgcagcagagcgagtacttcgttccaacatggacatcctgaagccaatcctggtgagyagacttgctcactggagaaacttcaagcactaatgctttcggaatgtgaggcttttccttggacagcatgactttgttttgtagaaaagtacggctggctgggagtttgtgatataatttagttcagtggtattctaagtgttcttagtgttctttcagacttttgggccatctcccaaagggtgaatgggaagaataagctgggtgtggctgagtttaagccaaaagttttttgtgcttgtttcaatcagagaagacctgctttttcatgtttttactattataatactaagcaagagctcatttgaaaacagagttcttcatatttaaaaaaaaaaagtcttgaaaccattgatgggaagatggatatctatttatgtttaaaaacccatcataaagatgacattgtrggctgtcacagttggaaggccctggaattagatgagaccacactatttagcttayttagtaataacattgcaaagaaaaattccgacraagttttttcagcctaggaatcaatagttcagagaagcactctatgagaatacccattcattcttaaccaaaaaatactggtgagcctgagcagtttggtcatcagagtgttttatatagttccagaacaaatatgtctctaggtgttctgagagctctggtgaaattcctctcsctaccccaaacatcatcatttaatatccaggattctggttttctactcaccagatagattctcttaaaaccagggaaagattcctggaggaaggatgtatctggaaagagatgttccttattayaataaaaygaaattgtaatactcttggattttgtgcagcacgaattctttatagagagttggtcctcccagagaattaagaatactcagtttctggaccctgttcccagatcataccctagaatgtgaccttagaaacacacttcaggattcatacctttgattgaccatcaaaaagtttttgtatcggccwggtgtggtggctcacgcctgtaatcccaccactttcggatgccacggcgggcagatcacgtgaggtcagcagtttgagaccagcctggccaacatggtgaaaccctgtctctacaaaaatacamaaaatagccgggcgtgatggtgggcacctgtaattccagctactcgggaggctgaggcaggaggatcgcttgagcctaggaggtggaggctgcagtgagctgagatctgtctcactctgttgcccaggctggagtgcagwggcgcgatctcgactcactgsaacctccgcctcycaggcttaagtgattctcatgcctcagcctccgagtacctgggactacaggcacctgccaccacgcccagctattttttgtatttttagtagacatagggtttcactatgttgcccagctggtctcgaactcctgagctcaagtgatctgcccacctcgkcctcccaaagtgttgggattaaaggcatgagtcaccgtgcctggtcccatgttataattttaaagtaaggtatatttctctacrgggatctttgcaaccctaagtaactggcctaaaaagttagagaagctgacttgtgcagacatttgcagcctrttggtcttttttgtgctgtgaatcatagagggtgaaaggttattatgaatggtacaaaactttgttacaaaaccattttcttggactgttttgggctgcttcactgcatgacaaatgctcaccctttcagytggaatgattgaaattttggaaaagatgggtgtttttagaagacattgtaatttgttccggtgctgtgcccattcattccatttcacttctgtttactcattaaacacctattgtgtacacaacccggtaaaatccctccactcacacaatgcctgaattatactcatagtagaatgactgtttagccctcatcatctgataattaacagctcaggtttcaacctgacagtatctctctgggaggattagcagcgtgacagagtgcagggaaatgcaccttcagaaccgtcagctacactgtgtcccatcctgctgtgttgtggttgtgccttgtggatgcgttggtttatgaccaggtattgattaaggtggctactaccrggtgctttctgcatatctcgggtttgtggagcactcaggttctgcttctgcccctctgctgttaccaagagacctctcttcaaaatggggctcttgagttagagtagaatgagtgatcaggattgttttgtgtaaagatgatttctgaggaaggctttaggatgaaatgacttccaaacattttgaaatgtgactcttacttattgaattaagcagggccttaattggaatgctgggactgatacttgatttgcattaagcagcctttttctattgctgcttggttgaaatttcaacatttgtgatggtagatggatgtgacatgtgatgacattgcacatgggcagttaactgtgccaagaagtgcagcagtagcagcaaccggagatgcaaagcccaacatgatggggagagaaactcttctttcaatatgtgcttctgtaccaaaagtggaatttcacgagagacatattttgaaacatttctccttttgtgtgtgcgtgagtgtttccctgtttccagccaagggtattgtgagtttctcctgggcctccttcagaatctgggtgctctggaaagcagtgttttggcaacatggggaaagtatggcagtgtgggagggtcagctgggtctgggtttgaatattgcatttgaatattttaccagcattgatgtcggataaattatttagtccctgtaagcctcagttttctcttcttctacatacacataatatatttgactctttgttgtgattattggttacacatatgaagagcctggtgtggggcctggcacacaataggtgctcaataaatagaagttgataatttaattgacatgagtagtagaaattatgtccttgaaaacaattgcgtcaagatagaagttttcagccaggcacagtggctcacatctgttgtaatcccagcatattgtgggggccgaggcggatgaatcacttgaggccaggagttcaagaccagcctggccaacgtggtgaaatcccctctctactaaaaatacacatatttgccaggcaggcgtggtggcgcacacctgtaatcccagctactgaagaggctgaggcacaagaatcgcttgaacccaggaggtggargttgcagtgagctgagatcactccactgcattccagccagcgtgacagagtgagactctgtctcagaaaaagaaaaaaaagatagaagttttcttctgtagatcagtgttagaactcataccaagcraagtggtcctggtgagtatttcagtgaaaaactgcattcttgctcagatattgtcaagacttttcacccaaagattcttatttatgtctcagtccrtaccttgtgtgaaaattaatactggatgtcagaacgctgttgtgtttttaaagttccctggggttaagagcagtttccattaggtgttctctgctttttacttaaaaatcttactcatgcattgagcaatatttattcagttcttattatgtgtcaggtattttctaggagctggactcaactcaaaagatatccttttgatgagaacaaaggtgggtggatatatgaaatattatctgtgggataaatgcacttagtcatgagggagacttgttatggagtgcgctcattgtatttgtactgttgagttaacaacttctaggaggagctcagggccacctggcaggggcttcttttgtcttgctgctcagcaaggtgtattttgctgtagagtgtgctgggcaggtgaacttttcttaactttctcttgggtccttcctaaagcagcatgtacctttcccagagcgaggagagggccaccttcctgtctcacagaaacctccaatctgttttggactgcaggaaggagccatagtagtggaccagcaaattttggcccgagagattgatttgcttccgattgtactttttttttttattgctactataacaagtcaccaaatacttagcagtttataaccacatacatttattatttcataaggccagaagccaggatacagtagagctcacctaggtctacttcttagaggctcacagggctgatatcaaggtgtttgtggggctgtgtttttttgggggggctctgaagatgaatctgctttggagctcatccaggatatcagatgaattcagtcccgtgcagttgtaggactgaagtccatttccttgctggctgtcagcaggggctggtttttgctcctaaaggttgccatcattccttcttatgcttttcatgtgactcctctcccacaagtgggttgagtatctctcacactttaaacctctgacgcctcctgtcacatctgtctccagtcagagaaagttctttacttttaagggctcaggtgtttagtttgggcccattcacataatccaggataatctccttattttgaggttcataactttaattacatctacacagtgcatttgctatgaaatgtgcatattcacagactccaggaatagggtgtggacatctttgcaggggatattcagtctgctgtagctttcttgattggaaggaatagtttatcatatatttgaagtgttccctcagtgcctttggyttttgttgacccctctgcagctctctgctttttcttgcccatatttggaaagtgactctaaagcataataagcatcacctattagggtttttaatgtacaaaccaaacagaggtgactttgggaggagaacatctctgaactaggtatgagacattcatcgaaaaaaatccatcaagtgtttattgtatgtctgctttataccagcactgttctaggcactgaagttcgacyaccaacaaggcarttgtgatgcacttggagctttcattctgatgggcattgagatccaggctgaaggctgagtctgggaatttgaggaattctttgtaggtcctgggtctacagagtgagagctgtcctcgttccagtttcactgatgacctctcgaccagctccctcacagcagtctttgccaacacagacactgtgggctgtagtgggaggaatgtggggttgaatgagctaggtttgggctctgtccttgactcaccattgcctcagtgatgtgaaaatggtgtctgatccttaaggttggaagtccaggcatgcagatttatctccatctcaataacgtggggaaaaaaaagaagtggtttttgtggaaccagtggttccactgtccacgtgtcttccagtgtgcctagcacattcccaccaagtggatcttggttcatgagggaaagaagggaaagtgagggtgccccgaggctcccagaagacaagtaatgtcacagctgagctgtgtacagatcgaagaagcagatggataaggagtgaacaaagtcatccttgtcttgaggggtctttatttagcttcttcttgactcttagacaaggacccagaatacagatggggcttgttgttaccttcagcctcatggctttttagggctagatacttcagcttgttacatgcagtccttaaagcgtctgtgtgggtttttgcaggagagaacacttgctcgtgttctcctgtctggaacccggacattgttggaaagtatcagattttgtttggctttgtgtgatttgactgcccacctgtttacttgctttctcccagcaagcagccgcaatccccatgggttggtaatgggtggaatgacacactgtgtagatttactcttcagactctatgttcacctcattcttatgggaaaagaagagcactagctggtagatatagcagtgtgttaatatgactgctcaactccatttacacagacattttcaccttagttatactatttcttcattaaatattgttgccagatctaagatacaggtttaattttttcctctgaattatgtggtagtagatgtatttaactatgtttagaaacagcaaaaaatgaagcgtttgaatgcgttaaacacatctaatttgaaagttaatatttaggttgttgatttattttttaaaagattagaatattccttagaaatgtagtcttataatttcgtatttcaataaaaaatattaaaatgtttcccagaggaaatctttactgtcatagaaatcaccagaaagagatagcaattactcctgggtggtgatagtctttgatttgtggtttacttgttttcagtttgaactaaaacatactaatcccagcctgagttggattttgcatatggtcaaagtgaagtagagatttttgtctactttatgaagatatttaaaggacatttgaaatgtttcaatgaacacattgtaacatgcattcccaggaggaaaacaaaattgtgtattgtgttgaaaatactattccaatatatgtatacccacgtctcattttgtcatagaattcctgaaaaatttagatgtagatgagatttttataagttgaaaatattttcagttgcattttaattgcacagatgtgttttctacttctatttggctgtgactcctaatgcattgtaatattatcttccagtgttcatttcgtgtagtgataatggattaacaaatgcattcattcatttagtaaacatttactgagccctaatcagtgccatgctctggcccagggaggtagtcatgtgcaaggtccagccctctctgtttcattcctggttggggaatgggtgggacagaccaggaaaggagcagctgccgtatagagcaggagacgctctgctgggtgtgatacagtccctgatggggcctcctactgcagtctttccagtcaggaargaaacatcctctaagtggggacctaaagaatggatgtcagccaggtaaagaacagggagtagaatgttccaggtagaggacatagtatatgcattggtccagagaggagagggaagagaaggtggcatttaggggaactgtacctgattgagatagttcagcatggagcagatatagctgtggggagtttgatgggagaaggaacgatgagacgtgatgcctgcagaggtgggcaaaggtcggctgaggcaggtctttcttcacgagccatgtgaggatatagggccttatcctcagagtaaagggagccattaaaggctccacaggctgagtgacttgatgaggtgaatacgaaacagagcatttctgtgaatgtgaatggcctttggagcagaactaagttcatgaggatggaaagaatataatgaagccatctcttagacccagaaagaatggggcacaacagcctttatctttctggggccaatgtcacagaatgccatgcttttaggaaacatggtatgttgtgattaacacattttgcagaagtgggtgggagcttttgaataataacagtaagcatttgtgcattcttcctgtaatgacattacagttatgatctgaaaatattgagtcatacatgaattcctgttatcttaactcagaaaatatagtccctcactaaaggttttattttccttctttttcccatttcctttacttcgtataagaaagtcacttgtctcctgggtgcaatggagacctatgtgagttcatagccaagagaatgtttttggttagaaaaataatagtaggaattccaagctgtgaattttttactgaagctctttggaaataggatttggcaagttttgtctgccttcgtcaagtaagcatgagcaggagagcacagttaatagcaggtgcagacacatgattctcagaccgtattttgtgttctagtttcaaggcatgaattctttcctggggttaattttattcaaggaagttatctgtctgttagatctgatatgtgctcaggccaacatagattctttacccttcctttcttcctgctcacctgtccttcctcttttatcttttcattgaattaaaaagaaaattatgaaatagtttcaacatgaaaaaaggtacagagaataacataaagaacactcctggctgggtgtggtggctcacgcctgcaatcccagcactttgggagtctgaggcagccagatcactggaggtcaggagttggagaccagcttggccaacatggtgaaacactgcctctactgaaaatacaagaattagccaggcatggtggcgtgcacttgtaatcccagctacgtgagagactgaggcaggagaattgcttgaacccaggagggggaggttgcagtgagctgagatcacaccactgcactctagcctgggtgacagagtgagactccgtcttcaaacaaacaaacaaacaaaaagaacactcctgtaccatcatccatcattttgccgtgctgactccaggttctatttaagaaataaaacattacaggtacagctgatgccacctctgtttccctagctcattcttcagagataactcttgtcttgcagttggatgttttaatcctctatatcatgtatacttacattctatgtataacaatatttggtactggcctaaatgtgttcacattgtataagtgtgcatattggcctgccacttcatttggaattatgttcttgagatttatcaatgttgatacatgtggaatctggttaatttttgccatagtattctatttttatactaaacttttaaaaatccatgcttctagtctttggcttattttttcaggttatggtatgttttggatgcacagaaaagtaaaattaagtcatgagcaaaatatctggataatccaagctttaaacttgatgtagaatttgaatcatgtgtgttttgttaaccctgtgatgtcaatccatgcctgattgtgtaactccaaccaatattcctttgaaaatggaaatttgtttatattgactacagattgccaatattattagtaaatgctgagcacttaatctcgaataaagaactagtttaaaaatgattctaacaatggcattgactgttctaccttattactcatgggtgggttcagccaatgtttctgttggagaccaaaaccaaaaacagtcaaattaaacaagcagtcaaacccaacatacagactactgataagaaggtcatatcataagatatggcattgaatttgtgtctgctaatgtaaaaatctgatgcccacagcaaacttaataaggacctatgtttacatccatgctcaattacattcctgggttaaacagtcatgctttaggccctgctgtgtgcctggagttttgctgaagtgtggggcttttaagagaaggagaataagcttgctccagagttaagaaatttaaactaaaagtcctaaagatgttggaaaaactattgcccttgaagatgtaaattcattaagttggagaagaccttttatacaaacaacagacccattcactgatttgtacccttcaggagacagatgaccggtaatggtgacaatgggtgaatgttgggtttggggtttttagaaacatctgcacttggtgactactgtatctaattggtgtgacaaacctggcaccccatgtgtttggcaccatcttgggtcctactcagggccaggtgaaccgagtggcctcttcactgcttcagagtctgaagcagattgtagtatgcggaccagacacagaatataccaccaagcacgttggcgcaaagcatactgggaagggaggctttgtgaacatggtgctggttctcaaacctcagtgctcaaaagagtctcctgaggattcctggatcacactcttaaacttctcattcagtaggtgttagctggttgagaatctgcatttttttttttttttctgagaccgagtctcactctgatgcccaggctggagtgtattggcgccatcttggctcactgcaacctctgcctcccaggttcaagcaattttcctgcctcagcctctctagtagctgggattacaagcacatgccaccatgcctggctaatttttgtacttttagtagagagggggtttcgccgtgttggccaggctcgtcttgaactcctgacctcaggtgatccacccactttggcttcccaaagtgttgagattacaggtgtgagccaccatgcccagcctgaatctgcatatttaacaagcaccacaggtgattctgatacagtagctccccaaacctcacagtgttagtgaatcccagtcatttacaattctgccatgattttggtcatattcaagtgcagctggtagcatttttagttaatatattttttaaattaagtcacttcttttggataattaaatttaattacaagggaagctataccactgctgtaaaaacatcacctgctttaaagagaaggtacataatgaatatacattaagataaagatgtatatgtgtgtgtgtgtgcacatataagtatacacatacctaccatagggattgagttttccttcaggtttttcaactgaaatgtcaactttgaggccagttaatatgtgtaagatatatgtgtgtatgtatgtctatacatatagacatatacgtaaaaacatacatggatgcatatagtatatctatacacaacctattatgcatatcatgtatatttcatccacttagtattatcttttattttgccgtttggcaaatgctcagtaaaagaaaagggttagaaggggagaaaggcattttatcccaagccttcaggaatcaggatgaggatgtcttcaccttgtggtggggagtaattatacaattagagacagcacattggagtgtggctgatatgctgtgtgatgatagctctagctctctgcctagcagaggaaggacatttcaatagaagaaaaagtttaagaccttgccgagaaacagagaaaggatgtttgtctttttaagaagttgaaaaccctgtttgcagacaaaagccctccagttttggcagtaaactttcatgcaagggaagaaaaaggcaggggatgacattgttgacaattgtgaggaattaccatgtgccaggcactgtgcgaggggctttgtacatatcctctagttttagtgcttataaaaactctgtgatatgtgcacagcattttaaactttgctgcatagtcgagaaaatggaaggatggggaatttgagtcatttgcccagggttctatagctaccccaggttcccatgactggagaattggggcacagggtggcgggggagagtgagtgacaagaatcctaacaatcttatttccattgagtccttataaaagaagtggattaactaccacgtttttaagtttttcttaaatttaggttatgtggatctggcgtttcttgttttgtcctgggtttgttttgtttttgctatgctgtcttgaacatctgtcatcttgtaggcctaacggtaaacacaaaaacactttacctcctatagctttcaattaagatctctcagtttgtgtttgtaatagttttccaggcaagttctccctaggttcggcttctagtgtgttaacctttagttataaagtgaacccaaagagagaaagtagaaacaaaacacctcacctgtttttgctcatgaattactctctatggaaggaacaatcatgaacacctctgcgtatcacagaggcctatctgagtctgacgtttaagggagaccgcgtaggtccctttgaggactgtgaatgtgggagtcctgggactctggtgaagaacccgttccagaagagatgaatgagctggacaagttctttcatagaacctttaggcaggttttcttagaaatgcacattgaggattatgcttggatattgtgatgatcagaatgatactcaatcccttctgcatttggaattctctttgaaagaaaacatcccaggcagctatttctcagagatagtgagtcccagccacttctagacattttcttgtgtagtctacattataatttcacagcagtctctgatatgacaaatgtcaaaatagcccaaccttctctaaacttcagagatgtctgatatgatattgaataaaacaatgctcatagaaacatcaagaaaggtggattttccctggatacttttttcctgcttgacaaataacagtgaagaaactgatctcacgtctttttctctttggaagcctgaacactcagaacccaacttgaggctcctcagctatagcaattctgacttcacagtctgtaaattattgttcttttttttctttagcttatgctttctgccctaatttatcttttccctgttctaatgaattattgtcctatatctgctgtgcagttaggtgacatataacagcaattaaatatatgaattggtacatataaagatttgactaaaactcgatgtaaaaataagtgttctacattcaatttccagtgttagaaacagtgctgacttgaacagagtgacagaattccatctttccctatttttgacagctttaaactttatattttcttcctttcttgtgagccgtcattaacttgtttctcaaagccattcccgtattacccatcttgcagacgcagacagatttgggaatttgcggtcagagttgtattggacacatccccccagcccacatgagatccttttaatctattgcatattaactagttttaagtacaatattcctacttcatttaaaaccattaatcaaagaatgagtttgaaaatgaacaaaatgcaaacttacagttagaaataattgtagtgtctttagttttggttaggagtcggtttcttgtttgttaaactcaagattgtgaacagttttaattcacttgtttatttccaatagagatttcaggtttacatttgaattcagaaacaaagttttctttctcattacagagaacactaaactctacatctcccttcccgagcaaggagctgrctgaagccacaaaaacattgctgcatagtcttgggactctggcccaggaggtaagttgtgtctttccagtaccaggaagcggatcatccactgtatcagtattttcattcctgagtctggcaagaggtccttttgagttgaatatcacatgggatgtaatatcaattttcaaagtataagtgatgtaaacaataatgttttgatttccttattttagaaatgaagaaacctaaaactcatagatgtctcagagctaattggttagtggctaacagctggatatctagtttagaaccttctccattttttctttttgcccctaggtaatcatacatttgtaaagaggagaattatctctgccactgcccatgcactgcttttgtctgaccagcaatttctccatattgcttcttcagtagcaaggccaatcattttaccaacacacatgcttgctaactaacaggaataacgtggtacccctaattcagccctttcccttgaaagcatctggcttctgaggttcaactatgggaatatggtctcttaatgaacattaagttgagtttgccttttaggtccacatgttgacaaatgtrtcagagtaatctctgtcctaggatcagagggcctgtaggcacttgcaaaagcagttagctctgactcccagccagtgcacactccacctttctgactcccagccttgtctcaaattaggcttggaagcgaggaactgtctggtgtcccccagcataggaagctgagccagggggcagtgctcacaaacaatacagactttaacgtgtaggatattggaaaataataatttgtggggaaattgtctcagacttggtccacccttatttttagctgcttctctaatccgtttttctttttttggtgcttgtatctaacctacccattttttggtgcttgcatcattttttcaaatatcaaaaacgaactttatgttttctaacaatgaaagtattgcatgttcattgtggaaaatgctgaagacttggaaaatacaaaaatgctgagatcaaacactattgatacgttagtgtatttcttcctgtcctgttctacttwctttctttgaattctgctcacgtgtttctgactgatgaggtctgacttttgggttccttttccagaggagaagccttctttcagcttgccatttgttaccctggttatgaaggctggtaaccttttttactaggtagagaagctggaccaactggggttcttccagggggagaatgagaaagagaaactgttttgcaagtccgtagctatttctctagggccctgttagctgacattgacatgccttgcattgctctgcagatcccctcgcagccctctgtcccttgttcatttctggccttagagaaagcaaagcagggtctgtaacaggggaggctgcctctaaactcagggtttggttacagctgttttcacttacatcactggccctggttttttttttttttctggcattaaaaaaaaaaattggaagcaggtgatgttcccattgctgatgtggtggaaactctccaagtgaacaatatacgtttttcttggcagctgtttcttgtgccctgcttgctcctggtccaggacaagcaaggaccatctgcctctttcaatagaacacctccagatccctttgatcaaaagttactcattgtctgacttgctatttctgtgagataaatgggagaagatcaataaatgcacttgtttgtccagtcagcgtgtggaaagttgataattttgaccaaagcacaacccttgaaaggaaaagaaaaagggagtgaatgtcttctgagaagctgcctaggttcagacagtgtcacccatttccctgtatgctccacatgacaaacctgagtgggtctcatcatgtccattttgcagatggcaccaaggctcagaaaggttaggcaacttttccagtcacccaatgagttaattgacaaaactgggattcaaacccagaactgttggattccaaagcctgtgttgttgcctgcttcgtgaaaaactccagtagcgactggaatagaaaggagaaccttccaagaaagaaaatacgcactagcagaacctggaaattgggaggaaatgaggacttgaggaataagatgaatgaaagctgacctgagtttcacatctgggtgatgggaagggaggacagggaggcagcatctcagatgtccacccagcaccgaccagctgcctggcattgctaggtgttgaggactcagcagtgaacacgctaacttctctgctttcttggggcacgtatagggtgagagacagaaacaaacaggtcagtgtacaatgccacaggagggatatatgcagtgaagaaaaagcagggtaaggggcatagagcatgagaaggtgctttttttaaagggggtgattaggaaagctctctctaaggtgacagttggacctgaaggagatgatagcatgtctgtggtgagggaaggaaactccgaacaggaagaatggcagatacaaagacattgatgctagagcatgcctaaggaatgtgtttaaggaccagggaaagtgagcaagtggtggggggaggagaggagctcagagcaggaggaggtgagtgccatacaggcctggcaagactttggattcctgctgggtgagatgagaatccagcggagggcttgagggaggggacatgatgtgatctagagtttagactgtttacactctggttgttgggttgagaagagactgggatgggggaaagggaggacaaaggacattgtgctggattgagaaagcagtaagtcagtttcattcattcactcarccgatgatgttcaaataccaccatcatccgtgggctaaaggatgaagagccatccctccctgagagtcaggaagcacttcccagataaagtttggagtgtgagctgaggtgtaggagaaagagtaagagtttacccctgaaacgggtgctgggaagagtcaatagtttggaataactcaataatttatggtgcttctttagaaagatttgctggctttatgtgggaagaaatttktttttttgattggggagtggtgggttggtggtgaggctgcctgtggaaagagaagtgagtgttttgactcactgttatttaaaaatctctagggctgttccaataagcaacaaaaggcaaaatggcctggttctctgtcmcctttctgtctgtatgcctcgtacaggttatgaaaagaaaaagttgggaaaagctgtccacctcacctaattgtrttcttgtggagtgtgctagatgccccctctctggagaaaaaaaatccttgtggcctctgacccacctctggagagcctagttcccttctggaggcagaaggcaaagcttaggwcctagagartgctggaccacgccactcacaggaaccagcaggctgtgaggttgaaagctaggcatatggagctttccaggctgggtgcagggcctcgtggcccttcccctcccctctgtgctctatagctcagtcttcccaggcggtgtgaacacgcagtgacatttccaggaatacagggatttattaatgatttmttgtgaaatgtttggaaatacaaagtactctataaatatttcataatagcattggggctgagaactccacaaagtgccggaatacatttgcatgtaagacagaacgctgcctgggtcattgatgcctgttgagtggcagtcacagacactgcctrgggtttctgactcacgctgttgggactgttctatgcagggcaccctcttgtgtggcataggatttgtgcctcaccacasactgttgtagctttgctgtcttgatgatgagtagagggcagtgtccaggccatggtataagcatctactgccccccagggttaccaaaaccaagccaagttgtgtctcagcgagctccgtgaagcatggagaagttgagtactcagagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcctgcctcagcctccccagtagctgggattacaggcacctgccaccatgcctggccaacatttttgtatttttttagtagagatggggtttcaccatgttggccaggctggtcttgaactcctgacctcaggtgatccacccgcctcgacctcccaaagtactgggattacaggtgtgagccactgcaccsggcccagactcgagtttttcatcttaatgctttttcattgcctgacactttactgagaccaagatagggaacttcacatacagtaccttttctcccaaggcggaagagggctgttcaatttctacactagagttcggggagttttagaaatgagycagttrtcgaggatgagagcagttcctgataggctcaaccacaatgagatgtagctgttcagagaaagcattcttttatctataaactggaagataatcccggtgaaacraagcccagccccaggggcttcactaactccaggctgtgcttctcaaactttagtgagcataggaatcacctgggcatcttgtgaagctgtagatttgaattctgcaggtcggcagaggggtctcagaatccgcatttccaacaatgtctccagtaatgctgatgctgctcgtccctggaccacagattgggtagccaggttctggcaagctcatcccaaggctttgagatgacatcagacaaaatatgttctgggacatggcttttgagaggtcaagaaaataagatgtttctttctcttctcatccccaacccttgcactgcccttttctcccttcccctaccctcctttctgtccccatccctgacgccagctgttcagcatgagaagctggagtgacatgcgacaggaggtgatgtttctgaccaatgtgaacagctccagctcctccacccaaatctaccaggctgtgtctcgtattgtctgcgggcatccygagggagggggrctgaagatcaagtctctcaactggtatgaggacaacaactacaaagccctctttggaggcaatggcactgaggaagatgctgaaaccttctatgacaactctacaagtgagtgtccatgcagaccccagccctgtccccaaccccatccctcccttagttctggccttggcctgtgtcatctcctccctctgtagcagcgttagatgtctacatgcccatttgcccaccagactgagctcttcctagaggagagaggcttctcttgaatagctacctgtccccagttctctgaatgcagcctggcacatctcaggtgcacagtagtgtttatcaatggaatgaatgattgacagccaaccttctggttttctgggggatgtggaagggtggcttccagggtgatcaagaatgagataatggcagaaggacaaatcctgcaagatctcacttatatatggaatatatgtaaggtagaaagtgtcagtttcacatgatgaataagttcctgggatcttgatgtacatcgtgatgactatagttagtaacactgtatagtatacttgaaatttgctaagagagtagatccgaagtgttcacactacacaaaaaaggcaactatgaggtgatggatttattaacagcttgattgtggtgatccttttacaaagtatacatatattaaaacatcacattgtataccttaaatatatacaatttttgtcagttgtaactcaaaaaagctagaaaagcatttttaaaaaggatgatgtactggtcttaatattaccattgagataagctttataataacataaaaagaaataacagtaatgataatagcaacaacaacaacaacaaaraactaacatttaagtagaatttcttgtgcactgtgcattctgtttaagttatctcattttaccctcatgataaccctgcagggaagattctttaaccccacatttcataggctcagagaggttaagtgccttggttagagccacatcagagttaatccacaagagccaggattcaagcccaaatctgcctggatctgtgctctctaagataactgttagtggtggcgtgtgtgttctcacactcagacatttgatctgcyctttgtttcccattcttagctgcaaggcrgtgttaaagaaccctgtgtctccatatccactccccacacttaagcacttttgtgggcccgtgtgccgtatgcctcgtggcagcagggatccaatgtcacagttttaggcagtggcatccttttccttgaaaacttgatgcaggggaacctttctccatttccaaccacaggtgtgtctttcagacactgagtgaggcaggttttgtactttattgtaacacaagaaccttttctyctctggagtaaagcactccagacattcgcaagttgctttacaagccttaaaaggatggtattgtaggcaactttaattaaatcccatctcctcctctcccccagcttgcaagttgacccaaggaagccttcatttccatgacagacttaattgtgagggcatcctcattaaaaaaaaaaaaattctattatctttccagcatatagaagatacttggtatctaaaaatccctgaaaaacttagaatgaatttttaaaaatcagggatcctgctggataaccaaacccatttgtctgttacaacttttgtatttgggtttttgttaagtgtacatatactagtttgtgttaattaaagagaatttttttttttttttttgagagggagtctcgctccgttgcccaggctggagtgcagtggcgccatctcggctcactgcaagctccgcctcccgggttcacgccattctcctgcctcagcctcctgagtagctggaactgcaggtgcccgccaccatgcccagctaatttttttttttttttgtattttgagtagagacggggtttcactgtgttagccaggatggtctcgatctcctgacctcgtgatccgcctgtctcggcctcccaaagtgctgggattacaggcgtgaaccactgcgccctgttgagaatttttttttttttttttgggagacggagtttcgctcttgttgcccgggctagagtgcagtgacacaatctcggctcactgcaacctctgcctcctgggttcaagcgattctcctgcctcagcctcatgcgtcaccacgcccagctaattttgtatttttagtagagacagggtttctccatgttggtcaggctggtctcsaactcccaacctcaggtggttcgcccgccttggcctcccaaagtgctgggattgcaggcatgagccactgcgcccagccccaaattttggtttttgcttgaaaactgaggtctgaattcagccttctggttgcccctcaagagtcagtttaaatgttggtcatgttagttgtcagtgaaaacaatggtgaggctggcatgagagtgtgaayctggatgggagggcttgtgcttcaygaaaacatttttccagatcagctcagtcgtgagttatccgtcattgacgttataataagctctgattatttatcaagcatcattctttatagatatctcagtttaatctgagataatcttctccacatctctccacatagatgttatgaattttacttttacagaggagccaactgaggctcagataagttacttattatatgactagtagtggtagagctggggtttcarctaagaactctctggctccaaagcccttgtaagtttctatcagtatatgaccatgcatatgagcatttgtctctcctcttcttcatagctccttactgcaatgatttgatgaagaatttggagtctagtcctctttcccgcattatctggaaagctctgaagccgctgctcgttgggaagatcctgtatacacctgacactccagccacaaggcaggtcatggctgaggtaagctgcccccagcccaagactccctccccagaatctccccagaactgggggcaaaaaactcaaggtagcttcagaggtgtgcgctaagtatactcacggctcttctggaattcccagagtgaaaacctcaagtctgatgcagaccagagctgggccagctccccagtcgtgggtatagaatcatagttacaagcaggcatttcttggggatggggaggactggcrcagggctgctgtgatggggtatcttttcagggaggagccaaagcgctcattgtctgtgcttctcctcctttttctgcggtccctggctcccyacctgactccaggygaacaagaccttccaggaactggctgtgttccatgatctggaaggcatgtgggaggaactcagccccaagatctggaccttcatggagaacagccaagaaatggaccttgtccgggtgagtgtccctcccattattaccatgtgcctgcttgatactggagaggtgagtttctggtcactttcccaggtgtgagtgaggtgagaattctttcagtttatctagctgggggaatgtagtgagcatagctaaagtcacagggcaccacctctccagaagtacaggccatggtgcagagataacgctgtgcatatcagcatccatgccactcacggtcaaatagcagttttctgcaaaactyagtgagggctggtgtttggaagtggagttgagtaattgcagtaccctattttcctttttggctgcagcctctcagccagccacagcatctccctgtgtcttggtaggttttggaaagaagtgtgggagcaaamgcatgatgttacatgtagactggcctgagatactcattctcagggcactgtgtgaatgatgagctgctgttactgtgtggaggggaaatgcacttagtgcttcagagccacttgaaagggataagtgctctagagacaattggrttcaaatgtggagcaggctgagcaagaacagaatgtctcctttgcctgagcctgagtgctgttaatcacatcttcctgccttgggctgagttagagaatcattagactatttcctgtttccatggtgagggaggcctcttccttttgtctctgctccccttaagaagcaggtgaggattttgccaggtttcttgttttgaaccttattgactttaagggcggctgggttttagagactgtacctacctagggggaacacttccgaagtttaggactattccctgatccgctgggaggcaggttactgaggaagtccctttaaaaacaaaggagtttatactgagaaaagcataaacagtgatttgtatggattcacactgactaatatagctcatgccattaaagtggggtctcttctctaaaggagggttatatgatctagccccgtagacctaagtgtggtttcagacctgttcttcctggtcctctccttggaatccatatttctactagttggactttttctgtttgtctggctctcagaggattataggaggccctgtgaagtgactcagtgaattttgatttgtgggcaagtagatggttccctagtctgaaattgactttgccttaggtgcttcaattcttcataagctcccagttcttaaaggacaagatccttgtaaacatggcaatggcattcattaggaatctagctgggaaaatccagtgtgtatgcttggaaatgagggatctggggctggagagaaaggcatgggcatgccttggagggacttgtgtgtcaagctgaggacctttactttaagctctaggggaccaggcaaggggagatgtagatacgttactctgatggggtggatgaattgaagaaggatgaggcaagaatgaaggcagagaccagggaggaggctctccaagtggccaaggcataaagcaagaaatgaggcctggtgactgcttagtggcagagcagtgaaagagagggaggcatcaaagygagtctcgatttctagctgggtgggtggtagcgatgtccagtaggccagtggctactgaggtctgcagtggaggagggtggttgggctggagacagatgatgagggagtcatcagcctgtgggtggaagaaaagggaacctcttccaactgttttctttgcttcttccctctctttctctttttttttttttttggacagagtcttgctctgtcaccyaggctgaaatgcagtggcatgatcttggctcaccacagcctccgcctcctgggttcaagcaattctcctgtctcagcctccagagtagctgggattacaggcacatatcactgtgcccggctaatttttgtattttcagtggagatgggatttcaccatgttggtcgggctggaatgaactcctgacctcaagtgatccacctgcctcagcctcccaaagtgttgggattacaggcatgagccaccgcgcccggcctttcttccctctcttaaagagtgtttatttaattccacaaacatgagcttgtcaccccctgtagcctggcatctcctacacgaggtgatggctgaggcttctgcttctgctggggtagctctgatctttctgctttctctggcactgtctacccatgttgcctcaccccacaggtcccagggcacctctctcgggcaagtcttggaaccctctgacactgatttgctctcttttctgagctgcttttagccacccatcctcrggacctgttttctctctgcctccacccctgcgggcagtcttaggtctcctgcccctcacgagcaccccagagaggccacgtgctcagtgatctcagtgggcgcatctttctagtcttgctattctttttggycatgttgttcagaaaccatactgggcagggccgacttcaccctaaaggctgcgtctcttcactctgcttttgtttgttccaaataaagtggcttcagaattgctaaccctrgcctctgtgaacttgtgaggtacaattttgtgtctgttatgttaacaaaaatacatacataccttcctggtgatggtataaattgctattctctattggaaagcaatttggaatgaaaatttaaagaaccattttaaaatrtgctatcctgcgtacctccattccacccacccccagggatgtagcctactgaaataattttaaagaagtcaccatatgagagaaaatgttattgctatattgttattgtgagaaattggaaatagactaaatgttcagcactataggaataattaatgaaattacatatactctatacaatcattatgctgccattgaaataataaatacaaaggcgcaaggggggaaaagcttataatgttagtgaaactaagactgatttttttataaagcagcagttttcagacccttggagactccaattcggtagaaccagrgcttcatcttctctgtcgaagctgtgacaggagttgcaaatgcctctcctttttgctgagtttgcagctgctgtttttcyggcagcacatctgtgcaggcctctgcctcggcccctctggatctgctgattgagcagcggattgatctgtccttctctttcgtgttgacccatgtgaggaaccractggcaagggaacaagaaatggaaataggcctcctttgcatcatgacctgtacatcctgcaattggaaaagattgtactttagttggtttaaccagcagcattatttttctaaactaagcaktaagaaggaattaggttttatgtgggatcaacagactgggtctcaaaagaggaaggtgatagaacacagtggggagggggaggtgcactagaaacagagggcctatgctttcattctggctttgctacttaatagctgtgtgacccaatcttagagacttaacctctctgaacttccattttctcatgtataaaatgggaaatattaaaggatactcactgggctggtggcttgtgcctgtaatcccagcacttggggaggttgaggtgggaggatcacttgagcccaggtgttcaagaccagcccaggcaacatggcaagactctgtctctatgaaaaaattaaaaattagccaggtgtggtggtgtgcacctgkagtcttagctacttggtaggctgagatgggaggatcacttgggcttgggaggtcaaggctgcggtgagctgtgattccatcactgcactccagcccgggcggcagagcgagacactgaatccaaacgacaacaacaacaaaaggcaaaaaaataaaagtgccctctttatggagttgtgtaaggtgaagcatatacactattcaacatagtaactatataaaggaagtattgttgttgttactgtagttaataccattaagtgagatgtttcgtatagtggaaagcacatggactctgaattcagactggtctgactttgagtctcagctccacatctagtaatactatgaccaagccctggttaaaatcatgtttttttttcttcagcctyagtcttctcacatataaaatagggacactgtcatttacctcagttttctgtgaggataaaacaacgacagtgtatatgcaagtattttgtaaattttgtagtgctcctcaagatttagttggtgtttactacttgtactttctcactggaatggcagatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggaggtgaatctgttgctgggatcatttagaaaagacttaacggcttctttctctgagacgttacaataaggttcaggcaggaggcaagtttagaaataatgtatagtctcatttacaaaactatccctcaagcctaacacaggatttgataacaaaaggcacttaataaatgttagttgagtggttgaatgagtaaataaactctagctttagtaaattaactctagcttattctatataggctcaagagaatatttctacccattttcttctaggttttcctatctcagtgactaatggtagcaaagcattcccttaaaaaggcattatttgtgaaacttayctaaaatcgaattcgggtccaattaaatttttgaaattttatattaaaaattatattagtagggatgggtaagaggtgttttggtctggttggttggttagttgctatgactcagaattgctaagaaaacagaaaagtaagataagatcaytgttttaacctcttttcctccacaaaatcaataaataacatatccctaaattactcttagaatttctcttaaattgcagtgaaaaaccaaaatccttcattcttggttgaaggttggaaaactacgttagagaggattagagagagaggatgagcaatcgtgtagtcagcccttgcctcctagtgtaggatttgtctcagccactgcttgttgtcctggctgccaacgttctcatgaaggctgttcttctatcagtgtgtcaacctgaacaagctrgaacccatagcaacagaagtctggctcatcaacaagtccatggagctgctggatgagaggaagttctgggctggtattgtgttcactggaattactccaggcagyattgagctgccccatcatgtcaagtacaagatccgaatggacattgacaatgtggagaggacaaataaaatcaaggatgggtaagtggaatcccatcacaccagcctggtcttggggaggtccagagcacctattatattaggacaagaggtactttattttaactaaaaatttggtagaaatttcaacaacaacaaaaaaactcaacttggtgtcatgattttggtgaaattggtacatgacttgctggaaggtttttcataggtcataaaataacagtatcttttgatttagcatttctactcaagggaattaattccaggaattttggtggcaggcacctgtaatcccagctactcgggaggctgaggcaggagaattgcttgaacccaggaggcagaggttgcagtgagctaagatcgcatcattgcactcccgcctgggcaataagagtgaaactccatctcaaaaaaaaaaaaagatrcaaaaatagaaaaaggggcttggtaagggtagtagggttttgggcaatttttttttttttttttttttattgtatggttctaaaggaatggttgattacctgtggtttggttttaggtactgggaccctggtcctcgagctgacccctttgaggacatgcggtacgtctsggggggcttcgcctacttgcrggatgtggtggagcaggcaatcatcagggtgctgacgggcaccgagaagaaaactggtgtctatatgcaacagatgccctatccctgttasgttgatgacatgtaagttacctgcaagccactgtwtttaaccagtttatactgtgccagatgggggtgtatatatgtgtgtgcatgtgcatgcatgtgtgaatgatctggaaataagatgccagatgtaagttgtcaacagttgcagccacatgacagacatagatatatgtgcacacactagtaaacctctttccttctcatccatggktgccacttttatctttttatttttatttttttttttgagatggagtctcgctctgacgcccaggctggagtgcagtggctcgatctcggctcactgcaacctttgcctcccgggttcaagctattctcctgcctcagcctccacagtagctgggactacaggctcatgctgccacgcccggctgactttttgtattttagtagagacgaggtttcaccatgttacccaggctagacttcaactcctgagctcaggcaatccaccctccttggcctcccaaagtgctgggattacaggtgtgagccactgcacccagcccaccactttaattttttacactctacccttttggtcaaaatttgctcaatctgcaagcttaaaatgtgtcatgacaaacacatgcaagcacatactcacacatagatgcagaaacagcgtctaaacttataaaagcacagtttatgtaaatgtgtgcacttcttctccctaggtggtaaaccacatttcaaaacaacccaaataaaactgaacaaagcttcttcctcttagactttttagaaaatctttcagtgctgagtcactaagctgccaagttctcattgtgggaactatgcctttggatgtaatgatttcttctaagacaatgggcggaggtgtagttattgcagacatctgaaatatgtaatgtttcttccagattctggaaattctcttattctctgtggttggtggtggtggtggsatgtgtgtgtgtgtgtgtgtgtgtgtgtgtgtgtgtagggatcaggatgcgggaggagctgggttctgcttktattggttctctgttttgcattgaatagtgtgtttccttgtatggctatctatagcttttcaaggtcaccagaaattatcctgtttttcaccttctaaacaattagctggaatttttcaaaggaagacttttacaaagacccctaagctaaggtttactctagaaaggatgtcttaagacagggcacaggagttcagaggcattaagagctggtgcctgttgtcatgtagtgagtatgtgcctacatggtaaagctttgacgtgaacctcaagttcagggtccaaaatctgtgtgcctttttactttgcacatctgcattttctattctagcttggaatctgaaacattgacaagagctgcctgaaatgtatgtctgtggtgtgattagagttacgataagcaagtcaatagtgagatgaccttggagatgttgaacttttgtgagagaatgagttgtttttttgttttggtttttagtactttaacataatctacctttagtttaagtatcgctcacagttacctagttactgaagcaagcccccaaagaaatttggtttggcaacactttgttagcctcgtttttctctctacattgcattgctcgtgaagcattggatcatacgtacatttcagagtctagagggcctgtccttctgtggcccagatgtggtgctccctctagcatgcaggctcagaggccttggccyatcaccctggctcacgtgtgtctttctttctccccttgtccttccttggggcctccagctttctgcgggtgatgagccggtcaatgcccctcttcatgacgctggcctggatttactcagtggctgtgatcatcaagggcatygtgtatgagaaggaggcrcggctgaaagagaccatgcggatcatgggcctggacaacagcatmctctggtttagctggttcattagtagcctcattcctcttcttgtgagcgctggcctgctagtggtcatcctgaaggtaaggcagcctcactcgctcttccctgccaggaaactccgaaatagctcaacrcgggctaagggaggagaagaagaaaaraaatccaagcctctggtagagaaggggtcatacmtgtcatttcctgcaatttcatccatttatagttggggaaagtgaggcccagagagggrcagtgacttgcccaaggtcaacccagccgggtagcagctaagtaggatgagagtgcagggttcatgctttccagataaccacatgctcaactgtgccatgctgtctcattggtagtggttcatggcagcatctgaaagctatttattttcttagatatattgggtggcgattcttcctaagtttctaagaacaataatcagaaggatatatattgttgcaggttagactgtctggaagcagaggctgaaatagagtttgatgtatgggtatttatgagggctcaatacctatggaagagatatggaagatgcaggattgggcagagggaggagttgaactgtgatatagggccaaccccgtggggcactctagagaatatgcagcttgttggagttgttcttcatcgagctgaaacatccagccctttgtgctcccccaaggcctccctcctgacaccacctacctcagccctctcaatcaatcactggatgtgggctgccctgggaaggtcgtgccccagggcctacatggctctctgctgctgtgacaaacccagagttgctgatgcctgaggccgtctactgacagctgggcaacaaggcttccctgaatggggactctgggcagtgcagttttgtgtctgaaccatacattaatatatttatatccgaattttctttctctgcaagcatttcatataaagacacatcaggtaaaaataaatgtttttgaagcaaaaggagtacaaagagataagaactaactaatttaatactagttaccatctgttacaaatagttcctactgattgccaaggactgtttaaacacatcacatgggcttcttcttctatcctcactaacccttttaacagacaaggaaatgaggctcaggaaggtcaaggactttattgaggttccacagtaggatacagttcttgctaaaagcaacccctccctcatgctctgttatctaactgcaaggggaaggtcagtggcagaggtagtggtcccatggttggtgcataagagctgctctgagacaactgcatgctggtgggtcctgcagacatgtasccatcagccggagataggctcaaaatatccacaagagtttggatgattgtgggaatgcagaatccatggtgatcaagagggaaagtcaagttgcctggccattttccttggcttttagacagaaaagttacgtgggatattatctcccacagctcttctgtggtgccaccagtcatagtccttatataaggagaaaccagttraaattacctattgaagaaacaaagagcaaactcgcccactgaaatgcgtagaaagccctggactctgttgtattcataactctgccattatttttctgcgtagttttgggtaartcacttatcttctttaggatggtaatgatcagttgcctcatcagaaagawgaacagcattacgcctctgcattgtctctaacatgagtaggaataaaccctgtcttttttctgtagatcatacaagtgagtgcttgggattgttgaggcagcacatttgatgtgtctcttccttcccagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacrtgggcttcmcactcaagatcttcgctgtgagtacctctggcctttcttcagtggctgtaggcatttgaccttcctttggagtccctgaataaaagcagcaagttgagaacagaagatgatwgtcttttccaatgggacatgaaccttagctctagattctaagctctttaagggtaagggcaagcattgtgttttattaaattgttwmcctttagtcttctcagtgaatcctggttgaattgaattgaatggaatttttccgagagccagactgcatcttgaactgggctggggataaatggcattgaggaatggcttcaggcaacagatgccatctctgccctttatctcccagctctgttggctatgttaagctcatgacaaagccaaggccacaaatagaactgaaaactcttgatgtcagagatgacctctcttgtcttccttgtgtccagtatggtgttttgcttgagtaatrttttctgaactaagcacaactgaggagcaggtgcctcatcccacaaattcctgacttggacacttccttccctcgtacagagcagggggatatcttggagagtgtgtgagcccctacaagtgcaagttgtcagatgtccccaggtcacttatcaggaaagctaagagtgactcataggatgctcctgttgcctcagtctgggctycataggcatcagcagccccaaacaggcacctctgatcctgagccatccttggctgagcagggagcctcagaagactgtgggtatgcgcatgtgtgtgggggaacaggattgctgagccttggggcatctttggaaacataaagttttaaaagttttatgcttcactgtatatgcatttctgaaatgtttgtatataatgagtggttacaaatggaatcattttatatgttrcttggtagcccaycactcccctaaagggactctataggtaaatactacttctgcaccttatgattgatccattttgcaaattcaaatttctccaggtataatttacactagaagagatagaaaaatgagactgaccaggaaatggataggtgactttgcctgtttctcacagagcctgctgtctcctgtggcttttgggtttggctgtgagtactttgccctttttgaggagcagggcattggagtgcagtgggacaacctgtttgagagtcctgtggaggaagatggcttcaatctcaccacttcgntctccatgatgctgtttracaccttcctctatggggtgatgacctggtacattgaggctgtctttccaggtacactgctttgggcatctgtttggaaaatatgacttctagctgatgtcctttctttgtgctagaatctctgcagtgcatgggcttccctgggaagtggtttgggctatagatctatagtaaacagatagtccaaggacaggcagctgatgctgaaagtacaattgtcactacttgtacagcacttgtttcttgaaaactgtgtgccaggcagcatgcaaaatgttttatacacattgcttcatttaattctcacaaggctactctgaagtagttactataataaccagcaattttcaaatgagagaactgtgactcaaagacgttaagtaaccagctttggtcacacaactgttaaatgttggtacgtggaggtgaatccacttcggttacactgggtcaataagcccaggcgaatcctcccaatgctcacccaattctgtatttctgtgtcctcagagggggtacaactaggagaggttctgtttcctgagtacaggttgttaataattaaatatactagctctaaggcctgcctgtgatttaattagcattcaataaaaattcatgttgaatttttctttagtacttctttcttaatataatacatcttcttgaccaagtccaagaggaacctgygttggacagttttcatatgagatcaaattctgagagagcaagatttaaccctttttggttcaccttctgatcctcccctaaggaggtatacatgaaatatttattactcctgcctgaacttctttcattgaatatgcaattttgcagcatgcagattctggatttaaattctgagtcttaacttactggctgagggaccttggataggctccttatccctcagtttcctcatctctaaaatggggatggcacctgccccgtgggttgttggaaggacttacagaggtgcagaatgtacgttgtacatagcaggtttcagcaaatgttagctccctctttccccacatccattcaaatctgttccttctccaaaggatgtgtcaaggaggaaatggacctggctgggaaaccctcagaatactgggatgwtgctgagcttggctcatacctgtgctttgctttcaggccagtacggaattcccaggccctggtattttccttgcaccaagtcctactggtttggcraggaaagtgatgagaagagccaccctggttccaaccagaagagaatrtcagaaagtaagtgctgttgacctcctgctctttctttaacctagtgctgctgcctctgctaactgytgggggcaagcgatgtctcctgcctttctaaaagactgtgaaaccactccaggggcagagaaatcacatgcagtgtccctttccaaatcctcccatgccatttatgtccaatgctgttgacctattgggagttcacggtctcgatccctgagggacattttctttgttgtcttggcttctagaagagtatcttttacttgccccctcccaaacacacatttcatggtctcctaacaagctagaagaaagaggtaaagacaagcgtgattgtggaaccatagcctcgctgcctgcctgtgacatggtgacctgtgtatcagcctgtgtgggctgagaccaagtggctaccacagagctcagcctatgcttcataatgtaatcattacccagatccctaatcctctcttggctcttaactgcagacagagatgtccacagctcatcaaakgctctgccttctgggttctttgtgcttagagtggcttcctaaatatttaataggtcccttttctgccagtctcttctgtgcccatcccctgattgcccttggtaaaagtatgatgccccttagtgtagcacgcttgcctgctgttcctaatcatcttctcctacctcctctttacacctagctcctgtttcagtcacctagaaatgctcacagtcgctggaatatgtcatgttcttccacacctccatgcctttgtaggtactgtttgctctcacaggagaactttctctctaacttgcctatcttctcaactcctcctttctctccaagatctagttccggatcccctcccctgagcatccctccttggttctcaggtagtcagtcactctctgccctgaacttccatggcacgtgaaagaaaatctttttattttaaaacaattacagactcacaagaagtaatacaaattacatgagggggttcccttaaacctttcatccagtttccccaatggtagcagcatgtgtaactgtagaatagtatcaaaaccatgaaattgacataggtacaattcacaaaccttcttcagatttcactagctttatgtgcgctcatttgtgtgtgtgtgtgcgtatttagttctatgcaattttatcatgtgtgaattcatgtaattactagctcagtcaagctgcagaaatatctcattgtcacaaagctccttcatgctaccccttaatggccacagccacctcccttcttcctcagttcctgacacctgtcaaccactaatgcgttcctcgtttttacagttttattatttctagaatgttacataaatggaaccatacagtaggtatccttttgatactggctttttttttttttcactcagcagtattcccttagatctatccaagttgtgtgtgtcaacagttcattcctcttcactgctgagtagtgttccctgggaggggtgtatcacagttccatggcatttttagatgtattttttaaacagctttcagcatcctctattttaattgttcatcaagtcctttttcccaatagactctgaatgctcctttatcatcgtattcccatcaccaacatcagtacccaaataggccctaaataaacatttatagcctcctgcctgcctgagaaaccagggtggacatggagagaaggcacttctgaaagttcaagcgcagtgcsctgtgtccttacactscactcctcagtgctttctgtgggttcatttctgtcttctctcctgtcacagtctgcatggaggaggaacccacccacttgaagctgggcgtgtccattcagaacctggtaaaagtctacygagatgggatgaaggtggctgtcgatggcctggcactgaatttttatgagggccagatcayctccttcctgggccacaatggagygggraagacgaccaccatgtaagaagagggtgtggttcccgcagaatcagccacaggagggttctgcagtagagttagaaatttataccttaggaaaccatgctgatccctgggccaagggaaggagcacatgaggagttgccgaatgtgaacatgttatctaatcatgagtgtctttccacgtgctagtttgctagatgttatttcttcagcctaaaacaagctggggcctcagatgacctttcccatgtagttcacagaattctgcagtggtcttggaacctgcagccacgaaaagatagattacatatgttggagggagttggtaattcccaggaactctgtctctaagcagatgtgagaagcacctgtgagacgcaatcaagctgggcagctggcttgattgccttccctgcgacctcaaggaccttacagtgggtagtatcaggaggggtcaggggctgtaaagcaccagcgttagcctcagtggcttccagcacgattcctcaaccattctaaccattccaaagggtatatctttggggggtgacattcttttcctgttttctttttaatctttttttaaaacatagaattaatatattatgagcttttcagaagatttttaaaaggcagtcagaaatcctactacctaacacaaaaattgtttttatctttgaataatatgttcttgtttgtccattttccatgcatgcgatgttaggcatacaaaatacattttttaaagaatactttcattgcarattggaaacttcgtttaaaaaatgctcatactaaaattggcatttctaacccataggcccacttgtagttatttacygaagcaaaaggacagctttgctttgtgtgggtctggtagggttcattagaaaggaatgggggcggtgggagggttggtgttctgttctctctgcagactgaatggagcatctagagttaagggtaggtcaaccctgacttctgtacttctaaatttttgtcctcaggtcaatcctgaccgggttgttccccccgacctcgggcacygcctacatcctgggaaaagacattcgctctgagatgagcaccatccggcagaacctgggggtctgtccccagcataacgtgctgtttgacatgtgagtaccagcagcacrttaagaataggccttttctggatgtgtgtgtgtcatgccatcatgggaggagtgggacttaagcattttactttgctgtgtttttgttttttctttttttcttttttatttttttgagatggagtctcgctctgtagccaggctggactgtagtggcgcgatctcggctcactgcaaccttggcctcccaggttcaagcgattctcctgcctcagcctcccgagtagctgggactctaggcacacaccaccatgcccagctaatttttgtgtttttagtagagacggggtttcaccatgttggccaggatggtctcaatgtcttgacctcgtgatccgcccacctcggtctcccaaagtgctgggaacacaggcatgagccactgtgtctggccacattttactttctttgaatatggcaggctcacctccgtgaacaccttgagacctagttgttctttgattttaggagaagtgggaggtgaatggttgagctgtagaggtgacatcagcccagccagtggatgggggcttgggaaacattgcttcccattattgtcatgctggagggccctttagcccatcctctcccccgccaccctccttattgaggcctggagcagacttcccagacctggtagtgcttcagggccctggtatgatggacctatatttgctgcttaagacatttgctcccactcaggttgtcccatcagccataaggcccccagggagcccgtgtgatggagcagagagagacctgagctctgcaatcttgggcaaggcttttcccttatgtttcttcttatctaaagtgaacagctggggctcatgtgctccctcctcatctaaagtgaayacatggggctcatgtgcagggtcctccccgctttcagagcctgaggtcccctgaggctcaggaaggctgctccaggtgagtgccgagctgacttcttggtggacgtgctgtggggacagcccattaaagaccacatcttggggccctgaaattgaaagttgtaactgcctggtgcatggtggccaggcctgctggaaacaggttggaagcgatctgtcacctttcactttgatttcctgagcagctcatgtggttgctcactgttgttctaccttgaatcttgaagattatttttcagaaattgataaagttattttaaaaagcacggggagagaaaaatatgcccattctcatctgttctgggccaggggacwctgtattctggggtatccagtagggcccagagctgacctgcctccctgtccccaggctgactgtcgaagaacacatctggttctatgcccgcttgaaagggctctctragaagcacgtgaaggcggagatggagcagatggccctggatgttggtttgccatcaagcaagctgaaaagcaaaacaagccagctgtcaggtgcrgcccagagctaccttccctatccctctcccctcctcctccggctacacacatgcggaggaaaatcagcactgccccagggtcccaggctgggtgcggttggtaacagaaacttgyccctggctgtgcccctaggtcctctgccttcactcactgtctggggctggtcctggagtttgtcttgctctgtttttttgtaggtggaatgcagagaaagctatctgtggccttggcctttgtcgggggatctaaggtkgtcattctggatgaacccacagctggtgtggacccttactcccgcaggggaatatgggagctgctgctgaaataccgacaaggtgcctgatgtgtatttattctgagtaaatggactgagagagagcggggggcttttgagaagtgtggctgtatctcatggctaggcttctgtgaagccatgggatactcttctgttakcacagaagagataaagggcattgagactgagattcctgagaggagatgctgtgtctttattcatctttttgtccccarcatggtgcactaaatttatggttagttgaaagggtggatgcttaaatgaatggaagcggagaggggcaggaagacgattgggctctctggttagagatctgatgtggtacagtatgaggagcacaggcaggcttggagccaactctggctggccctgagacattgggaaagtcacaacttgcctcaccttctttgccgataataatagtggtgcttacctcatagaggattaaattaaatgagaatgcacacaaaccacctagcacaatgcctggcatatagcaagttcccaaataaaatgctactgttcttacctctgtgaggatgtggtacctatatatacaaagctttgccattctaggggtcatagccatacagggtgaaaggtggcttccaggtctcttccagtgcttacccctgctaatatctctctagtccctgtcactgtgacaaatcagaactgagaggcctcacctgtcccacatccttgtgtttgtgcctggcaggccgcaccattattctctctacacaccacatggatgaagcggacgtcctggggkacaggattgccatcatctcccatgggaagctgtgctgtgtgggctcctccctgtttctgaagaaccagytgggaacaggctactacctgaccttggtcaagaaagatgtggaatcctccctcagttcctgcagaaacagtagtagcactgtgtcatacctgaaaaaggtgagctgcagtcttggtgctgggctggtgttgggtctgggcagccaggacttgctggctgtgaatgatttctccatctccaccccttttgccatgttgaarccaccatctccctgctctgttgcccctttgaaatcatatcatacttaaggcatggaaagctaaggggccctctgctcccattgtgctagttctgttgaatcccgttttccttttcctatgaggcacagagagtgatggagaaggtccttagaggrcattattatgtcaaagaaaagagacttgtyaakaggtaagagccttggctacaaatgacctggtgttcstgctcattacttwtcaatctcattgaccttaacttttaaactataaaacagccaatatttattaggcwctgatttcatgccagagacactctgkkcatgaaagaaagtaatgataatagttaattttatatagcgttgwtaccatttacaaccttttttttttttttaacctctatcatctcaattaaagkgcagagagaccctgggaagaaggtaactatatttattatcccagatgagggaagtgaggcttgtagggaattggtagctgattcaaggtcacccagcaggtaaataacagtggtgggaccagacccaattaccaggtatgttttcctctgtaccgcagtacatgcctgagatttatttgtgtgttgaagccagtggtacctaatgtatttacatcccaacctgaaactcctatccacttatttaccttttaatgagcctcttaactcaagtgcagtctgaggaccagcagcatcaggatcacttgggaacttgttagaaattcagcaacctgggcccagctcagacctaccgaatcagaatctgtgcattttaacaaggttcttgagtggttgaacacacattaaagcatgagaagcattgaactagacatgtagccaggtaaaggccttgcctgagatggttggcaaaggcctcattgcagcattcattggcaggccacagttcttttggcagctctgcttcctgacctttcaccctcaggaagcraggctgttcacacggcacacacatgccagacagggtcctctgaagccacggctgccagtgcrtgtgtcccagggaaagctttttcctttagttctcacacaacagagcttcttggaagccctcccyggyraaggtgctggtggctctgccttgctccgtccctgacccgttctcacctccttctttgccatcaggaggacagtgtttctcagagcagttctgatgctggcctgggcagcgaccatgasagtgacacgctgaccatcggtaaggactctggggtttcttattcaggtggtgcctgagcttcccccagctgggcagagtggaggcagaggaggagaggtgcagaggctggtggcgctgactcaaggtttgctgctgggctggggctgggtggctgcgggkgtgggagcagcttggtggcgggttggcctaatgcttgctggggtgcctggggctcggtttgggagctagcagggcagtgtcccagagagctgagatgattggggtttggggaatcccttaggggagtggacactgaataccagggatgaggagctgagggccaagccaggagggtgggatttgagcttagtacataagaagagtgagagcccaggagatgaggarcagccttccagatttttcttgggtagcgtgtgtaggaggccagtgtcaccagtagcatatgtggaacagaagtcttgrcccttgctatctctgcctagtcctaatggctgrcttttcccaggaaggcttctgcttccatggactgttagattaaccctttatttaggtaaatgagggaacctactttataagcataggaaagggtgaagaatcttttaagattcctttactcaagttttcttttgaagaatcccagagcttaggcaatagacaccagactttgagcctcagttatccattcacccatccacccacccacccacccatccttccatcctcccatcctcccattcacccatccacccatccagctgtccacccattctacactgagtacctataatgtgcctggctttggtgatacaaaggtgaataagacatagtcctttcctttgcccccaaccctcagaccagagatgaacatgtggaatgacctaaacacctggaacaggtgtggtgtatgagcggcaggcctctgatgagagggtgggggatggccagccctcactccgaagcccctctgagttgattgagccatctttgcattctggtccctgcagatgtctctgctatctccaacctcatcaggaagcatgtgtctgaagcccggctggtggaagacatagggcatgagctgacctatgtgctgccatatgargctgctaaggagggagcctttgtggaactctttcatgagattgatgaccgrctctcagacctgggcatttctagttatggcatctcagagacgaccctggaagaagtaagttaagtggctgactgtcrgaatatatagcaaggccaaatgtcctaaggccagaccagtagcctgcattgggagcaggattatcatggagttagtcattgagtttttaggtcatcgacatctgattaatgttggccccagtgagccatttaagatggtagtgggagatagcaggaaagaagtgttttcctctgtaccacagtacatgcctgagatttgtgtgttgaaaccagtggtacctaacacatttacatcccaaccttaaactcctatgcacttatttaccctttaatgagcctctttacttaagtacagtgkgaggaacagcggcatcaggatcacttgggaacttgttagaaatwcagcaacttgsgcccagctcagacctactgaatcagaatcaggagcaattctctggtgtgactgtgtcacagccaggtatcaactggattctcatacataggaaatgacaaacgtttatggatggatagtctacttgtgccaggtgctgagatttgttttttgttttttgatttttttttaatcactgtgacctcatttaattctcaaaaaaagatgaaaaaatgaacactcaggaatgctgacatgagattcagaatcaggggtttggggcttcaaagtccatcctctctttatccatgtaatgcctccccttagagatacaacatcacagaccttgaaggctgaaggggatataaaagctgtctggccaagtggtctccaagcttgacagtgcagcagaatcacctggggatattattaaaaataaacatactaaggtttggcttcagggcctgtgaatcagaatttctggaggtgaggccttgaagtctgtatttctattgcatactttggacacagtggtctatagactagagtttggaaatgattgcgctcattcagattctcttctgatgtttgaattgctgccatcatatttctagtgctctatttcctcctgctcattctgtcttggataacttatcatagtactagcctactcaaagatttagagccacagtcctgaaagaagccacttgactcattccctgtaggttcagaataaatttcttctgcgcagtgtctgtcatagctttttttaaatttttttttatttttgatgagactggagttttgctcttattgcccaagctggagtgcagtggtgcgattttggctcactgcaacctccacctcccaggttcaagcgattctcctgcctcagcctcccaagtagctgagattacaagcatgtgctaccacgcccagctaattttgtatttttagtagagatgggttttatccatgttggtcaggctggtctcgagctccagacctcaggtgatctgcccgcctyggcctcccaaagtgctgggattataggcctgagccacagcgctcagccataactttaatttgaaaatgattgtctagcttgatagctctcaccactgaggaaatgttctctggcaaaaacggcttctctcccaggtaactctgagaaagtgttattaagaaatgtggcttctactttctctgtcttacggggctaacatgccactcagtaatataataatygtggcagtggtgactactctcgtaatgttggtgcttataatgttctcatctctctcattttccagatattcctcaaggtggccgaagagagtggggtggatgctgagacctcaggtaactgccttgagggagaatggcacacttaagatagtgcctyctgctggcyttctcagtgcacgagtattgttcctttccctttgaattgttctattgcattctcatttgtagagtgtaggtttgttgcagatggggaaggtttgttttgttgtaaataaaataaagtatgggattctttccttgtgccttcagatggtaccttgccagcaagacgaaacaggcgggccttcggggacaagcagagctgtcttcgcccgttcactgaagatgatgctgctgatccaaatgattctgacatagacccaggtctgttagggcaagatcaaacagtgtcctactgtttgaatgtgaaattctctctcatgctctcacctgttttctttggatggcctttagccaaggtgatagatccctacagagtccaaagagaagtgaggaaatggtaaaagccacttgttytttgcagcatcgtgcatgtgatcaaacctgaaagagcctatccatatcacttcctttaaagacataaagatggtgcctcaatcctctgaacccatgtatttattatcttttctgcggggtcctagtttcttgtatacattaggtgtttaattgttgaacaaatattcattcgagtagatgagtgattttgaaagagtcagaaaggggaatttgctgttagagttaattgtaccctaagacttagatatttgaggctgggcatggtggctcatgccagtaatcccagcgctttgagaggctgaggtgggtagatcacctgaggtcaggagtttgagaccagtctgaccaacaaggtgaaaccccgtctctactaaatacaaaaaattagccgagtgtggtggcacatgcctgtcatcccagctacttgggaggctgaggcaggagaatcgcttgaacccaggaggcagaggttgcagtcagccacggttgcgccattgcactccagactgggcaacaagagtgaaaactccatctcaaaaaagaaaaaaaaagaattagatattttggatgagtgtgtctttgtgtgtttaactgagatggagaggagagctaagacatcaaacaaatattgttaagatgtaaaagcacatcagttaggtatcattagtttaggacaaggatttctagaaaatttttaggaacagaaaactttccagttctctcacccctgctcaaagagtgtatggctcttacattatatataactgcctgacttcatacagtatcagtacttagatcatttgaaatgtgtccacgttttaccaaaatataatagggtgagaagctgagatgctaattgccattgtgtattctcaaatatgtcaagctacgtacatggcctgtttcatagagtagtctataagaaattgatgacttgattcatccgaatggctggctgtaacacctggttacgcatgaacacctcttttcagttgtctcaagacacctttcttttctgtacttatcagacaaggactgaaaggcagagactgctactgttagacattttgagtcaagcttttccttggacatagctttgtcatgaaagccctttacttctgagaaacttctagcttcagacacatgccttcaagatagttgttgaagacaccagaagaaggagcatggcaatgccgaaaacacctaagataataggtgaccttcagtgttggcttcttgcagaatccagagagacagacttgctcagtgggatggatggcaaaggrtcctaccaggtgaaaggctggaaacttacacagcaacagtttgtggcccttttgtggaagagactgctaattgccagacggagtcggaaaggattttttgctcaggtgagacgtgctgttttcgccagagactctggcttcatgggtgggctgcaggctctgtgaccagtgaaggcaggatagcatcctggtcaagatatggatgccggagccagatttatctgtatttcaatcccagttctattccttgccagttgtgtatccgctggcaagttacttctctatgcctcaatctcctcatctgtaaaatggggataataatattacctgcaatacagggttgttacgaaaataaaaatgaataggtgcttagaatggggcctgacattagtaagtgcttagttttgtgtgtgtatatgttatttttattttggaggagaacataaaaargacaaagtgtagaaaaactggttgggtgtattcagctgtcataacatgagagttgttatgcccagatgcacttgacatgtgaatttattagaaacatgatttttctctgagttgatgtttaactcaaactgatagaaaagataggtcagaatatagttggccaacagagaagacttgttagactattgtctgcatgtcagtgtttgcatgctaacttgcttagttagaaaggttaaattttttcactctataaaatcaagaaatatagagaaaaggtctgcagagagtctttcatttgatgatgtggatattgttaagagcgggagtttggagcatacagagctcaagttgaatcctgactttgctacttattggctatatgaccttgggcaagctgcttagtctctctgatcctcagttacctttgtttgttgatgatgaccattgataacacaaccataaataatgacaacatagagatagttctcattatagtagttgttatacagaattattcactcaatgttaattttctgcattgaaatcccagaacattagaattgggggcattatttgaatctttaaggttataaggaatacatttctcagcaataaatggaaggagttttgggttaacttataaagtatacccaagtcatttttttttcagagaagatatggtagaaagtcttaggaggttgaagaaggaattggatatttattctttctgagactatcatgggagataatgactatggttgtccatgattggagccgttgctgtagagttggttttattatagtgtaggatttgaatgggccatgtgttctcagacctcagattaaaatgagaaaactgaggccagtggggagcgtgacttcacatgggtacacttgtgctagagacagaaccaggattcaggacttctggctcctggtcctgggttcatggcccaatgtagtctttctcagtcttcaggaggaggaagggcaggacccagtgttctgagtcaccctgaatgtgagcactatttacttcgtgaacttcttggcttagtgcctctgccaggtggccataacctctggccttgtgttgccagagaaaaggtttagttttcaggctccattgcttcccagctgccaagaatgccttggtgcagcacagtcataggccctgcattcctcattgccgtgctggttggtcggggaggtgggctggactcgtagggatttgccccttggccttgtttctaacacttgccgtttcctgytgtccccctgccccctccactgcctgggtaaagattgtcttgccagctgtgtttgtctgcattgcccttgtgttcagcctgatcgtgccaccctttggcaagtaccccagcctggaacttcagccctggatgtacaacgaacagtacacatttgtcaggtatgtttgtcttctacatcccaggaggggrtaagattcgagcagaccaaagatgtttacgagggccaagggaatggacttcagaattacacggtggaatgaattttactgctgcggctcaggtccctgtataagctaatactgcatgcatagaacagcagcgaactaaccctgaataataggccagtcttctgttgagcctttcagcctctctcctcttcatcctactgttgtcaggaacagccacatgtgttttaggtgaaataatccacccttgcaaaaatccatgattaagttataaaatatttggatttgtggagctgtgttttaattctgtaactgagtcacagggcacactgtcaaagcatagaacctccagagacttgttttctgcaaagtataattcatgtaattattatctattctgttatatttgggatgttaggtagtgtttgttctttagataaaaatatcccccactctgtaacaatacattaaatcaaagaaaaggacaaaggatttttctgggtcttgttagcaggagctttcttcagtcctgaaagatttgtagacctgtagatgggggaactgtgtcagtgatacaaaagggaagcatttaaaaaaaaaaaagtatatatatatatatatatatatatatgtaatgtgaattggcctctttttctctaagcccacattttcttcttacatagttcaggtttactttattttttcctttccggctgctgaccctgtattgcccgtagttgtggaacatagcatgtgtttgtgacctgtgcctgttatttttgtgctttctagttgtgcatgcaaagagtacaaagttttcttgccctttcttggaaaatcctgcttgtctgtgccaaagggataattgtgaaagcacttttgaaatacttaatgagttgattttcttcaaattaaaaaaaatatataaatgtatmtgtgtatgtacatgtgtgtacacatacacacctttatacatacagcccatttaaaacaagctccactttggagtgctctacgtcaccctgatgccgaatacagggccagagtctgagatccttctgggtggtttctgtgttttgttcatttctgttttaagagcctgtcacagagaaatgcttcctaaaatgtttaatttataaaaacatttttatctctcgattactggttttaatgaattactaagctggctgcctctcatgtacccacagcaatgatgctcctgaggacacgggaaccctggaactcttaaacgccctcaccaaagaccctggcttcgggacccgctgtatggaaggaaacccaatcccgtgagtgccactttagccataagcaggcttcttgtgcttgttgcctggtttgatttctaatatgctgcatttatcaactgcatgccacattgtgaccgccagcatttgccctttgaattattattatgttttatttacaaaaagcgaaggtagtaaccgaactaaattatctaggaacaaacgtttggagagtcttctaacaccgtgcaaagcacgtcattacagacatttgtttactgatttagaaccttaatatttaatttaaatagcactttacacttactgatgaaatgcttttcctttctttctctcccagcccctgtacttaagtgcttcaataggctctcattatatatgatttttaggttttgyttatcagcttcttcgcttttataatctgaaaagatggcatatgaatttttataaaaagggacactttcttcttctcaaattgtatatttttattgtactttccttcaaaacccccttttaaaaagtaagcagtrgataaataaattcagtgaagcatccatatgacycttaagtgagtgtaggggaagggaggtcaccagatcactgtgagtgaagatggtggagaggtgaggatcttatgaggccgtgctcaaggctggtagaggtgggttagtgtttccaggtttaggcagaatctcagctgaggtcatgaaacaacagtgatctctgaaaaattatggcaaggtgggaaggtgctggagaattggagagggggcaaacttgactttcaagtttcaatgggaagataggtgactctgcacaccacagaacagtgagcatgataacctgtttatacaaggttctagagcagatttctaaatggatagctactgtgtgcttgtttgttcttaattagtattggatagttactaaatacttgttagtacttagtacataatgggtggtaaatcctagcagctaatattggttcccaaataaccagatgacaaggatagagaaggacacagacacggcctatctggatttcatggtgcctttsattttccacatgaaggttgtgtagggaagatagaagcatgagatgagatgataatatagttatctggattcatcactggccagctgaaccatatgaactcatggattgatgctagcttaggaaggctctgtaggagccagaactgggctgagagccagcccatagagacaaaagaggcccggccctgacatcagagggttcaaacatgatgtctgagccccacctacagtctgccggaggtggttggaaggaagagcctttatccttacaattcttactgaaattcaaatttttaggttttgcaaaaaaatggtggacctgaaggaaatttgacaggagcatgtctcagctgtatttaaatttgtctcagccaatccccttttgaatgttcagagtgtaagcttcaggagggcagcgcgtcttagtgtgacttttctggtcagttcaggtgctttaaggagacaattagagatcaatctggaaaacttcatttgaatttttaatacataagaaaacaataagaaatagttaaaaatatatatttatawwatatatrtgtgtgtgtgtgtgtgtgtgtgtrtrtatatatatatattttatttatttatttttttttgagatggagtctcgctctgttgcccaggctggagtgcagtggctcaatcttggctcactgccacctctgcctcccaggttcaagtgattctcctacctcagcctcctgagtagctgggattacaagcatgtgccaccacactggctaatttttctaattttagtagagatggagtttcaccatgttggacaggatggtcttgaactcctgacttagtgatccacccgccttcgcctcccaaagttctgggattacaggcatgagccatcgtgcctggcaattatatttaatatttaataataaggaaataattgctgtaactttactttaaattgtggaattctgaaactggaagggaactggaaatgacttgttgaatcaaatcattttaaacttttattttgccagtggaaaaaataagcccccaaaagagcaggggacctgctgatgtcccacagtaattcagagctggagatgaggttgaaggctttgtgtcttatctccagggaaaatttgtagacagcgtagctctttatgtgacgagcattctcaccccagtcatcccccaattctctactcatttgagaacataaattggatcttgccagtctctactcatttttcagcacatcgagcataagatccagactctttcccaggcctctctcatctggctcctctcctcctcctttatcattactcttcttcgtagcttatcctactccagccatgctgtcttcctattattcctaaaaartagaaatgcatttcttcctagggcctttgtacctgcacttgccatcgcttttgctcagaatgttctttttgccaagcttttgcccagcttgttctccatcattgttatgttttggctgaaatgtcttctcttagtaggttcattctccccagtcactgtctttttattttgctttattttgggccatctaaggttatcttattagtgtatttgttgttcgtctcctccatgggcatacacctccatgaaggcaggtattttcaccttaggccctcgaatatactggacagcatctggcacgtagtagatgctcaacgaatgtttgttgtgtgagcaaatggttggttgattggattgaactgagttcagtatgtaaatatttagggcctctttgcattctattttacttatgtataaaatgatacataatgatgatataaatgatgtcacagtgtacaaggctgttgtgggatcaagcaatcaaatgagatcatgcttgtcttttccaaatggtgagggaatagatgcatgtttrtggttgttacggaatgatcctgtgctcctgaggcaacagaaaggccaggccatctctggtaatcctactcttgctgtcttccctttgcagagacacrccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggkgcaggggggctgcctcctccacaagtgagtcactttcagggggtgattgggcagaaggggtgcaggatgggctggtagcttccgcttggaagcaggaatgagtgagatatcatgttgggagggtctgtttcagtcttttttgttttttgtttttttttctgaggcggagtcttgctctgtcgcccaggctggagtgctgtggcatgatcttgcctcactgcaacctccacctcccaggttcaagcgattctcctgcctcagcctcctgagtagctgggattacaggcacgcaccaccatgtctggctaatttttgtgtttttagtagagatagggtttcgccgtgttggctaggctggtctggaattcctgacctcaggtgatccacccgcctcggcctcccaaagtgctgggattacaggcgtgagccactacgcccagccctgtttcagtctttaactcgcttcttgtcataagaaaaagcatgtgagttttgaggggagaaggtttggaccacactgtgcccatgcctgtcccacagcagtaaagtcacaggacagactgtggcaggcctggcttccaatcttggctctgcaacaaatgagctggtagcctttgacaggcctgggcctgtttcttcacctctgaattagggaggctggaccagaaaactcctgtggatcttgtcaactctggtattcttagagactctgtttgggaaggagtcctgagccattttttttttcttgagaatttcaggaagaggagtgcttatgatagctctctgctgcttttatcagcaaccaaattgcaggatgaggacaagcaattctaaatgagtacaggaactaaaagaaggcttggttaccactcttgaaaataatagctagtccaggtgcggggtggctcacacctgtaatctcagtattttgggatgccgaggtggactgatcacctaaggtcaggagttcgaaaccagcttggccaatgtggcgaaaccctgtctctactaaaaattcaaaaattagccaggcatggtggcacatgcctgtaatcccagttacttgggaggctgaagcaggagaattgcttgaacctgggaggtggaggtcgcagggagccaaaattgcgccactgtactccagcctgagcaacacagcaaaactccatatcaaaaaataaaatgaataaaataacagctaatctagtcatcagtataactccagtgaacagaagatttattaggcatagtgaatgatggtgcttcctaaaaatctcttgactacaaagaatctcatttcaatgtttattgtttagatgttcagaataaattcttgggaaagaccttggcttggtgtaagtgaattaccagtgccgagggcagggtgaaccaagtctcagtgctggttgactgagggcagtgtctgggacctgtagtcaggtttccggtcacactgtggacatggtcactgttgtccttgatttgttttctgtttcaattcttgtctataaagacccgtatgcttggttttcatgtgatgacagagaaaacaaaacactgcagatatccttcaggacctgacaggaagaaacatttyggattatctggtgaagacgtatgtgcagatcatagccaaaaggtgactttttactaaacttggcccctgccktattattactaattagaggaattaaagacctacaaataacagactgaaacagtgggggaaatgccagattatggcctgattctgtctattggaagtttaggatattatcccaaactagaaaagatgacgagagggactgtgaacattcagttgtcagcttcaaggctgaggcagcctggtctagaatgaaaatagaaatggattcaacgtcaaattttgccacttagtagcaacttgaccaggtaactggttatccttttaaagccttagtttatctaaattgtgatattaatgttgctcttataagtttgtcatgaggactaaattaaatggtgtacatagagtgccttgggtactctctgatgggggactccatgataatttgtggtctcatggagggagctctgggaaggtttaggagcctgccttggctctgcagccttgggagagccttctagcttcccaggacatggcagcctagtgttgaatgcttggctcagcaaatgtttgttctcgtttccttcccatcaacttggtcagttggggtctttcagttaggagtatctcagtgactttaaatggcatgggcatgctggagtgatagtgaccatgagtttctaagaaagaagcataatttctccatatgtcatccacaattgaaatattattgttaattgaaaaagcttctaggccaggcacggtggctcatgcctgtaatcccagcactttaggaggccaaggcgggtggatcacttgaggtcaggagtttgagaccagcctggccaacatggggaaaccctgtctctactaaaaatacaaaataagctgggcgtggtggtgcgtgcctgtaatcccagctacttgggaggctgaggcaggagaaytgcttgaatctgggaggcggaggttgcagtgagctgagttcatgccattgcattccagcctgggcaacaagagcgaaaccatctcccaaaagaaaaaaaaaagaaagaaaaagcttctagtttggttacatcttggtctataaggtggtttgtaaattggtttaacccaaggcctggttctcatataagtaatagggtatttatgatggagagaaggctggaagaggcctgaacacaggcttcttttctctagcacaaccctacaaggccagctgattctagggttatttctgtccgttccttatatcctcaggtggatatttactccttttgcatcattaggaataggctcagtgctttctttgaactgattttttgtttctttgtctctgcagcttaaagaacaagatctgggtgaatgagtttaggtaagttgctgtctttctggcacgtttagctcagggggaggatggtgttgtaggtgtcttggattgaagaaagccttrgggattgtttgtcactcacacacttgtgggtgccatctcactgtgaggaggacagaagccctgtgaacatgtggagcacacaggggcacagacagatttagattaggcctgctttatagagtttctgcctagagcatcatggctcagtgcccagcagcccctccagaggcctctgaaatatttgatatactgatttccttgaggagaatcagaaatctcctgcaggtgtctagggatttcaagtaagtagtgttgtgaggggaatacctacttgtactttccccccaaaccagattcccgaggcttcttaaggactcaaggacaatttctaggcatttagcacgggactaaaaaggtcttagaggaaataagaagcgccaaaaccatctctttgcactgtatttcaacccatttgtccttctgggttttgaaggaacaggtgggactggggacagaagagttcttgaagccagtttgtccatcatggaaaatgagataggtgatgtggctacgtcagggggcccgaaggctccttgttactgatttccgtcttttctctctgccttttccccaagggccaggacccctggatctctgggcagagcagacgcaggcccctataatagccctcatgctagaarggagccrgagcctgtgtataaggccagcgcagcctactctggacagtgcagggttcccactctcccaactccccatctgcttgcctccagacccacattcacachcgagccactgggttggaggagcatctgtgagatgaaacaccattctttcctcaatgtctcagctrtctaactgtgtgtgtaatcaggccaggtcctccctgctgggcagaaaccatgggagttaagagattgccaacatttattagaggaagctgaygtgtaacttctctgaggcaaaatttagccctcctttgaacaggaatttgactcagtgaaccttgtacacactcgcactgagtctgctgctgatgatactgtgcaccccactgtctggsttttaatgtcaggctgttcttttaggtatggcggcttttccctgggtgtcagtaatactcaagcacttcctccgagtcaagaagttaatgatgccaycaaacaaatgaagaaacacctaaagctggccaaggtaaaatatctatcgtaagatgtatcagaaaaatgggcatgtagctgctgggatataggagtagttggcaggttaaacggatcacctggcagctcattgttctgaatatgttggcatacagagccgtctttggcatttagcgatttgagccagacaaaactgaattacttagttgtacgtttaaaagtgtaggtcaaaaacaaatccagaggccaggagctgtggctcatgcctgtaatcctagcactttgggaggccgaagcgggtggatcacttgaggtcaggagttcgagaccagcctggcctacatgacaaaaccccgtatctactaaaaatacaaaaaaattagctgggcttggtggcacacacctgtaatcccagctacttgggaggctgaggcaggagaattgcttgaaccctgtaggaagaggttgtagtgagccaagatcgcaccgttgcactccagcctgggcaacaagagcaaaactccatctcaaaaaacaaattaaatccagagatttaaaagctctcagaggctgggcgcggtggcttacacctgttatcccagcattttgggatgccraggcgggcaaagcacaaggtcaggagtttgagaccagcctggccaacatagtgaaaccctgtctytgctaaaaacatagaaaaattagccgggcatggtggcgtgcgcctgtaatcccagctactcgggaggctgaggtgagagaattrcttgaacccgggaggcggaggttgcagtgagcccagattgcaccactgcactccagcctgggcgacagagcaagactccatctcaaaaaaagctctcagaacaaccaggtttacaaatttggtcagttggtaaataaactgggtttcaaacatactttgctgaaayaatcactgactaaataggaaatgaatctttttttttttttttttaagctggcaagctggtctgtaggacctgataagtactcacttcatttctctgtgtctcaggtttcccatttttaggtgagaattaaggggctctgataaaacagaccctaggattgtggacagcagtgrtagtcctagagtccacaagtctgcttttgagtgatgggcccatgtatctggcacatctgcaggcagagcgtggttctggctcttcagatgatgccggtggagcactttgaggagtcctcaccccaccgtgataaccagacattaaaatcttggggctttgcatcccaggatttctctgtgattccttctagacttgtggcatcatggcagcatcactgctgtagatttctagtcacttggttctcaggagccgtttatttaatggcttcacatttaatttcagtgaacaaggtagtggcattgctcttcacagggccgtcctgttgtccacaggttccagattgactgttgccccttatctatgtgaacagtcacaactgaggcaggtttctgttgtttacaggacagttctgcagatcgatttctcaacagcttgggaagatttatgacaggactggacaccanaaataatgtcaaggtaaaccgctgtctttgttctagtagctttttgatgaacaataatccttatgtttcctggagtactttcaactcatggtaaagttggcaggggcattcacaacagaaaagagcaaactattaactttaccagtgaggcagtacggtgtagtgtagtgattcagagaatttgctttgccaccagacataccaggtaaccttgactaagttacttaacctatctaaacctcagttycctcatctgtgaaatggagacagtaatcatagctatttccaaactgttgtgagaattcaatgagttaaaggtataaggtcctcaccacagcgcctgcccacatagtcagtgatcactatgtcctgaacactgtaattacttcgccatattctctgatcatagtgttttgccttggtatgtgactagaatttctttctgaggtttatgggcatggttggtgggtatgcacctgcctgcaggagcccggtttgggggcattaccttgtacctggtatgttttctttcaggtgtggttcaataacaagggctggcatgcaatcagctctttcctgaatgtcatcaacratgccattctccgggccaacctgcaaaagggagagaaccctagccattatggaattactgctttcaatcatcccctgaatctcaccaagcagcagctctcagaggtggctcygtaagtgtggctgtgtctgtatagatggagtggggcaagggagagggttatggagaaggggagaaaaatgtgaatctcattgtaggggaacagctgcagagaccgttatattatgataaatctggattgatccaggctctgggcagaagtgataagtttacgaattggctggttgggcttcttgaactgcagaagagaaaatgacactgatatgtaaaaatcgtaacatttagtgaattcatataaagtgagttcaaaaattgttaattaaattataatttaattataagtgtttaatcagtttgatttgtttaaaaaccactgttttaaatttggtggaatatgtttttattagcttgtatctttaattcctaaattaagctgtgtgtgtgtgtgtgtgtgtgtgtgtgtgtgtgtgtgtgtgtgaagtttaaagccaggatgagctagtttaaagtatgcagcctttggagtcatacagatctgggtttgaatctggtctctaaactttatagatgtatgatattaaatgaggcagttcatgtaaattgccaagcccagcactcagcacagagttgatatttcacacacattagatacctttcctgtatgtggagcatggcagttcctgtttctgctttactcctacaggatactaatataggacactaggatctttataccaagaccccatgtaatgggcttatgagaccattcttcttataaaaatctgacagaatttttgtatgtgttagatcaataggctgcatactgttattttcaagttgatttacagccagaaatattaatttatttgagtagttacagagtaatatttctgctctcatttagttttcaagccccactagtcctttgtgtgtgaaaatttacaacttactgctcttacaaggtcatgaacagtggaccaaagtgaatgccattaaccactctgacttccttcattagttttattgtgacagtggactcttttgacctcagtaataccagtttggcatttacattgtcatatttttagacttaaaaatgatcatcttaaccctgaataaaatgtgtctggtgaacagatgtttttccttgggctgtgcctcagatatctctgtgtgtgtgtacgtgtgtgtttgtctgtgtgtccatgtcctcactgattgagccctaactgcatcaaagacccctcagattttcacacgctttttctctccaggatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatggtaaggacacaggcctgctgtatctttctgatgtctgtcagggccatggattgayatggataagaaagaaagagctctggctatcatcaggaaatgttccagctactctaaagatgtatgaaaaagaaatagccagaggcaggtgatcactttcatgacaccaaacacagcattgggtaccagagttcatgtcacaccagagggaaaattctgtacacaatgatgaaaattaataccactaccacttaagttcctatgtgacaactttcccaagaatcagagagatacaagtcaaaactccaagtcaatgcctctaacttctctgatgggttttaacctccagagtcagaatgttctttgccttactaggaaagccatctgtcatttgaaaactctgtacattttatcagcagcttatccatccattgcaaatatgtttttgtgccagccacaatatattgcttctatttggaccaatatgggggatttgaaggaattctgaagttctaattatatttcaactctactttacaatatctccctgaaatatatctccctgtaacttctattaattataagctacacagagcaaatctaattcttctcccaccgaacaagtccctggatatttaaaaataactctcatactctcatttaacctgagtattacccagataagatgatatatgagaatacaccttgtaacctccgaagcactgtacaaatgtgagcaatgatggtggagatgatgatgagatctttgctgtttataccaagccccttagactgtgtcactcttctgatccggttgtccttgtatggccatgctgtatattgtgaatgtccgttttcaaaagcaaagccaagaattaaccttgtgttcaggctgtggtctgaatggttatgggtccagagggagttgatctttagctcacacttctattactgcagcacaaagattttgcattttggaaggagcaccgtcttactggcaacttagtggtaaaccaaaacctccatttcacacaaatgattgtgaaattcgggtctccttcattctatacaaattcatttgatttttttgaaactaaactttatatttatccatattaaattacatgggttttatttttgttttatcttgattcagtaattactcctttcagtaaacacagactgagtgctgtgtgtctgacttatgccaggcataggtgattcagagatgaaaggtcaagtccctgaacccatctcttgtcttcctgggtattatctgtccctccctgctttagagctcctgaaatttgctagaagcatgtcttcatctaagttgttgataaacacatcaagtaggattggactgaggcagagccctgtagtctgaagctgcagttcttctagcggctgacaagccccactatcacttccctgctggtgctttgctctgccagctgtgaattctcataattgtcctatcgtcaagtctttatttctgcattttactgcttgatacactgtcaggacagactttaaaattattctcagtgcgatgaaacaattctgacattcatgttatgagcagttacctcataaatagattacatgtgagattgaacttgggcagactataatatagcattaatgaygaaacagacacagtcatcttcgggaagaagaatagaggcttatttgctgcctgtgaaattaaaattactctgactgggaatccatcgttcagtaagtttactgagtgtgacaccttggcttgactgttggaaagacagaaagggcatgtagtttataaaatcagccaargggaaaatgcttgtcaaaatgtattgtcgggtattttgattaatagtttatgtggcttcattaattcagagttactctccaatatgtttatctgccctttcttgtctgataatggtgaaaactygtgtgatgcattgtatatttgatttaggggtgaactggatgtctttgttttcacttttagtgcaattacgttgtccctgccacactggtcattatcatcttcatctgcttccagcagaagtcctatgtgtcctccaccaatctgcctgtgctagcccttctacttttgctgtatgggtaagtcacctctgagtgagggagctgcacagtggataaggcatttggtgcccagtgtcagaaggagggcagggactctcagtagacacttatctttttgtgtctcaacaggtggtcaatcacacctctcatgtacccagcctcctttgtgttcaagatccccagcacagcctatgtggtgctcaccagcgtgaacctcttcattggcattaatggcagcgtggccacctttgtgctggagctgttcacygacaatgtgagtcatgcagagagaacactcctgctgggatgagcatctctgggagccagaggacagtgtttaattgtgatcttattccacytgtcagtggtattgacactgctgactgccttgtcctgtcttcagagtctgtcttccctgagaaggcaaagcacctttctttcttgctgtgccttacattttgctggtcaagcctttcagtttcttttgacagttttttttacttctttcttttttcaatgttgctcttaccaagagtagctcctctgccttccactttacacatgagagctgggcgacgccattcagtcctaaggcttttaccatcacctctcttggtgtttttattgtcatctctaagatcaatgcctttagccttgatcataaccttgaactctaatctcaaattctcacttgcctagtggattgctccatttagatagtatatagataccccaacctggayatgtcctagttttctttccccttggaacttaatgcttttcttgccatccctgtcacactcagtggcactaccatccactcggttgcccaagctggctcttagagttatcctagatgcttgctttgctgttgcagatttcccacattcaactggttatgttgtcagttcttccaggtatggacctctaaaataaggcttcctctccattccggttgtcattgcctttgtccaaacacagcacacaaggccttttacagttgcacaactcttcytgtccatacccaccacaccctttcccagctgtaagcttcagatgagttgcctccaaccaccatgctcctgtaggcctggcttgaaatgcccttcttctgtcacagggtctggtagtatatcccttgcccttcaagatttagctaaaatgtgaagctttccttacctgctgggaggtgttctctcttttctctgtgctctcagagtccttagtccatgcctccagtacaacgtacatccacttacatggtaatttcctgtttacatacttttcctactyggagtggagtctgtttcttaataattttgcctctcccatgccctagcacagtgcatccagcgtatagccccttattcagttggtagatatttggccactgttgccttgtgggatcataagttctgatgtatttgagaagaatttctaaaattctgacaaaatcctgaaactcaaatattgacccagacatgagcaatttgcttttcaaatgctaagggatttttaatggatttgctttaattaaatctagcctgtttctaagctttattcattatttctccatactcagagcatttctccagattttctaaagaatagaattttattgctacatatcatcagctatgcctgctgctatttaattggtatctgaattaaaaggtctggtttgtccctagagaatcaaattttttcttcactcccatatttcagaacttgatacatttttaggataaaccatgaatgacacccgtttcttctccctcaccctcccttccctcccattttttttttttttttttagaagctgaataatatcmatgatatcctgaagtccgtgttcttgatcttcccacatttttgcctgggacgagggctcatcgacatggtgaaaaaccaggcaatggctgatgccctggaaaggtttggtgagtgaagcagtggctgtaggatgctttaatggagatggcactctgcataggccttggtaccctgaactttgttttggaaagaagcaggtgactaagcacaggatgttcccccacccccatgcccagtgacagggctcatgccaacacagctggttgtggcatgggttttgtgacacaaccatttgtctgtgtctctgatagcattgagaaaagtgaaagggcagttttgaaggtaaggaaaatagtgkyatttgcttggatccactggctcatgccactgtctgggttggttagaagcactggaaaagtcaaaccataactttgagaattaggtgatcagggaatcagaaggaaagatgcaaactttggctcttttaggcgaatcatgtgcctgcagatgaggtcatttattatcttttacacagtctataaaattataatgtattacatctttttctacctttagaatggttaaaaatatttctccggtagccatatgattattattcatccattagataatatagtcaaatgggccatgttatttactgttcatagaagaggggctttttgcaacttgggctacaaaggagatatgtaaggaatttaaggaatggttacatggaactagatttaattgaatctagtggtttaattgattcactaggatatatgctactgaaaggggaatctgcttaaagtgctttctgatatttattattactaaaacttagaatttattaaaaatactgactgtgaaaattacttgggtcgtttgcctttttaaaaggatttttggcatgtctcattaaaaaaagaaatactagatatcttcagtgaagttacaaatcgaatacacattggctctgaaattctgattgatactgggtcataaaaagttttcccaaatcagacttggaaagtgatcactctcttgttactcttttttccttgtcatgggtgatagccatttgtgtttattggaagatcggtgaattttaaggaacataggcccaaatttgaggaagggccatggtttttgatccctccattctgaccggatctctgcattgtgtctactaggggagaatcgctttgtgtcaccattatcttgggacttggtgggaygaaacctcttcgccatggccgtggaaggggtggtgttcttcctcattactgttctgatccagtacagattcttcatcaggcccaggtgagctttttcttagaacccgtggagcacctggttgagggtcacagaggaggcgcacagggaaacactcaccaatgggggttgcattgaactgaactcaaaatatgtgataaaactgattttcctgatgtgggcatcccgcagcyccctccctgcccatcctggagactgtggcaagtaggttttataatactacgttagagactgaatctttgtcctgaaaaatagtttgaaaggttcatttttcttgttttttcccccaagacctgtaaatgcaaagctatctcctctgaatgatgaagatgaagatgtgaggcgggaaagacagagaattcttgatggtggaggccagaatgacatcttagaaatcaaggagttgacgaaggtgagagagtacaggttacaatagctcatcttcagtttttttcagctttatgtgctgtaacccagcagtttgctgacttgcttaataaaagggcatgtgttcccaaaatgtacatctataccaaggttctgtcaattttattttaaaaacaccatggagacttcttaaagaattcttactgagaattcttttgtgatatgaattcccattctcgaatacattggttttatatgcttacatttatgtgttagttattaaaacatactaatattgtatatctagtcaaaactgaggtagagagaataaatggttgattttgagtttgagtttcatagtccaaaaagctgatatattgcctgtgttcaagagggtctatatcagccctctagatgccagcatctccaaattttacttttttggaatctgtacagtatttgcaatatttttattacaaatttctactctgtggaatttaatttttaaaatacctgcaatacatatatatgttgaatagatgaaaaattatgtagatrataatgaatgatrcggttctaaaaagacaggttaaaaagtaagttcacttttattttgagcttcagaatcattcagaagccagtcgccacaaacgcagaccaaggctcttggcacatyaaatatgcctatggcttagggttattgacaagtcttatgttgcagtgtatgtggtttatagtcctgccttccacagttgcttgggagagctgtgagtcactgaggcttatgaatgtttacattttgtttgttgcagatatayagaaggaagcggaagcctgctgttgacaggatttgcgtgggcattcctcctggtgaggtaaagacactttgtctatattgcrtttgtccctattagttcagactatctctacccaatcaagcaacgatgctcgttaagaggtaaaagtggattttaaaggcttctgtatttatgccaggatggagcaattagtcatcgagaagaragggaccctgtatgtcaagagaatgatttcagagaatccaatacaatttaagaaaaagcatggggctgggcgcagtgattcactcctgtaatcccagcactttgggaggccgaggtgggcggatcacgaggtcaggagattgagaccatcctggccaacatggtgaaaccccatctctactataaatacaaaaattagctgggcatagtagtgcattcctgtagtcccagctactcgggaggctgaggcaggagaattgcttgaacctaggagggggaggttgcccagattgcgctgctgcactccagcctggtgacagagtgagactcatgtcaacaacaaaaacagaaaaagcacgcacatctaaaacatgcttttgtgatccatttgggatggtgatgacattcaaatagttttttaaaaatagattttctcctttctggtttccgtttgtgttcttttatgcccttttgccagagtaggtggtgcaatttggctagctggctttcattactgtttttcacacattaactttggcctcaacytgacaactcaaataatatttataaatacagccacacttaaaatggwcccattrtgaaatacatatttaaatatctatacgatgtgttaaaaccaagaaaatatttgattcttctctgatatttaagaattgaaggtttgaggtagttacgtgttaggggcatttatattcatgtttttagagtttgcttatacaacttaatctttccttttcagtgctttgggctcctgggagttaatggggctggaaaatcatcaactttcaagatgttaacaggagataccactgttaccagaggagatgctttccttaacaaaaataggtgagaaaagaagtggcytgtattttgctgcaaagactttgtttttaatttatttaaagaaataggttgttatttttgattacagtggtatttttagagttcataaaaatgttgaaatatagtaaagggtaaagaagcacataaaatcatccatgatttcaatatctagagataatcacaatttacatttcctttcagtctcattctcttcttttaacagctttattcaggtataatttacatacaatataatttgcttgttttttaagagtataatttagtgatttttggtaaattgagagttttgcaaccatcaccacaatccagttttagaacttttccatcaccccacatctgtcttatatacacatataaatgtgccatacaattgagatcatactgtatgtagaatttaaaattagtttttattgttaatgagtgtattatgaatatttcccagtgggttacatttcctaagatgtggaattttacattgctacataaaatycccctatgtacatgtacctataatttatttaataaattccttataaatgttggacacattagtttccatttttcrctatgtaaatatgtccctgtatacatcttttattatttcctcaggaacaattcctacaaagtaaattgccctctctaaagagcatacaaattgactgagccaccgttaggccattttctgagactgcacaggtcacaaagcaatctgatctttgggaatacagctacattttataggcttcttagataatgttactctaagtactttaaatatgtggggcttctctgggcttttttttttttgagacggagtttcactcttactgcccaggctggagagcaatggcgcgaccttggctcactgcaacctccgcctcccaggttcaagcgattctcctgcctcagcctcctgagtagctgagattacaggtgcccgccacaatgcctgcctaatttttttgtattttcagtagagatggggtttcaccatgttggccagactggtctcgagctcctgacctcaggtgatccacctgcctcagcctcccaaagttctgggattacaggcatgagccactgcgcccggcttctctggacttattatgtggagagatagtacaaggcagtggctttcagagttttttgaccatgaccgttgtgggaaatacattttatatctcaacctagtatgtacacacagacatgtagacacatgtataacctaaagtttcataaagcagtacctactgttactaattgtagtgcactctgctatttcttattctaccttatactgcgtcattaaaaaagtgctggtcatgacccactaaatttatttcccaaaccactaatgaacaatgactcacaatttgaacacactggacagggggatagccaataaaattgaaaagagcaaggaaattaatgtattcatgatctcctctcctgtctcttacatttttgcagtagcaatgtaaaggaatcctaagagaacagacattctgggaatagcaggcctagcgctgcacaactgctttcctaggcttgctcctagtaccaagctcctgacgcatatagcagtggcagtaataaccagcccatagtaaggtttgtcacagggactggttgtaagaactgatttgrttggtatagctgtgagggcctggcacggtgtccacgtgtgcctcaatcctaattctgaaaaaggctgaccctgggggtgctaattagatacacagagaggaatgaatgctgccagaaggccaagttcatggcaatgccgctgtggctgaggtgcagtcatcagtctggaacgtgaacactgaacttctctcacatgtgattcttcacttgactggcttcatagaaccccaaagccaccccaccaccacataaattgtgtctctaggttctgtgttgctcacactcaaaatktctgggccttctcatttggtgcatgtgaatggtgcatatgagtgaagtctaggatggggccttagcrttaaagccctggggtagtgtgactgagattgttggtaaagaatgtgcagtggttggcatgacctcagaaattctgaaatgggactgcacctgcagactgaagtgttcagagagccagggaggtgcaaggactggggagggtagaggcaggaaccctgcctgccaggaagagctagcatcctgggggcagaaaggctgtgctttcaagtagcagcagatgtattggtatctttgtaatggagaagcatactttacaggaacattaggccagattgtctaaccagagtatctctacctgcttaaaatctaagtagttttcttgtcctttgcagtatcttatcaaacatccatgaagtacatcagaacatgggctactgccctcagtttgatgccatcacagagctgttgactgggagagaacacgtggagtyctttgcccttttgagaggagtcccagagaaagaagttggcaaggtactgtgggcacctgaaagccagcctgtctcctttggcatcctgacaatatataccttatggctttyccacacgcattgacttcaggctgtttttcctcatgaatgcagcagcacaaaatgctggttctttgtatctgctttcagggtggaaacctgtaacggtggtggggcagggctgggtgggcagagagggagtgctgctcccaccacacgagtcccttctccctgctttggctcctcaccagttgtcaggttatgattatagaatctagtcctactcagtgaaagaactttcatacaygtatgtgtaggacagcatgataaaattcccaagccagaccaaagycaaggtgctttttatcactgtaggttggtgagtgggcgattcggaaactgggcctcgtgaagtatggagaaaaatatgctggtaactatagtggaggcaacaaacgcaagctctctacagccatggctttgatcggygggcctcctgtggtgtttctggtgagtataactgtggatggaaaactgttgttctggcctgagtggaaaacatgactgttcaaaagtcctatatgtccagggctgttgtatgattggcttgtcttcccccagggacagcagagcaaccttggaaaagcagagggaagcttctcccttggcacacactggggtggctgtaccatgcctgcagatgctcccaaatagaggcactccaagcactttgtttcttagcgtgattgaggctggatatgtgatttgatctttctctggaacattctttctaatcatctttgtgttcattccctgaaaatgaagagtgtggacacagctttaaaatccccaaggtagcaactaggtcatagttccttacacacggatagatgaaaaacagatcagactgggaagtggcccttgaccttttttcttctgtagataagagcattgatgttattacgggaagaagcctttgaggcttttatgtattccacctcggtctggaatttgtttctgtaaggctaacagttgcaatatactagggtaatctgagtgagctggaattaaaaaaaaaaaggaatttcaccccaatcttatactgacttcaatagagstttcagacaaaaagttgttttgtatatacttatcagtcatgaaaagataattacaactaaatggcctttttccttccctatttatytggagaaatttaattacataaaaaagtactcagaatatttgagtttcctgcatcaataagacatttataataatgaccttgtttacaaatgaatttgaaagttactctaattctttgattcatcaagaaataactagaatggcaagttaaaatttaagctgtttcaaagatgcttctgcatttaaaaacaaatttatctttkattttttttccccycagcaaataagacttattttattctaattacaggatgaacccaccacaggcatggatcccaaagcccggcggttcttgtggaattgtgccctaagtgttgtcaaggaggggagatcagtagtgcttacatctcataggtccgtagtaaagtcttgggttcctcactgtgggatgttttaactttccaagtagaatatgcgatcattttgtaaaaattagaaaatacagaaaagcaaagagtaaaacaattattacctgaaattatatatgcatattcttacaaaaatgcaagcccagtataaatactgctctttttcacttaatatattgtaaacattattccaagtcagtgcatttaggtgtcatttcttatagctggatagtattccattaggatatactcttatttaactattcccccttttgtagacatttggattatttccaacttgttcacaattgtaaacaccactacactgaacagcatcatccctatatccacatgtacttgtaacagaatacaattccctaggaagctggaatgctggaagtcatggtgatgttctcatggttacagagaatctctctaaaactaaaacctctttctgttttaccgcagtatggaagaatgtgaagctctttgcactaggatggcaatcatggtcaatggaaggttcaggtgccttggcagtgtccagcatctaaaaaataggtaataaagatartttctttgggatagtgcctagtgagaaggcttgatatttattcttttgtgagtatataaatggtgcctctaamataaagggaaataaaactgagcaaaacagtrtagtggaaagaatgagggctttgaagtccgaactgcattcaaattctgtctttaccatttactggttctgtgactcttgggcaagtkacttaactactgtaagagttagtttccctggaagatctacctcctagctttgtgctatagatgaaatgaaaaaaatttacatgtgccagtactggtgagagcgcaagctttggagtcaaacacaaatgggtttgcatcctggccctaccaattatgagctctgagccatgggcaagtgactaactccctgggcctcagtttctctgtaacatctgtcagacttcatgggtccaggtgaggattaaaggagatcatgtatttacagcacatggcatggtgcttcacataaaataagtatttagtaaatgataactggttccttctctcagaaacttatttctgggcctgccaggggccgccctttttcatggcacaagttgggttcccagggttcagtattcttttaaatagttttctggagatcctccatttgggtattttttcctgctttcaggtttggagatggttatacaatagttgtacgaatagcagggtccaaccyrgacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtaagctttgagtgtcaaaacagatttacttctcagggtgtggattcctgccccsacactcccgcccataggtccaagagcagtttgtatcttgaattggtgcttgaattcctgatctactattcctagctatgctttttactaaacctctctgaacctgaaaagggagatgatgcctatgtactctataggattattgtgagaatttactgtaataataaccataaaaactaccatttagtgagcacctaccatgggccaggcattttacttggtgcctaatcctatttaaattagataaaaaagtaccaaataggtcctgacacttaagaagtactcagtaaatattttcttccctcttccctttaatcaagaccgtatgtgccaaagtaaatggatgactgagcagttggtgatgtaggggtggggggcgatatagaaagtcartttttggccgggcgtggtggctcatgcctgtaatcccagcactttgggaggctgaggagcaggcagatcatgaggtcaggagatccagataatcctggccaacagggtgaaaccccgtctctactaaaaatacaaaaattagctgggcatggtggtgcgcacttgtagtcccagctacttgcgaggctgaggcaggagaattgctygaacccaggaggtggaggttacagtgagccaaggtctcgccactgcactccagcctggggacagagcaagaccccatttcaaggggggaaaaaaagtctatttttaagttgttattgcttttytcaagtattcttccctccttcacacacagttttctagttaatccatttatgtaattctgtatgctcctacttgacctaatttcaacatctggaaaaatagaactagaataaagaatgagcaagttgagtggtatttataaaggtccatcttaatcttttaacaggtatttgtgaactttgccaaggaccaaagtgatgatgaccacttaaaagacctctcattacacaaaaaccagacagtagtggamgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccaraatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttytaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacagaaatttacttttgtgcatttgtggcaccacctactgttgaagggttataaagccattagaaaagtagaggggaagtgatttggatcaaaaggaaaaactttagaaaagattcaaatgttcccttaatcataaaagagaactgaggggactacttgaaaataaaaggttgttttgtattttcatgttggttaagatactgagtaactggtattaagtgttagaggtttttagataaatattctgcttaatgattatgaagctgcactgagatttctgaaaatgctctgtagctgagcttatttaataaatgttcacttggtataggggaagctacaaaggcagccttcagtgtccttttgtttattcaaccaaaaatataaggacacaatgtagcagttatactgggaaggtgctgggggtggtggcaatggtgagcaggaaggcgaagtagatatggaaacagaaatgatactaatatcggtgattccttccttttttcctgtaataagtgctgtgcagacaacatatgagcagtgctgataaatgtaaatgtatttttcatagctcattaagaatcagtttcagaaagagatgtctgcttattttgctacttgaagaatccctgtcaaacagtccttttgaggaagtacaagaggctgtctctatttgtgacctcaggaatggctgtgacagtgtcgtgagcagtccttttcctgtggcacagatctgaactttgtgtgcagaaaaatcttggcttcaagtgagccaagatgccccctgagcatcagcatcacaacttcatcctcctatcttgaagttcatgttatagtgactttaatgaaatcatagaacactgtttcttcgtgaacaatgacgagggagaggaaaaaactttattgaaaaataaaaaggcaggtaatttagatgaaaatatgttacccatgaggttttgtttttgctttttgtttttgtttttgagaaacagaatctcgctctgtcgtccaggctggagtgcagcggcatgatcttggctcactgcaacctccgcctcccgggttcaagcgattctcctcagcttcccaagtagctggtactacaggcatgcgccaccacaaccagctaatttttgtatttttagtagagatggggtttcactatacgttggccaggctggtctcaaactcctgacctaaggtgatccttctgccttgggctcccaaagtgctgggattacaggcatgagccaccttgcctggccctacccatgagccttgactaaaacattcttctatctgtagaaaagcccaaaagaacttttccagattcaaaaaacttggcactttgtaatggtaatgtttacattaagtaaaaaaaaaaaaaaaacccacttagcttcagttttcaagtgtttactgtgttgtcatgcacttcatttaattctcaacacctgccctatgaggtaaaaagtaccattttacatatgagtaaattacagctcagtggataagaaactcgtccaaaggtacaggttcagtcaagtggcagagggttctttttgttgaagttaggtatcagttaaaattgaccttgtaaaatcacatcagcatcaatatacattaatttaacaaatatttattgaactttactgtatgccagatacttctctaggtactagggggtacaatgtagaagaaaatagaattcctgctctaatgaatttatatttcagtggtgaaagatgatgtgtggacaaacacatctaatgtattttgacagcaatgggtgctaagaagaaaataagacatggtaattggataacaatggagagaagtcagagatggccttttctgaggagtgacatgctcagaatcgaataaaaagagcaggagcagcctttcaaggtgggtgcgaaggatattcccggaagaaagaataagtgttgcaaaagccccagtgggaaaaagcttggcaagctgaggtggtaaaagagctatctgtactaatgtctcttgtactgagttagcaaggacaagagtggcagggggtggaactggagagatagcagggaccacatctcacaggatctcgccagcctttttaaggtatttggattttattgttagtgcaacaaggagccactggagagttttaaacagtagtggtgtgacctactgtttcagaaagaacactggctactatgggaagaaaggacagtaggaagactaatagataatggtggattgaactaagatggtagcaacagatagggagctatggtaatgttcagtatccactttggagatagatccagcaggacttgctgacagactgcatgtaagggctgagggaaagagagctagcaaggtgacttctagtttgtgacctgaactaggtagatggttgtgttaaaaatgcagtgggtatttcagtctgaagctcaggggcaatgatggaaaataagataaatgtgtgcaagytggctgggcgtggtggtgcacgcctataatcacagcactttgggaggccgagacgggtggatcacttgaggtcaggcgtttgcgaccagcctaacatggtgaaaccccatctctaataaatacaaaaaaattagctgggcatggtggtgcatgcctgtaatccaagctacttgggaggctgagacaagagaatcgcttgcacctgggaggcggaggtttcagtgagctgagatcgcaccattgcactccagcctgggcaacaagagcgaaactccatctaaaaaaaaaagtgtgcaagttattggtacgtatatatttaagcctcgggactgaatgagattacctagagagaatgaagatagggaacattcttgagcctgagatcctataacatttagaagagaagctagccagggaaattgagagggactggccagtgagagagagtaaaatctgaagagtataatgccatatgttgaagctcagagaattattgtttcaggaaggcagaagttgtcaattatatccaacattgctgagaagatgagtaaggaatgtaaatgagtaaaggcaggaatggctattgaatttgttaagacagaggtccttggtgaccttcmtaagagtcatttcagcatgacaaggatgcagacctaactggaatagattttcagggaagactgagaggcaaggaaggggagactgcaaatatatgcaaatctatatttttgctttgaagggaaacagaaaacaggacaacagctggtttacagaacttttatttggattctttccttgtctgttaataatataggctgcacctgggcatcatcgtgcccttcctttttgattctgctgttttgcttttaatcctacaggcatttcttctggcaggagccttgtacacactctgggtggttcatgaccaccacggacttgccctttcaaggcagaagcctgtgattcaaaaacttccattccttccaatcgactattataaaactcattttgtctagtgcccatactcctttaccttaggatcctgggccaactgtcactaaagaaaacaaaccatttcctcctcctgggggaatgtgcttctttcaagaaggtgcttagagaatagacattctaggtgacagcagttatgaaagaggtgtctctaatgaacctaacacttcttccaacatactccaggttcaccctcctttgaagacagaaagtactacaacttcagttgccaccctagtcaggttcataggatttactcagtaggttaagagatggtgctgagaatgaagtccagagtttgagtctacaagtggcatttgcttctcctttgggacttctgtggcagggtgtggaaccaaatcagattggttgcatatctgtttctcttcctgaaaatacaattcaaataccttcatagtctgtgacagcaacttataaccaacagacaatggtattatttttatttattgatggcactcccccatagccagaacttctactgagtcattcatcgtgtattccaggaatactttccaaatggagtagtgaggcacttccaataacagttatgtaatctgttaacagtggctcaaaatgacatgtgaaggaatgatgtacttcttttttcagactcacagatctcatatgttaattcagtcaacaagtacttagggcttatcacatgccaggcacaggtaatatgacaataatgaaaacaaaaacccttgctgtcatagaattcggtttctagtgggaagagacatacattaacaaatcatatataagtaaaacattaattatggtgataacagaaaaagaaagcaggggagagggatagtgtcttagttcaggttgctgtaacaagagtaccatagacagggtggcttaaacaacaaacatttctttctcacagatctagtggctgggaagtctaagaccagggtgccagcatgaagaagttctggtgaaggcttacattctggtttcctcacagtgagggctcttcacgcccttataaatgcactaattctattacccacatgacctcatctaaaactaactcacaaaggccaaacctcctatgttgagattaaggcttcaacataggaattttgggggggacaaaaacattcagtctctagcagataggggccactgtgggaggggattacaatcttaaatagggttgtcagggaaggcttcatgagggcaaagacctgaggaggcatggaaatgatccacgcagatgcatgtctggggaagagcattccaggcagaggcagtgggaatggaccctcaggtaagagcatgtttagcaagttcagagaaaagcctcttaggtcaggtctggagcgagagtggaaaatgtaacaggacagatcatgtaaagacttgtagaccacagttagaggcttggacaataactctgaggatgacatgaaggtattgggagggggtgttgagcagaggagtgatatgatctggtttatattttagattattctgactgctatgttgaaaatagggttgagagcagaggggaagggcagcacaccagttaagaccacttcccaaaaatccagatgatgatgggcttgaaccaggagagttgctatagggatgtgaagcaatcaaattctagatatttgggacctgctgacaggtacataatggtgtatgagagaaaaggcagtgtgagaatgactctgaagtctgtggcctgagcaaaacagaaacctggagttgccaatagctgagataaagtttctggttaaagatcaagagctcagttttggacaagaggggtgtgagatttctaatagacattcaggtggaggtgtggggaacacacctggatgtgatgagcctggaattcaaattcacatgtgtgaatttgaaaaaagattcagaaaagaggtgtggactggaggagctatccacacacagatagcatttgaagccacaagactgggggtgatgacgcagggagtaagtataaatagaaaagagaagtggtccaaggactcagtccttacatcagaggtcaaagagacaagatggagactaggagatatgaaggcttgtgcagtgagtgtttcggagaaacgaagaaactttccagaagaaaggagaggtcaactgctaacaagtcaagtgaaatgagaactgggaaatgagttgacaagagcaatttggctggcgtgatcagagaatgtttaagagataatgtgagggaagaaaatggaggcaggaagtatgaactactcttttgagtcatattgtaaaggaaaaaaatggggtgattttactcttttttttttttaaagataggaaaaaaaagtatatttatatgctgaggagaagaatccagttgaaggggaatactgtggcttcaggagacaggaaaactgcctaagccacatccttcagcaagtgagtgttcaagtggagggtttgtctttgcttggggcacgggcggttcatccacagtgaaaggagagaaggca

SEQ ID NO: 17614 - DNA, 42035 bp, Homo sapiens
aatgtagtcgagaagaacaatcttttcaaagtcatgcaaattcatttcttcccccaaacacatcttttgtgagggacacacacccctgttccctcagctgttctccctgccacgtggttacagaccagcctctttctatattctgctctggaagcatgtcacagacttcttaaaatgtaaccatggttggagtatttcagatatgagccacctaatttagagttcactgagaccccatgtttccatttctgtaccttcaaggtctacaaatccagtccaggagtgcattcacttgtcatctaaaatgacccctcactctttttaatatgaactgctattataccaggtttccctatcggggatctgcttagctagttttttgtttgtttgtttgaactgcaggccttttcattttacctaacaacttattctgtgaattttgacacacagttccaacctgttgaggacttttaaagctgggattccttcagccaagctggtagctgccaggggctgtgctaggcttattaaaagcatgagatgctggtgttggtgagatgtcaagaaatgggcacttccacacacagctggtaaaagtgcaaattggtacagctttccataaggcagtctggaaacagttttcctactccttaaaaatgtgcatagctttgattcaacaattccacttctaagaagtcatctaaaggaaataactagaaaagtatgcacagatataagcagaaagacattcagcataattcacagtgaagtcagaaaacacctcttctatgtccaactcagggcaatggttaaaaatgaaaaaacataagcgcctgtaatcccagcactttgggaggccaaggcaggaggatcacttgatgacagcaattcgagaccagcctgggcaacatagcaaaaacccatctctacaaaaaattttaaaaaatatattagccaggcttggtggcatgtgtctatagtctcggctactcaggaggctgaagccaggaggatcacttgagctcaagagtttaaggctgcagtgagctagaattgtgccactgcactccagcctgggtgagggagcaaggccctgtctcaggaatgaaaaacagcaaaacaacgtgggaaccacacgatgtgatattccacagtcattaagctgatggtacacaaatggaggggttttgtttctggtaatgacagtttgagtcatttagacctaacttcccactaaaaacaactagaaaagctagggaaaatatacaaaaatggtatttgaaagcaatgtagcatttccaaagtaataaagtattatgggaccatgacccagatggagaagaaaacagaaggtatgatcccaaaatggggaggtaactgtcccactcaaggaatctgcagctattaggagaggcagctgagaggccaaaaaacctcaccagaacttcccacagactcacaaggcaaggaagacaaaatccagaaatgagggcctgcgaagaggcagtattgataactccccactccagggtttgggttgggatctcaaaatgctatacccaaggagagagggcgaatgagaagtagatcagtcttcacaaagcctgagacctgttcagtcactgatcacaagtgcccctagcttaggcaccaaccaaccatatgacatcatctagcggctcaatttgtctttaagctgcccatatacaatgtctgacactccaaaaataaccaggcataagtgaacaccgagaagataagactgaaatacaagaaaaaaaccacaggcaatagaaactgacctataggagatgcagttaaaggaactcagaagcggaatttaaaatttaaaatgccacacttcatatgttcaagaaattgaaaaacagaaaagtcagcagagaactagagccacatggaaattctaaaaactggaaaatacaactcaatgaataggttcaatggcattttaaacacagctgaaggaagaaatcgtagagtgaaaaatcggtctgaagaaaatatgcaggacaaaagcataaagagataaaaggctggaaagttcagaaaaaagcttcagagacatatgggacatggtgaaaggtatatgtaattagagacccagcaaaggaggtaagagaaaacctcagaagcaatatttgaagagaaaataagaatttttcaaaattgggaagagatatcaagtcacatacttttataaaaaaaatcacgaatccaaagtattataaatgaaaaagaaaagccacacctagaagaatcatagtaacattgctgaaaaacagagacaaagaaaagaaagatgcggtatattaaaaagagcaataataactgacaaatgacaccacagaagacaaaagaatatactatatggttcaaagaaacaattgtcacctaaagttctgtatgattaaaattgaaaatgaaatatcctttaaaaaatgaaatattcttaacattaaaggtgaaataaagatatttgcagacaagcaaaaattgagagaattcagcagccgcagattgcattaaagaaatactaaggacttttcttcaggagagaggaatattacttttgacagctgcttggagattgtaggaaggaatgaagcggtaaggttaacatgtgggaacctctaaatgaatattaaaggcatggtacagaaatgagaaagagaggaggtaaacagaacccagtgaataagtttacaacagtttaaacacagcacatatccactttcaatgccttcatttccaggaacatattttttaactggaagaagattccatgaccccaggcctcggcatgcctgcctggaacttcagtcactagggatttagcccagatttcttctagctacgtccactttattcttttctctcattttttcaacaaatctgttgagcatctattatgggcaaggcactatacagagttctggggccacagagatgaagacactcattttataggcaaagaaggaaaactcagagaagttcagcaacttgcccaaggttacctggctcctacatggcagagccaaaccctggatctatttccttgccaggaattttctactaagcaaccttgactcccccacccctaaaaagtcacatacatgaatgctcatgttgaatttacccatgttactgtctaatattttattgctattaccattcagcttttttttttctttttttaacagtctcactctgttgcccaggctggagtgcagtggcgcaatgtcggctcactgcaaactccgcctcctgggttcaaacaattctcctgcctcagccttccaagtacctgggattataggtgcccaccaccacgcctggctaatttttgtatttttagtagagacggggtttcgccatgttggccaggctggtcttgaactcctgacctcagttgatctgcctgtctcagcctcccaaagtgctgggattacaggggtgagccacctggcccagccccactcaactttttttctctgacatcctcatatcaccgtcagtctcttcaccatcttcgaagtattccttttcactttctttcctattatttttacctttgtagaataaaaatatcttgaattcataaatggatcgtgtgaccttctatttcttaagatgcgagcatgcaacgttctgcagttagaagaatcccactggaattttcaaccatttaatgatgctacccaaatcatacacagctactgtcctcttgccctggccaagaactggggtcagggtcaaagctaaagctctaatgtggcccaggaaagaaggaaggaggctaccactttgctccacctgcctgatcccatcccacctgacaggacctgggcactggtcccccactgataaacaggggggaagaggccaattttgatagtatccatggggctctgcagccagaccactctccttccttcttccccttaccaaattcagtacctccaagctaagagttatcctcctaaaccctggcaataattctgcatatatctgcattactgtttaacaacttgcaggaaaaattatatctatacagcaataatcaatcatgggtgtatagataatttacggccaagacacattttaaaaagacggttttgttaaatgaaagtactgtttcattatctctgctattaacataacagcccaattttatttaccacagagcttattaccatatgacctcacttttctttttttaattaataggaaacacaaaaacctgaccctactggagaataaaatcctgcacagaaaaattaatgtaacctttaaaaccctgacgtaaaaggctacataggttgagtgcgttaactcttcccatgtccacagattaacattgccggagtattccacgagattccactagtatatcatgatgagaaagaccaacttctaaggcagcttgaagctttctgtcctcaggtcttttcagtttgatttgcttaatgtaaaacaagtattcaaaataagcaacgacttaaataggttggttgaaatcagtggtttcaacttggggcgattttgccccccagggaacatgtggcaatgtctagggacatttttggttgtctcaacagggtgaaagatgctactggcaaccagtgggtagagtccaggggtgccgctaaacattgtacaatgcacaggacagtaccctccctctccccagcacagaataacccagtccaaatgttaacagtgtcatcgctaagaaaccctggtttaaatttttcttcttgaatagctgcatttaaccagatggtctataaccttgtaagtgctaacaacacactggcttacacagctcccacccttgttattttatttatatatgcaaacagatgtgttatgttctttttaagaccacctttgaatggaagaaaacttgccaaaatgtaattacattcaatctatgtcagggtgagcatagtttcattcagtccccaaatgaagacacactggaaattaggtggcagtgcatttaatatggggaggtttcctgagagttaggccttcagttcttgtttaaaggaagaataaggaaagaagaacctccacatttctaggctaaatgaggaacatggggtaaggggtggggtggctgacatagctgaatcagtggatttttggagaagcaggttgtatttataggaggtcaagacttgtaggatgtgaccagctggtaagaagctttgaggatgatcatcaaaggttatatttaatcccaagcaataaaaaggcagcaaccattacgagtccactaagaaatactcagaagacaaaaacacattggtctactctcttcccatccagattgcagacattgccctttatacatactcttacatcctccctaacttccaggcgtagttaatactctgcctccttaaatcataatttatactctgagcctggggcctaattacttaatcttttcaaattcatggaacatatatgggtagcatgtatcatgaccgtgggacagcttgagccacttaataaaactttcaagtccaaatcgtatacaaaaacatcctggtcttatctaaaatttcgacattctctggagaaacaatctttagtgtgttctccagagggattctcagggtcatccaattctgatgcttaaatcaaataatcgtttggctttctctctttgttcctcaaaccccaccaaccccacccccagggttttgtccgtccaaactgttcattttgcttcaccaagtctgtttctgtgccaaattctgcaagttaagccttcagcctttggactatccttttacaagatgggggctcagattaaattctcactaacttgttcctgttgtgatcccagatgtgcttctaatctgtgttccttttgtgtgtgatctcaaggcatttggactaaaatggaaagtcagcattttttagaaagtaattggtcttttattatacgatactttgaatgggatcaatgtgtttcggcaaaaacagaaatgatgacgagaagaaagaaagaagaacacagatagatgggaagatttcacccctttcgtgaggacacttaggataatgagcaggggtctaagctacaggagggtggaaggggaggacgtctgaagagcttgaagtgatctctgcaagtttaaaacaaaagcacagttgtctcctgtctagagtcagtttgtattcaattgttttttaaaaggaaaccaccaatggtgaggatgtttcattatgctaaattataaatcactcctgaaaaataacatttagaaagaaaggaaaaggttttggaaataggctacacgtaccattaccaaaattgtgtcatttcagaatgataaatgccctgtgtgtatttttgaggcataatgcagtaaagactttagtacttccagttttcactagttgagcacaatggcagtgacgccagaaaagaagtgacttttaaaagaagggaacaaaggaagagggggcatggttttggaacaggctgggcattaaggataaaaaagaactcaagaatggagcaaagtagggagctgggtgcctgggaggacactgacacccagaggaaaataagggagacaggactgatttgatcatttttgatatttgatgtgtgaaacatttttacctacttgaaagtagtgttaaagtacaatgtgatccattgctgttttgggaagcatcgatattcctttttacatgcgtaaaatccccattcatcactgggagctttcaatccttttggtatttccagttgctcatactatcctatgtatatcaccaatgtaacaacagctgtttttattgctgctgtcattgtgctggaaaagcgcaaacatgtttgtacagctttctaagcaaaactgtcattttcccttttattaaattggttgtttgtgattagtgggaagagttaaatcgctgtagaaatcctattagaaagagtaatgtaatagcctgtacagggatcccagtccatttcccaagacaggtcattaaattactttccgagaggagaagattcacacagagcattcagggcaattaagaaaatcaccctattcctggctcttgggcatttttgaagtgagatatgctttgagcaaaaccagggaatgtggtaaaggaaaatmatttttgcacaggctttagaaggtcacaggacagggaaataagcaatatgtttgaatcctggcctagccacagagcagctttgagacagattaaccctgcatagcaaagcctctctttacctgtggtgggtttggcttccttaattcattgtaaggtgatgcctcaccttgtttgtcctaattgtgagaacaccatcatattatacaccaaattggctggttcacagaagggcaaagatcctagactgaagatatttttaaattctcccactgtggtatamtattatttgacagtagactatgaatacattatagaaccatactataaatttcacagtctttcttgatcagacctcctccagagattgagctgtaataccttaacacatccatcatatatgatgaattaatgtctctcctatgcatttagaatggtgttacttatgcatcatccttgggagaattgagaaagacactcaatcatttttctctgtcttctgtgattacgatgaaacactctaagaaaggccgtgcctcacacaaacacccaaaagtaataaattagttaacaaataaataatacaatagagacaaagagctaagaaaccaacatacagaaaactagaatactgattttttaaaaatccaaaaccaggtaacaaaaaggaagtgaaagaaggaaggaaggaaagaaggaagggagggagggagggagggagggagaaaaacaaaaaacccaaacagatggaaaagtagaaaataaagaacagcaacttcaaaaaagccaaccatattaataattacattaaagataaatgatctaaatactccaaaataaaaggcagagatggtcacaggcagtgaaaaaggaagacttaactacacgctgtcagcaagaaacccactataagtataacaatgcatatagattaaaactgaaagagcaaagagcagtaaatgatatattatagaagatgaaatactatttgataaattggacttcaaaattttaaaattctgctgatcaaaatacaccattaagaaaatataaagttaagccacagtgttgaagaaaacatttgctacacaatcgacttgtatccagaatatataaagaactgttaaccaccttaacgcacgtaaaaatgggtaaaaaaaatctgaacgtttacaaaaaaaaaatatatttgaatggccaataagttccatgtaaacatggtcaatttcatgaaatatcagggaaatgtgaactaaaaccacaatgagataccaatatccaaccattataatggttgagttgaagaagactgaatataccaagtgtaaattataaatcaccaccaccaccgacatataatgtataccttggtgaggatagaaacaatagaacacatatatatttctggcgggaaagtaaaatggtagactttgggagacaatttggcaatttcttagaaagctaaacacttgaaacaggaattccattcctgggtatattcccaaatgaaataaaaatatatttctacacagtgacttacacagagttaattataacagctttactcttaatagctcaaaacttgaatcaacccaaatatccatcaacaggggaatgtatgagcaaactgcagaatatccaacaatgagttactactcaagcaataacaagaaatggactcctgataccaacaacacaaatgaatttcaaaagcattatgttaatcaaaaggagccagacacaaaagagtacaatcacatgatttcgtacatatgagtttctagaagagagaaatctaatctttagtgctataaaacagattggtcgttacttgaagccagagttgataagaaagactgattgaaaaggaacactacaaaggaactgactatgaagaaatatttttgggatgagggaaatatttaatgtcttgatttgggtgacggttacgtgggtgtatatacttgtcaaaattcattaaactgtccacttatgtgtattttatctttttattgttttacttcaaagtttatttttacaaaaatctccactgtgatatggttttctctctttttaattctacaaatttctatggtatatattttgaaaaaatyctaaagcaagtgtttcagattgaaggaaaatgatactgagtagaattatgaccaggctagtagactcattttattattatgagataggactatttctcatcaaacttcctgtcttaaatcgactatatttaatattgttacagctggtcagcttcattttgatgtgtttgcttgcatggcatatatatttttctctccttttacttgattcctgtaggaagttctatatttatatatacttcatttctgtatgtattgacatttaaagtgtatctcttgtaaatcatatacagggagtttggtttcttaaccccatctgataatccttgttttttaatttttccatttaattttactataattcctgcagagctgggtttaagtctggcatccttctacttattttcttgtgtattagtattttatttttcctgtttttttaaaataaactttatatttttattatttcatctttctcttatagcagcttcttatatcttactgtcatcctttcagtgcctactttggagataaaaatgaggatcccagacttattattaacttagtatctttactgttttcagaataagcaaaaatattataatagttgagctctatttgttcctccctttgtgctattcatagtttacttatccatatgttgtaaagccctaaatatcttgcattattgttttaaagagttaatagtgttatatttaccaatatgtttacattcttatgctctttctatagttctatgcttctatctggcatcgttttccttcaacctgaaggacatcctttcatagctcttacagtttgattctgttagagacgaattttatcacctgcttttggtttttaaatatctttatttttcctccatttttaagagwattttctcccagtttgaattctgcattggcagtttttcttacatcttgaccttccaagatatctttccattttcttctggcggtttctattgaaatgtcaaccaccagtcttaactttgctcctttgaaagtcttttttcctctgaatgtttaatagattttctcttggactttgactttcaacagtttgattatcacgggctcagatgaagttttctttgcatttactctaattggggctaaatgagtttgaaattataattaactattagtcataacttttgaaaaattctcagccattatctccttagacattgcttctttcccagtctctctcactcctttccttataggattccagttatatgtagttacacttttcaccgttccatgtggcttctgtgctctgttctgttccttccattcatgtctactgtgtttcatgtctattgatctgtcttcaagttcactattcccaacaacttctgtttccattccaatgagtacttaattttagatattgatcatattattcagttatagaatcatatttgtagaatccaggtcactactgaaattctgcatatttttctccatttcagagattttgtttttcgtttttgctgttttaccacaccaatgctaattagcttcaagtccttctcagctaatttcaatatttatatattggtggctctrtttttttctcttgtcagtcacagtttcctgcctgcctttttttgagatggagtcttgctcygtcacccaggctggagtgcaatggcacaatctccactcattgcaacctctgcctctggggttcaagcgattctcatgcctcagcctcccaactagctgagattccaggcatgcacaaccacatccgacaatttttgtatttttttcttttcttttcttttytttgaaacagagtctcactctgttctgttgcccaggctggagtgcagtggcgcgatctcggctcaccacaacctccgcctcccaggttcaagcgattctcctaccttagcttcctgagtagctgggacttcaggtgcatgccaccatgcccagctaatttttgtattttagtagagacagggtttcactatgttggccaggctggggaatttttgtattttttgtagatacagagtttcgccatgttagccaggctggtctcaaacttctgaccttaaatgatctgcctgccttggcctccaaaagtgctggaattacttgcatgagccagcgtgcctggccctcatgcctgcttttgaaaacatgtctagctactttttattttatgctagacactgtgtatggcagtgccataaaggatccagatgattttcccaccagagagagcacagcctttcatctgtaggaaaattggactgatgtgatcagtctctcacttgccaggaattgagctgggtcagggttgggctgcacttctagtaaggctcagtccaagccttagtaaggctcatcctcaaggatggttccttgacggtgaccatcctaggcttttaatttaggrtctggagtatctgtctttttggcccacaaacactacaaaagactacagatgaagttcagttttatctttgcaaactagaagcgtactctttagctttcttgcccatgcaacttgggcaggaaacatgacatgggagactagttatgtgtttgttgcaagccccattcctcttgctggaccttgtctcccaagttaccagcagattgtggaagatttcactctgcctttctcacccagtacctcagcctcctaaatgatgccagaaattatatgtaaatttatactactttgtcaagcaaactttcaacacaagtcttttcttttttcactattaacactttaagcatcaccatagacatattgcttttactattgactgacttaatattgtttgatagtataaaagcaaacttttacacagccactatttaaaattaactcaaatcttaagtgatgttttgactattttttcaaattgtgattttctatttgaggaaatgccctcaaactatatcttagaagtttaaaaatattcattgcaacttggccgatgcctggtgtgctttgtggtagaagaaaactgaacatctcatctcagataagaggcattatcatctcatagttagcaactgcaagtaacagctgtgatgtcttggagaccctttaatatcgtatccattgttgaaggtcagatcttatcccttaccagtccaagaatgatgtatgtgtcagctgtcatgaagccccttctgggacaagtagagagatgcatttatacaactgagtagatatctgccatttttgcctgcttgccttctattcacctcttatatcatcccagaacccagagttattttggggaaccacggttctcccacccagtcctgtgatttcagtggactatctccttccccctatgccaagagtggacacatggcccaggcttggccaatcaccgtattctacaccttttgactacattgatcgtttcaaatgagggcacatgacctaaatgagatctcagagactctatttgaggacttctatttacatcgttgaggaagacaatgtttgcagctggggttgttgagaaggggagacaagactgtagctgttgtcagccatcttgccatgatgaaggtcggctctctctgagggcagagacaacagaaagaataaattccagtcttgggaacacttgttgagtcactggagtctctcatatctaaagccagaaaatgcccctggactttgggtattgtaaacagaaaacaaattccaatgtaacataagccggctttagttttctgccactcataaccaagagttgatttattaagtaattcttactaatggatcatcattctcagccagacttcattccaagaaaaaagggctagaatgatgcactgggtccagaaaatggagataaaattaaagtgctcctattgcattacactgagtgggaatccattcttgggagttggctctgtcacaatgcaaatatggacatcaataagccactaagctttggaggagcagagaaatgcagttttaggggctggactagcagttagagagaatagttaaataatcagattgagatgatctaagacagttgtaaatatggacttcagccttgcaaaatattagaactgcaggtaaagattttgtgtcatgttaacagaagcgacagatgaaatgggctgggtgcagtggctcacgcaggtaatcccagcactttgggaggctgaggtgggcagatcacttgaggtcagaagttcaagaccagccgggccaacatggtgaaaccccatctctactaaaaatacaaaaattacccaggcatagtggcatgcgcctgtaatcccagctgctcaggacgctgaggcaggagaatcgcttgaacccaggaggyggaggatgtgctgagacaagactgagccactgcactccagcctgggtgacagagtgagactctgtctcaaaaaaaaaaaaaaaagtgatagatgatattttggagtattctgaaagggtccagagatgcaatgcagtaaaaaacaagcagacagaagacagaaccctgggagttgcatacatttagaaggctggtggagaacaggagtgggaaaagaagctagtagagtggtcaaaggggtcggaggagaacaaggcaaaacctgggaccaagaaatccaggggcagcaattgcaagtaagagaaagaaatcaccaatgacaaataccaataattaaagaccccagagaatgtaagagaagcaaggtatttaccaaggcattattgaccttgccaaaagatgttccaagcaagtggtagggtagaaccaggctgcaatagttacacagcaaaacccatggtacacagcagccactaaaagcaatcagctgcctctgagatgcctggtggctgaggtaggggcagaaaggcaggtgggtgcagaggtaacagtatggaaactggagtgctaactctcaaaattatgtaaataccatcatattgtttttaattatggatcactgggtgggatgtgtctcattatcaatgggaaggtacaaaagaactttctcagtaaataaaagaaggttgtaatgcagagtagcacaggtacagggaaattattaacatagtctcatagctgtttggtgagaatgggaccaaaayatgaaattgtgcactatgagagggatgatacatttttgttaagcatttattgtgcaaggggatatggtggaccctaaggagcaggaaagaagtccctgcctttagggaatgccagtcttcattaagggtcgttgcagggaaaatctctaggatgcctcctctgagctgagctaatactaaatctccygcccacctttttagtgggttatgggtcttcctcattatacatacacacaaatacacacacacacacacacacacacacacacacacacacacamacctgcacgcacacaagctgcatgagatatactcaaagactcctcattggttttctgaaatttaaatttaaccgggcatcctatattttatttggcaatgccacattccatgcatgtttgctgaataaatacagaagtataactggggctggagtgggaggagaaacctgggagaggaaaataattctttttaaatctaatctccaaaaaacaattataaaaaagtagcacagtgcttagggcacagcactggcagagcagatgagacctttgtggcataaggaacatgtatctggtctctgccccctgttcctggaacagaacttctaaaacccctgtaatttctcgggtgacaggaacgtcttttgttctaataaggtgactcttggtgggctcctggatgggggctggtcaccagaaagactgagccatgattagaagctgggaacttccagyccacccccatcctctggggaggggagaggagctggagctggagttaaaaatcgataatgccaaagtgatgaagcctccataaacatcctgaaaagaggagattcaggtttcagagtggtgaacacatccatgtgccaggagggtggtgcactgcaactccacggggacagcagctcccacgctcaggaccctctagaccctgctctataggcacctcttcatctggctgctcattggtgtcctttaccatatattttataataaagtagcaagactaagtaaataagtgagtcccgagtcattatagcaaattattgagcctgacaagggggtcatgggaccccttcacttgtagccaagtcagagagaagtgtgggtcacctggggaccctctatttgcaattggcgtctgaagtggagcatcttgtgggatggaaccctttgcctgtggggtcggtgctaactccaggtagtcagcatcataactgaactgtaggacacccaactggtgtccaaagttggagaattggttggtgtgggaaaaaaaaaaaaaaaaaaaacccacgtttggtgaccagaagtgaagtataagcgtcaagaccacggtttgcattttctgtacagctgcaatgagacgacgtcagagaggctgtgagaaacccatggcagagcaccagcgggggacacaagatgggtgcagagggaacccgacagcggggccttccaagcacacctgctccttccctctccaacacctgggttctgtcttccacaagctccagaacagcaagtcctgaagtgagaacctggccgtgcctctggatgaatgtgacttaatttaggtagttgtctcccttcaacaaaccaaacacaagagaagaaatgctgtgtgtggctggatggtcctgaytatgtggttaatgagatatggatgccrtgtggtcagtggagtctgggtggtcagggaaagcttcagggaggaggcaggcctgtggggagcctttaaggaggaggagaacataaataggcagaagtctctctgaattcgttgtaattaaacctaaacactaagccaaacatgatatcaagattgtggctggctttattaaatactgtttatgttgtagwctttgcccttcttcagcagcaagcaactgccttctcttctcttgttagacaatggtgccgtcaaacccggggacatcagcacatctcaggygctgacaaaccaggaaygatgccctctcatcgcagccacatatgcacgtgaacatatgtgagccacatcgccaaagctaacaggtagttatggtcaagtcttcagattttgcagtttcttcttttacttttcagtratacattattacttacttgcataaattagccatgttggttcagatgaagagacaacatcacacgttgctactttgcttacagtttctttgcagcagaaatgcagagcagcttggctgaaaggtcccagcctgagggtctctcatgagggtgcagtcatcacctgagcctgcagcttggctgggatgaaaggacccactgcaagatggcaccctagtatgcctggcaagtcagcgctggctgtcggctttccatatggtatctccacagggctgtttaagtatcttcatggctcagcagctggtttcccccaccagttgagagggccaagaaaccaaggtgaaaagtacaatgtctcctatgacttaacctcaaggtcacacacttctgccttcttctattggtgacccagaccaaccctgcctcacaaaggagagggccttggaagggcaaggatcaccttggaagctggctatcacaaagcccttgaattyaactttgaaaatgcaaagtatggggtcaaagtctcccacctgggaaacagaacattttaagatctcatatggaatagccagacatataagatgaccatataaaagggtggaagagaatacatacacctcatcaacaccacctgcttcaaggtgtgagccccatccatccatctgtccatctgtccatccagccatctatccatctgtccatccgtcgatctgtctgtctgtcttcccacctgcccwtctatccacctacacatatatcactggtatttatcacagaagcttctgtggtcaactctaggaaaaagtggtgaataaaaaagataagtctctctcctcatgggatggacagttaaggctgaaaggcagacattaaacgaggacataaacagataaagaaaatggtgaggcagagcgtggaagaaacaaagaataattacagcaaccaagcgagtgggcatctgcttaaatgagataatgagggaaggaagacttccctaaggaaggggttttaaggcagagacgagaagggactcattcaccatgcaactagatggggtgctgtaggcactcacggatggaggtcaggaacaggcattcccaaggacattcccagggctctcctggacaaaagccagaggaggagccaagccaggaataagatgagaagccaagtgtggaggatgaggcatcaccaccgacctgagcaggttggcaggagtagcgtggtctgaggactgctggaggagctgagggtggggcaggaagtaagcttggagagagggacatggacgcaagtcccacaaccatgggaaaagtagccagctcgattgttagagaggagaccaggtgtccctggtgagggagagcagaaaccagctggggatgctgtggggtgaggatatggtgtgaggggggtgctccaaagggagtttcaatgcagacagagtagggcacagggagtgttagggctgcaggccaacgtctggctgccctttggaacatcacctcaatggggccacacattaagaagttctgctttgaatttgggacaaattttgggagcaccctccactcataaatgagacacactcaaatcaatcaagagatacgacatggacattttcaggaaaaraagatttgtctgagagcccattgtctatataaaattttcaatactctattttcaaaccttgtctaaaattacacccccaaaatgtcacttgactactcagaaaccttcagtggctccccattgccttcagaattgaagtcaagcccccagcatgatattcagggccttgtttaatctgaaaactcctcaacccaaccccaaatctagctggaataggtacttaatagtcacttgcaaacataaacagaggactggaacttgcctctcagagcacagtcaatgcagagcctcgttcaaaacccctgctatgaggctttctatggaaggaaagggagaagcgggggtttcagcagactgccccagtttgtacagaagctaggactggtaaggtaattaacgttccttctcatttgggcctgagatgcagggcaaggaaacggtaagcatgccgctccaagtcactgcatttgaaatgaaacagttaaactcatttgccgtcatggttgcaagagcttcttgaaaggagttgctctgaggttaatgagcatgataggtcaattctatgtgtgctgaaattcttggaatctgaaaacatggcagttgtagctagtcagctttcactgaaaaatgtacatgtgttgtcttcgagggtatttacttaactaaagacgtacgtttccacagcttctggacatttattttataggaaaagatctttaaagtttctccaactcatttccccacctgccaactctgctcgccagctctttcctcgtaatgcctgctggagccaaaagaacgtctccgtgttcctgtctgttataaccaacaaaaatgcatccaatcttttgtatttgacttaaggatgctgtttctgtcctttccaaccgatggctccttataaccctgtctgggcaactgaagtatgtggcataaaaatcagaatattagtttgatccttggagctgggaggatgaccagtttgtgttttgcccatcacaggcgtttcccatggcagctgcattcccagaaacacttccagactgaaccagacgaggctcagtacctgccaatgaaacagcaggctggaaactcagtctctggagctccaccgagaccgttctggagatcaacctcacaaagctcccttctctttttacttaaaactgcaaggcaagggtgtctgtagatgtgtgattcttcacttttccacagcagatccagacatgaaaatcgcaggacagcaaatgcccactctcaatgctctttataagcaaagacacagacatgggcagctagtgtctggctgaccgacagctcccagcgatccgatgcattcccacgaagtccacttatgagatttgcctgtgtcaaggaacactaaaaccagcaataacttttggcaatgcaaacgcattcctattagctgaataggcacgaccagagattatatgcccccgtggtcttgttttgaactacaaaagaaggagctggatttcaaaggagatatgatagmattttttacccctgatgggctcttaactcttccttatgtttgtagtgcaggaggagttaacatttctaagagttctgtttgagcaagttgcaaagtagctctgaaatgaaatggccagttttaatgcagtttttaaaagggcaaaatatctctatcacttagcacagggcctggcacataaaggattctcaataaatatttgttgattaaatgaatatacagaaaggactcaacagaaaagcagggtaatctctaatcgtaatttcttccccctcaaaagtgttaagtcaaaactcatggagataattccacccaatagtatcctaggcagggcctccgccctcagcagctgagcaggtttagagccattcaactctaagccccaagttgcgcagggctcaatttacatggctatacatgtaaattgatgaaaacatacacctgatgaggtgttcaaggtggaaaaattaaagaaattggttgggcacggtggttcatgactgttatctcagcactttgggaggctgaggcaggtggatcgcttgagctcaggagtttgagaccagcctcagcaacatggcaaaaacctatctccacaaaaaataattttttaaattagccaggggtgatggtgcactgattgtgccactgcactccagcattggtgacagagtgagaccctatctcaaaaaaaaaaaaaaaaaagaaaagaaaattgttaaaagtctacaatagctaaaatagcattttccaagtggtataatgtgttcccccatgacagacaaatacattttaagaggtatacagcacacttcattttaatcagttttagtgtttgagaaaaaaaatcactaagtatctcaagcatgtataagctattcatatgataagctgtaatattaatgatgtgattgcttttataattaggttaaattcacgctggtgggtcctgggtgactgaagtttgagaaacatggatgcaaactatgttgcctccatatacagaaacatcaccgcgagtccatcaatgatgggaagtgctgtacctgtgatgtttctgcaattgagcgaatccacccacagcccttctgaggagtccttcctgagacacctctggggtgggacctgccaggtgaggccgaggaacacagccaagctaatggctcccatggaaacgggaaatcttaatagagacccaatccacaaccctggatctcagtagctctgtgctctcaccaactctgttttgggtttttgaccaaatctttaaacaatatgcttggaaaattagtaggttcaagcaaaaagaagacccttagtacctctgctgagtaaaaagtgcatatggcagacattatgccagctgaatgaaacattttgtgtgccaactttagaaaagggtcaatttaatttcaagtaattagcagaaaggcagccttgaggcatggatcaatgcaaggaatgtgaaataccagagctaggtcaaatactgaagagttgggaattaatttttttaagaaatgttttttttcccccagggaaaagagcctaatgattaggtttctaagtaattgatttaacttattgaacatagctattttatttatgtctataggtacatccataaagagccaaattcctggcatatttccttttataccattttattttattattttttgagatggagttttgctctgtcacccatactggagtgcagtggtgcaatgttggctcactgcaacctccgcctcctgagttcaagcaattctcctgcttcagcctcccaattttatgccattttaaattaattatgtgaaaagatagggtgtgtctcagccatgagccagcacttgagatctgtttcttttataatctacccacagcagacatacacatatatttcccacactctgtcagctgagaaggcctagaagcaatgactgcccagtagcagtgagcctatctagtacctagagtctctaataccattctccaaggaatcrggctcgtggagaaatggctgactttaggacaggtacaggaaatataccagatgaacccagtgcagcttgcagtgccagaaaggaaggaagtgctagaacacacacacacactcaacagtcataccatctctctcacacacactctcacacattcttatacattcccatacactttcacacactcaaactcacacactaatgtacacccacacactcacatatactttcacacacaaactcacacacattcacactctctcactcgcatacatccacaagctcagagtcactctgtcatacacaaacacacacacattctaacacacagatacactttcacatacattcaaactcatgcagtgacattcacactcacacattcacacattctcagagccacactctctcacacactcattctaacacacactttcacacacactcaaactcacattcacactcacacactcacatacacccacacactctctcacacaccttcacacatgcatccatgggtgtatgtcaaagagacacaggagccagtgaaaagaactctcaatagccaaagtaggaacaatttgaacaataaaataaataagagtattggattatattctaaagtataaaataaatacctgtattagtctactctcacactgctaataaagacgacccaagactgggtaatttttaaaggaaggagatttaattgactcacagttccacatggctggggaggcctcacaatcatggcagaaggcgaaggggaagcaagacacatcttacatggtggcaggcaagagagcatgttcaggggaactgccctttaaaaaaccagcagatctcgtgagacttattcactatcatgagaacagcatgggaaagacctgcctctgtaattaaattacctcccaccaggtccctcccacaacatgtgggggattgtgggaattacaattcaaaataagatttgggtggggacactgccaaaccatatcaataaccatragaccacattaatgtcgttaaatgattaaaaacataaatagggagcacagacaaatctcacatgcatgagaattccaaataatggatgcagctacctcgccatccaggggtgcagcgtaactccccactcctcaagtatgggatgcgcacagtgacctccttccaggcaacacagcatgggaagggggaaaaaggagctttgtaagtggagaaacccagcaaacacaacctcagccaggtgctgaagcacctacagataagacatatgcacagtatgtccccttgatatggtgtaacaagatggggaatttgcctctgtgatctgctgcccaaaacagacaagcccagtcccatcatgagaaaaacgctggaaaatcccagctgagggccagtctatgccacacctgatctctactccccaaaaccgtctaggtcatcaaggacaaggaaggcccaataaaccgccacaaccaagaggagccttcagagacacgacactgaacacgatataatgtgaggtcccagatgaaccatcagaaaacgaacattgagtcaaagctaagaaaatcagaataaggtacggacattagctcctaataatccactgataagggcttgttaattgtgacaagtgtaacaacaggggagacttggtgtgaggtacatgagaaccatactatctttgcaatttttttataaattaaaaattgttcttatataaaaagcttatttttaaagatctagcaagagcagtcttgggaggatggaagggtgggaattgacttttattcttccttgccccaaatctctaatgggcagatttctctaaacacatgtagtcttgggagacacgtgtttccttttgaccatttacgtgtggtgcccaccatgcattctcaacggggatgagcaaaattggtactaggaaggggacgaaaaccttcgctattacaaaggtttttaccctccaaagtttagcttagcacaacccaataaaatcttattccttagtgttcaagttctcttgttagaaagaaactaaatttaaattcatttagtttttctctttaggcaggcggtaacaaaaaatgctggtaaaacactagtgtgcaccaccaacaatgcatgtcttcctcacattctcagggacacgtgcaagacacaagagcatgaggagtgtsttaaatatatccaaaaggaaattcttcccacagcggctctctatgcaggcatatgttacattctacaacggtgctgtagtcaagcgttgttttaatataattttatatacgtggttgcaggcactgtcaggataggtataaaaatgtttctcactttttagggaaagaataggaggatttaaaaaaatctgaactttacattttggttgaacaaaaacatcttcatcactatcacaactacttattgagtgattattaaggaacggtcctcactggttatatgttgcaacttcaaagaaattccacagtaaacacgtagatgaaggcttcctcagctttcctctgacataaaattataaagtgcaacattaataccattaaatctcttgggaagataagctcttcagtttaaagtaagattttagaatcctaatcctttctggaagttatatgttcttccaaatgacctcaatccccagaatgttctctctcttattaaaaaatgtcaggcttaaaaagaaaaaaatattgtcacaaatgaactacacaaagataattgtgaaaaatggggaaccaaggtatgcagtatataaaaattctctgtaatgtctttgcaatttttcaataaatccaaaacttttttaaaataagttgtttattttttaaaatcccatatgtctgactaagtacttattcaaatttactacagtctgtgagcttctcaagggcaggattgggtcccattcatccttgcttcctgggaacctgacctcgggtctcaaagacaacaagcattcatacgtccttgggcaaatgtacaactgaaaacagaattcatcaaactccttctctcctaatgtcaagtaactataagccctacatgtcagtcaaacataaaaagcattactcaggattacaaaaatatattttacaatttctgtctcaagaaggtaaatcatgatatctcctgcattatccaaatttgttcagttattttaaaatatgatttttttttcaaaaggacccagtttaatgatgatgacagaagcttgtaggggaaggaaaaggtacagaatctaagacaacccgattcaataaaaacaatttaaaagtatgatattaaggccttgctaagaggtcacaagaaacaagcgagtgggtggtgagtgttgttggaaatgcagagcccttccttggttgaatgagagctccctaagccagggacacagttgaaacaagtacaataccttggcctgctttctcctctttgtgtgttggccaaaaaggaggagtgaacaggaaagaccctggcagggagttgggatgcaacaatcacatcttgttgaagaaagccagatctccctcggaggcaagacagacagggagggagagagcgctggcgagtgctcaccacgtctgccccctgaaccatgacctcagctgtctggagtcaagatgtatgaagcagtcctgatatgatgcccaggggaaagaaagttaaagatttttctgaaaggtagcagaggaatatgcaaagaatactggatttcaaatctgacaggccttggcccagatgctagtcttctcgcttaactttctacctgggggtsggggggggggcttcagcaacctcatgtgcacaacagcatccaccttgcagggctgctgggggcatccagcgagctgatatctatggaatatctagtctaggggttataaactatggccctcgggcaaagccaatgcactgcctgttttggttcagcctgcaagctaagactcatttcatattctaaaattgtttaaaaagatttttcatgacacatgaaaatgatactaaattcaaatttcaacgtccagtaagttttattggaacatagccatgctcattcatttatgtattatctagggctgcttctacgcaacagcccagttgagtcgcttcagcaggtatcattgtgacctgtgctgctgaacatatttactgttcagctcttcccagaaaaatctgcagaaccccagtctggctccgtccaaggccaagacggggatcccagtaactgccagtttcctgtccttccacatcttttctcaccgtgcagtggttctcaacccggggcaattttacaccccaggggccacgtggcaatgcctggagacatctgtgactagaagagggtggcgctggcatcagtcaggtgtatcagggatgctgctacacatccaggaactcccaggccagtgccctccccccacacacagcaaaggcttatccagccctggggcagtgataggaggacccggtgagggacaggagagaggctggcatttgctgaggatccagcatgtgtagggcatggcatcaggtcacaaggccaccatcaccatctcctttacagctaaggaaacaaagcctgagcaagggcgaatgacaagcccaacgccacacagcaaggcagagggagtccgaatccatttctgcaggttccaacatccacggttcttctcctcccaccatgcatggaaatgattctttaaacagctgagctcccagacaagatacaagggtgccagcttttacctctccaaatcctctctccataatgatgggttatatgaggtctggtgcaggagttggggcctccagcagcctcctgtgtggcagacacagcttcatgaggattgtcaggccaagggtggggttggggttcccacagaaggtaagaaactgagtgggacagaccatacccaggaacccagagagtctgggaacagtgttccaaccatgagccactgtgcatgtcatatgatgatatctattccacagtaggtattttagtcattacattcttaagaggaaacaccaytggctggcttggaagctaatgtaaaatagatgcttcctaagtctgaaaggctaactattgagcctgttcagccaagctggaggtgctaccatctagcctgagcaactcctgcaattactcgaataatcccttagataaaaaatataggtctggctatgtcaacccacccatgtagagtaacagcactgctcttggcacagagctacacttggggcggtgtcccaggtaagataccacatagcactaaagtgaagaaggtagcattctatcagctagacgcagcctccaaatgattttaaaggacccagagttgccaaaaggaggtaggaaacatctaaaaagttgtggtagtcagagtggtttgcaaggctcaggatccaggcacggataaagtctcagagtcagtcaacaagcatcctgcaatcactccactctgtgccaagcactgcaccaaggtggaagggcacagagctgtggctgctgccctgagggagggcacaggctggttgggagaagcagggataaaaactaataatgatggtactctgtgatcgcgccagagagctgaatcccaaagtcatgcatggttggggtctaaggccagtatagaaggtagaggtggcacctgaggcacagtccaaattaatctttgaaagcctcacagctttcatgcttttatacaggttcagcatttcttctccacagagcactggggcattgcttattgggttgagcatagtcgagttggcttattttaggggttgcgctatttcatgatatccaacagaaagaactagaactgctcttaggaagtaagaagsttgcctcatgagaggcagaaggaactaagaaaacagcagatgcccacatgctccttggggacccaaggggatgtgatcacctatgtcacttaagttgcgtctctgcagcatctgtttctgccatgtgcaaggctgaatttgcatgaattaaatgtgtgcatgatatgattgcacatcacagagatgtggacaacttataaagacaaaggtatgggaaggaagaatttggccaggaggccaggggttcaggatgggtttcacaagagaaggtgccatttaagaatgagtgcttaagtggtgcttcaagaatgagtaggactgagggagtcaggggacatggggacagaayatagtgcaagcatggtgtaaagaacgtggcctatttaggcaactggctgccctgacaagcttcatggctaagatgtaggggtgggggctctagagtccagatggcccaggctacccagtcccatgggcatcatgctaagaagcctggctttgaattcaggtgtcatccgggacttccgaaggactggaaagcaggaagggaacaggttctatctgtgctttagacagagtaccctacctccttttgtagaatggaggaagactaatgaaggcagtggtagacagcagaaagaagaagcacatgtcaggatactgggccagtagagttaagaagtgtttcaaaccttactatttcaggggagaaggaagatgacaaccttatcttctagggacaattaaattaagtgggaggcagagtctacgttgggggacaatacatttgcataattgggaactttcagctggaggtacctgtaattgattggaagtagatgatcaaatctcaggggtcaaagcagaatgagaggtgtggattttaagtcaatgcatgctagatgacaaaagccgaagttattgttcgtaacacctgatacagcggttcacacagtgggaactccacgtgtggtagctctcactgctattttcacttatgtgagcccctaggtgcaagtagaccatgrggtcacagttgagagggacatcaccagcgggacccttcatcagaagtggggccacaaagaaactcagaggacaccaagaatgagggacagagccaggaaagctaatgaaaagcaaaaacaaaaacataygagaagaaacatgagaacrgggtctcaggagcccaaagaagagaggakttcaraggaggagagggaatgggtatcaagataagtaagataaagagtgaaaggtgtgtgctggctttggaaattaggaagccatctctgaccttggcaaaggccattccaatgacatgttgggaatgggagctgctaccaagggttgggagggaactggggggaggcaagccagtgaatgcggatcacctttctgggaagtctggctgtgaaggaaagaatggggatggttattggaggggagagcagggctccgttttctcagctgtaaaaaaaggcaaatggaaatgtatggagtagaatgtgcctctgtcattttaattagctgctatttgatatttgagacctgccatatgctaagggaagctttggtttcatgttctaatgggtttgccttccattttccatttcttatactctttctgtaacttcattctcactcaaggaagctggaaattggacatttcctgaagtattcaaaggccgagctcaagtgaggtcatctcacgatcaatcacattttgacatgtcttcgctggttccgcggttaattttttcaagacatgaaattggaatttggttcctaaagacactktaaactttcagtgtcaccttacatttctgtagtagtgttaagtttctagcgtattttacagccatcgtttcatctcattctcacaatgacccttagagggagggaatgcagataagtttatccctgcattatagacaacaaccaatgaacaaaaaagtgcaagctctccaacacacacaaggtcacctcctttcctgtccctctactctttccactaaattatcagtggcagtgatggcttgattcttgatttggaaaggacattctaacatcccattcagaaagaaagagacagagaacttgacagtaattttacctaaatcagccgaatcgacttgaccagcaatctggcattggatgcagcatcaatttccccaagtggatctaagccttgggtgctcactaaaatcaccrgggagtattttttttttttttaagaaatctgcatggrcctgcctcaaaccatttaaattaactctcaacaactggaggttgaacactgttatttgtaaaagtttctgggtgattctaaaatgcagctagggtgagaaccagtatacatagtaagtcaatgacgtggtgaacaccaaattagacagggggtcctttctctttgggggtgtatatgatggaagctcctgccacctatgtagccagggccaaaacacaggggttgtccttaacaccttgaatccacgggcaagtccaacaaactttcccttcaaagtacgtctccagtccaatcgcttctggtgctgtccgtggtcagagtgtggacgcctccctctccttcctggacagttgcactggattccccatggctctcctcatttccattcagggccctacactgcagtctgggcacagctgtcagaggtcactgttaaaactcacttgcacgtcctgctccaagcccccaggaaccttctcatggctgttctaccttgtcagggccctgctcacctctctacacgctccctctttggctccctctgtcgctgtttcctcggcctggatgctcttccccagaactccacatggcaggctcacccttcatgtcatttaggtcaccttcagatgtcacctccacagagaggcctttcctgaccaccctcagggcagagatgcagctccagcaccaggtgcatggcaggcacataatccagatttgggaatgagtcactgaacccccaggaacttgttaccactttttagcccaaagtgctttgagacaaagcacagcggggcaggtgaccaggctgcctgaggtcacaggggtggccccatgctatggcaccataggatgaagaagaatgcacatgaggagagaatggagggacagtcagagccccggagccatggcgtggggctgtggttagtgcctctgggtcacagagcgacgtgcctttcatgccaagcctagagtttgtcttcacactctaggatgcggatgtgaggaatgcctctgaggttttcaaggaaaatcatgatgagttagatcttcattttaggaaaacagttgtggaaatctgtccggaagaaagccagaaaggatgtgacttggaatttgaggccccctttctttaggttcccatggcattcccagccagaaattgctggccaaacttccagatctggcttactggacttgccatggccatcagataaaatgtttaagagttagggatttctggcagggcacagtggttcagcctataatcccagcacttggggagatcgagacaggaggattgcttgagcccaggagtttgagaccagcttaggtgacaaaggaggcctgtctcctaccccctccccaccccctcatctctaccaaaataaataaataaataataatacgaagaaatcaaaaagctaggcatttctgtataaataaggaatgtgtttcatggttgtgaacactgcatgtcacctctggggaaaaagagtcacaaaaaattaatgttatgatttggtaagtcatataaaatcagaatatttaccagagaaagaaggtcacagtttatgtcgctatctcagggtgaatgtctgtttcctacaggctactacttccacagtgagttcacacatgggaggagccctgtgggaaatcttggcccctgttgctcccgcatcactccaagtctgtcttattttccatgctctagacacacctgcctcctccctgctcctccagcctcttacactctggctcttctcatggctggctctttagaacttattgaawaaactatctttccttcttagaaagggctttcctggccaaactatcaaaatccatcttccctgctggcccctagaatactttgttgtttttttcttaacacttatcacaatgtgaatttatttaattatgtttcccttactgcaacgtaagttgcaggtggcagaaagcgtgtctgccttctgcattggctgtatgcctagcacctggcacataataggtgcttagttaaaaactggctgaacagaaagaggcaaggagtgagaagcaaatctaaaagtctatattctgaggcacagcaggcaccgttgttctgcaaaaatattcttcatgtgagtatgttttgtatactgaagatatactgcatgattcagttcaaaatgaaaatcttgacttactggtaatgaggacagatacacacatacacacctttggccagaatgcctattcccacagcatgtatacacgtcttccccatggggaattcctgcaaacaggtacacacacgtaacagacattgacatgcaccactcctcacacaagctttcggggttacccaccaaatatgagtacatattgtaattttatggccatacactgatgccataaactatatgttgagatgagcccactggcattacaacaaaatgctgttcccaacttacctaagtcatcatgcccctacataacgtcactaacctggaattctttagtgcagtagrtgtatgcctgtcacccacagggctctcattctggagacagaaacccagaagagttgggacagctacctaataatcatggttcttcctagtcttctaaragatgatgcttgtgacccacaagcaccaggtggtaagcttggccagcagtagatgtgccagtccctcctccaacatgccttgtgatgtctgccaggtggctggagggtaggaaggaggaagctgggggtcacaaaccagagaaggcctgagctggtccaccccagcggcaggcccatagccctcagcagcttgtccctccgattccctccagggaaggttgtcagaaacaagacaggacacattcagttaaatgtgcatttcagataagcaacaaatacttaaaaaaaaaaaaagtatgtcccaaatattgcacgagacatatttacactaaaattaaatacattgtttatttgaaatccaaatttaaccaggcattctgtacttctaacttgctaaatctggcaactctaaccccagggaaagtctacataatggctcccaacatccaagaaactttagattattccatatttttctattattcatgtatatcaatattttaaatcaacttctttataacgaaagcccactcctcttttactgtatctattatgttgtttttaattttgctgaccaatagcatgatggaattttctttaatatcttaagtttttcttccagaaaatatcaacaccactatacttgacttgtaccttgtatattcaatttgcaacaatgtctgtgaaacaacaaagttagaaaaaatgtgcacatttggcatttgggccttttaatcaaaccaccaacctttctaaaagctcagtttccaaggtaagctccctagatggaaatcaccttatcattactcatataaaggtggcccactgcaaccattccaggaagtgacagaggatgttcacaatctcaactgctcttcaaaaaatctgctattatgaaaaatgatctaaaaatagttctatataatgcaaggaccaagccatctgtatgatctcttcaaagagctcatatttccatagatttttatcactttccaactgttcctacaagcactgaaatttaagaaagtcatgtcagtttagcagataaaacgcaccaagatattaaatttaatcactattatttcaattattttatattattcttttacatcataaaaggctcaaatcaaacatgtcaaagtaaataaagtttagattgcattaaaactcatgacaaatgggtttttaagttgcataaatatatttctagcaataatcaattcgaggaaatcaatgttaattaaatagacataaatatagaaaaatgcccatcattcattcagttaaactgaacatggaagttgtatatctgggactgtaacccctggtttttgttcaaaaactaattttcagtagatgcaaataatgttggatccctcatcagcactgtcacatcaaaattggtttgcatatttttggcttaagaataaagcttccattctctaaggatagagttagcattaaagtgagtagagacaacccttgaatgagagaataccaaagcagctaatgtgatttaaaagcttcggcagtctcaaagctgagaaaaggagaggaactcaccttggagtcgaagctcttcactgggatccagaggtccccactccsaacagaggcactgacaacttcatcagctcttccttggttccataagctcacccctgaatcaaaaggaaaacagccctatatttcactctagtcaggaagagtttggcatcagaagcttattacataaatgacacagtgaaaatatttggaagttaaataagcccagggaaacactagaacccattaagtcatgaaaagtgttaaaactgctgaattctctgtcaatctaaccatgaaaattttgtaacttaaagaaaacaraagttaattaatttgttccttcaagacctgtaacatgtgctggggtattatcatagacaagatatataattcagtccttcaacaagcaacaaaaatgcaaaagtgacttttttgaaatgatgaattgatactttatttaggatctgctctgtattaaaagtcacatggctttagctgtattaagactaaatccatttatttaagtcccagtgaatctgttaaacataatgccaattctcctctctgcacttatggagtctaattttatatgctttagtaagtgattctatagacaaaattaattttccagttcagactgactagactggtttatgttttaaaaaaatcaagtcattcaataaactattatatgatcttgtttcttggggtcctgtctgttgaaccagttaatataccaacacaggttcaatttagacccatttccataaacaatcctcacggaaagtataacatttttctcttctggagggtgtatcactttctcaacaaatacgctaatttctctggacttgctctcctatgaggtcatgctcctgctatttggttygaccacagtatatccctcaaggtgaaggatgggaccagattccctcacatgttattcccatttcttcaagcaggactcataattttcagacctgagtcataatagcacagttttaagttactaaagagttcacatttattgggcacaaatggtattgaaattttaatcctagacattttacagttccccaaatacttttaaatccacaccattttatcatgctcaatgtggaagtctgcagttatattcaggttaccaaaggattmctactcccgtagtcmctgtctgaaacagcctctgagaaattctcaagctggtcacagagtgtttaaaactctcaggtgytgaggaccaagaggacaaggaacaggaatgaactgaaagtccgaaatacagccaatgggagagggctgagctgcaaccctcgaccgcatggggaaggaaggagggaggggactatgggcccaggacgtgtggtcttcagggtgtggatgggctgagtcttcagggatgaacctgcattcaagcgagaagggttctggcagagcaagtggaggtgctggctctgatggtgatatctgtgacacccgtgaacggctgcttggaggtgaaaagagtcgactctctgaatgggaagcatcagaagtccttctcctggctgcaagggtgcaaccactggcagcatggagatcttgagtaagtgtgtctccctcctcctgtcgcttgagcccatgccttccatgtgctcaaaggcagaatagcccaggctttggaggaagacgcaccctgcagcagcaccagctctaccacacatcagctgcggggccacgggccagttgtgtcccacgtgtttactcaccactcaccaagtattcaactgtctacctggtgacaggcactcttgtcagtgactctagatctgatgccttctattcaaaaagcccattctttcttcttcaagccagcagccccaaagtgagccagctccctccgtctatactgctgagaccctcatctcttgaacacagcttcatcccagaaggcttgcctctctctccrtcctgtgcatttcasagagggaygtagagaaaactgccctcaggacttgcattcttgtactgggagagaaaaacratgaaaagaagaccatttcagagagccagaagtgctgtgaaacagmaggaccacagcaactctgctaaaactgcaaccttcttgtcaatcaaacattatttcaaagtaaaaaaaaattaagaagaaaaacagggtgacagcagaatggctggggatggtatttctgaaggacaggccaggaaagccccccttttttgttggggatggtgagcttataagctgagagctgatgatgagaagcctccagctgcacatatagccacgaggatcgacagcagtaaagggagcgcaagactttccttttccgtaaaatgaggcagagcgtggtgagcccgagggaaatcacatgatgtgtgagggacgcatcggccggtttcaacggcactgttctcgaagctttgccaagaccagggtctcttgctcaggaccccacgggattcacacgttggaatgcagagaaacaaagtgagttctgatccagctatacagctcctgcagaggccgactacagagtgcaattaactgaacttataagacagctgtcatgttattggaattggattaaggcagctttaaaatactagcagttatggggtgaaaactggagatccatctgaactttcccttcacctgctgaaaaaccacaccacgccgagagttaccacgggcattggcgtagtctttggaaagtcagctaaaactgtcaaagcgatcgcgagcattttaaaatatcctccacataaacgaaccagtttaattataaggtactcctggcagcgctgagtttccaacacaagtgaattgttaaactgaataaccacaaatcaatcctattgccaaggatgtgttaaactgggcagagaaagagttccaaaactagaatcctgtgtcactcccaacccaaccccagtaatggggaggatgggatggtttccatgggtattccagccacactaccaaaaggcctggaaggttttcacccaggcctcagatgcctggaggaagaatctttgcacttaatagacttcccttgagaagctgtatgtgtgaggaggaaggagatgatgcgtgaaatccgggtcttctagtcgaactgtttgcaggtgctcctgcagggaggggtgtaggggaggcagcaactccacaccttgactttggggaagttcaggaggtgttggtggggcctcctgttagataatcagggtgaggctacagaaaccaagtgtaaagaacatcctccatcctctggactgtttcttccaaggctcttagtggctgagaaagacacagttatttagtttcctgaaggcaaaatattccaaccactgaaacatttcctgtttcacctacatattccagtatctcaatccaaaaggagccctttttggcaaatatgttttccttgaagaggctttatttccaaatattcgaaggagaatttagaagcaggctgtggcagcccttgtagaatgtggtgcaacctttttgagaaattgagtgactgcacaatttgctgagtacggtatgtattatctatgtacatggataatcaagccatctctcagctttttcattggctgcacaacagcccctcagcaatatctgtagtcagaagaccgtttcttatgagcttttcttatgtatttatacactggtatttcttttagatgatgcaaataaaaattttatttcactgcacggatagacagaataaattatacacagctgtgaggtatcagaatatattttatggagtgatcttattgataaattataaacacgggacctgaatgatggatacattcaagcctgagaaacccggggaaaaaatatgaccctataaaatacacagtttgcatatattttatttttcataatatatatttgggcatcaacagaactcatagttacctaaataagaaatgtggatagattatactgggcaggaagcttttttgccactgcgtaacctgatacactgcttgcagttttgataaaatggccagtttgcttcagcctcagagtggaaaaacacatattagatcgttcatctctgacagttatctgctgtgatcatcagttgtgctttcccatgggaagtgtgtgcctgctttgcttgtctccttgtctgagtttgtcattttcagatctgattcaggctagtcaagattgcaatgaaagtttttaaggttatgggaaagcaggcaaagaagaaacctctcaaagtgactccagatcctcccctcatgtcacccagagcctggctgcctgcatgagtcctgccccatccttgctctagccaaccttcctttggtaacttatgaagggaaacaggaaaggctataaccaagtccacaccaccctgatgcctacatccgcgcaagctccatttcacaagaggtggagactgatgcagcagctctaagacatacacagtgaagaggggacatcttggagccataagacctgaccctggtcctgactcctcctcgatttattttcctttgtcaaagcctgacatctgaggctctaccgtctacaaaatgaaaactgcattctctcctctaagattctcatgaggttaagggagctcaaataagtcaacacagtaaagcgctttcgaaaagcttaatgcatgaaatccatcttagatatcagaatccaagtttctagactttgaggcagtgtctgtttaaccaaaccacactattggtgcaaaaatcacaactccatattgatcatttgaaaatgccagtgtataagtggatgccagtgggcatcctcctaagccacccagtgggccattgagaaaataaactctgatgagatcattagtcaagagaaacttaaatatcacacctggagttctggcttgaaagggaaatcattatcaacacctacatgaactttaaaatggagaatcaatctgaggtgcaaaaagtagaattaagataaacatccttttgaaaaatctaagtgaaagcaaaaagttggggcagccatttgccaagaagccagggacaaggcttcggaaactgatgaagcaatttttttagcccctaaatatccgagacctaaaggaaatcttacagaactgagcagctccttgtctcagggcaatatggtggtgatgctcctataaatgatagcaagatttcctttcagattcacattttcaatcttaaccaaataatgatgtagttctttcattttagctgcacgctccctacatgtaaattagtaatgcaattttaaaataacgtaagtgaaggatccacaaaagaaccaatagcaaaagttaagctgaaaaaagtaactttataatagagaaacctgacaaaccctgctttagccagatggtcaaggtcaacatcaacagagataagtcctgtggatggtacgacccttgacgtgatgtgatgacagtcccacttccatctgtgatcttccacttcaaaacccacagcccccgtctaatcatgagataaattcccaaagaggtacgctctaaaatataccaaccagtaatcgtcaaaactgtcaacatcataaaaaacaaggacagtctgaggtactgtcacagacaagatgaacctaaggagacaggacaactaaatgtaatgtatcctggatgggactgagcaacagaaaaaatgcactcagtaagaaccaatgaataaagtataaacctaatttaaaatactatgcaaatattggtttactaactgtaacaaatgtacaatactaaggtaagatgttaagaataggggaaatgggatgtggagtgtctggaaaccatctgttctagctttgcaatttttctgtcactctaaaatcgttctaaaaatgaagtctactaagaataatttttaaaatttaatctgaattttacaagaataatcatgtcattctggagcagttcagtacatatcaaaaggctcagggatgactggttatcactgggggctccaaataccagaaagatggcatgtttgccattcactgctcttctgacattgctatttactcagacggaagatgcagtacctgcaggcaagctaaaaccttgtcactgacaaggattcctagagtagaaaaaggcagaggatgtgaaaataattgattctcaagcagcttaaagggccttctgagtactctccagcatactctagaaaacacagaaacggcaagttgaaataaaaacttaagattttttgcatcattggctacaagggtctgggatggcagaaaagttaaagggagaaactgccactaggtttgggaaggtgacaccaagtgacacacacacaaacacattgacaaaaccacgtcaatacagaatatagcttctctcagagcctaagattgtagctaccacgctggcaggctgaattacgaagatgtaggcaggtgtaagagaagcagcataatattttgagtcagaagacgcatcctgcatccaccacacgctctcaatgaccctgggcaagttgcttgcattccttgctattcagatccttggtgagtggagctgggctatggaacaacatccgccacagagggccggcaagaggatcaaatgagatcatagatgcaaacatgtacatggtgtattactcaggttttccagaaccaacagaatatgtgtatataaaacagggagtttattaggaagaactggctcacacaattacaaggcgacgtcccaggacaggccgtctgcaagctgggaaagacagaggctggtagtggctctgtcaaagcccgaaagcctcaaaaccagggaagccaacagtgcagccttcagtctgcagccaaaggttgggaagccactgatgtaagtcccacagtctgaagtcttcagtccctgaagtctgatgtcccagggcaggaggaatgggaagaaggaagagagccagaagactcagcaagcaagcttatcccaccttcctcttcctgctttgaagtcactggtgcaagtcccagagtccaaaggtcaaagaacctggagtctgatgtccaagggcaggaggagtgggaggaagcattcagcacagaaaaagaaggaaatcagaagcctcagcaagccagatcatcccaccttcctccacctgctttgttccagctgtgctggcagcacatgggatgctgcccatccagcctgggaaagggcgggtcttcctcttccagtccaactcaaatgccaatctcctctggcaacaccctcccagacacacccagaaacaatactttatcagccatgtaggcaaccctccatccagtcaagctgacacctaatattaaccatcacacatggatctcatttggtttaggttgttttttttgtttactccttatcagtcattggaaagaaatacaccaaaatgctcttgctggctttctttgagtgctggggctatgaattcattatgattttcttctttatgtttgtatgtatttctggcttttctataactggcacattattacttttatgatgaaaaaataaacttaaaaagatcctttggacttatgatgacaaaacaacaattcttctggcaccacagatacacagccttgggcgtgttagaggacagagccatttggaaataaaagcaatcaagtgctatggaacaattacaatttggaaaagatgttttatgtgtcattttgaaattcaaagaaagctagttatagcttctcataaatgtctaaatagattcataccccaagcacgagctgtctctactacacataaacataactgtccatgcctatggtgcctcccagctgtggggagcaaagtcacttacaacagtaacttacattttttttttttttttttttttttgagacggagtctcgctctgtcgcccaggctggagtgcagtggcgggatctcggctcactgcaagctccgcctcccgggttcccgccattctcctgcctcagcctcccaagtagctgggactacaggcgcccgccactacgcccggctaattttttgtatttttagtagagacggggtttcaccgttttagccgggatggtctcgatctcctgacct

SEQ ID NO: 17615 - DNA, 52192 bp, Homo sapiens
gtggggacggagacgggcaaaaccaggaggaagagagctcccccgacccggcagtgttcccggctcaggcgcttggaagggctcctgagcatggagggctgcgggaggccagggagataagggctcgagggagggcgcttgggtggggtaagagctgtagcagctctgcccactggttcctagagccagctcaggggagcaggcagctcggccctgggtcccacaacatgtgcagcccagggaagagaaggctctgctttccaggtgtggagccgaacagagatcatcgctccaccctaaagcagtgtggctggaggagtgaaatactctagaggcttgagctccaggtcacagtgcctttgggtgaccttccgctggtcatgtgtttcctcaaggatccgtttcctcacctgtgtggcaggatagtttattgagtcatgaatatctgttcttatccaccctataaccctcccctcttgccactttccaagcggctctccacgttgcaagcaaaaagccgccgaaagtcatctttgagatgagagtgagtatcttagactggaagcatctcctgccagcccggagatgacagaatgtcctgcaggccactcccttggaagcacctctggaggtggtccagccccgagcttcccagcctcagattccagcacagtcttggggtgcacacgagcacacaggctccaacaagggagtcagggagtcagggcccctactatctccaggctccatctaagatgcctggattttggtggggggtggaagtggaggaagacagacccagtaactgggatggaattcactgccacctacccgtgtgacattggcttaaattaaattaaacagatctaaggcagacaccaagatgctctttctggtggggccgagtttatagacaggactcctaacccttctgcttgttaaccggcataataatatccccattggaaaatggaagtgtgctttgcaaacggtcaagtgtcaaacaaacaagaggcgtgctctggactcctccatcccgggtcccatgggaagggggtgcacagaggagggccggctcacgatgttcccctctagatggcaacagacagcccgtgaggcactgtaggaacagcacagggcagaacagcccgtccgggacacccacctccccacccccggctcacactggccaaagatccagactgacaaatgactcagacacacaaacgcccggggctaagaggaaacacggcatggcccggaggttgcagggggcagcactcacagggatggggctttctgctatgcctacccctccacccagccatgatcagtggcctgaaatggtgtcatggaccccctcccatgtttgagcacttgctgtataccaaattcttacagatatgtttgtactcttaaatggttatgaagatcctgtcttcataggacgaaaccagggattctaggggtcaattactgttgatgtcaccatccttcattattattagataatctggccaaactcatacactaatcaacatcagtccccatcacaaccacaacaacgactgctgacccttccgaacccactcccagcctggggggttgcagaagcaccgagttccagaatttcagcctccctcccacaacgtccaacgcaccccctcgaagcacagcctgtccttcttttgagctggctctgtgtgatgaagggacacccagcaaatggcccagacccatgggcattcgatctattttcggttgcagtccctttacctctgacacctgtgcctgcgccagaccccttcctttcctggccggccatccgaggggtccctggtggcctctgggaagagaggaactgcagaagtccctttcattttccagctgaggtgctggctctgggccgatgctgccgggcaccccacaggaggtagccgccctctctggctcagtcaccagcacgagggcagggccactcctttggggctgcttgtcacgggtgccctttgccagcctccaaggacatccttccttctctgtccctctcccctgtcctcaagccccgtcccattttgaacctctgcatagcaggattcagattcccttccaagcgcatcagaactaaggctagctctggctgggcatggtggttcacgcctgtaatcccagcacttagggaagtcgaggcgggaggatcacctgaggtcaggagttcaagatcagcctggccaaaacggagaaaccccgtctctactaaaaatacaaaaattagccaggcgtggtggcgcgtgcctgtaatcccagctactcaggaggctgaggcaggagaattgcttgaacccgggaggcggaggttgcagtgagccaagatcgtgccactgcactccagcctgggtgacagagaaagactccctctcaaaaaagaaaacaaaccaccaaaaaagaactaaggctagctcatctcaccagtcctttatgatctaaaccagtgctgtccccggtggcagctgctggccacatgtggctaatggagcacttgaaatgtgacaagtccagattgagacgtaccctcgatgcaaaatacacaccagttttaagacctggtacaaaaaagaatgcaagatatctcaataacttttattttgattggatgttgaaaggattatactttagatatgttgtgttaaatatattactaagaatagttttacttatgttttcttttatttcatatggctactagtaaatttaagatcataggaggggctggatgcggtagctcacacctgtaatcccagcattttgggaggccgaggcgggcggatcacctgagctcaggagtttgagaccagcctggccaacatggtgaaatccggtctttactaaaaatacaaaaattagctggcagtggtggcggatgcctgtaatcccagctactcgggggctgaggcaggagaattgcttgaacctgggaggcagaaattttagtgagcggagatcacgccactgcactccagcctgggtgacagaacgagactccgtctcaaaaaaaaaatctgaactttgtctggatagcgacggagggtgtctgagcaaagcacgatgttctcagagccatccagagactgggaactctgtcctaccaaaatgggtgcacccagaggagctggaagatagagatgccctgtgggtgactcatctggttgccccttggtggcactgagccaggcaacaagcgggaaaggcttgtcaatgataacggcaagaccaacgatcaccaggcagccaggtgcacccggtagccctctgtgggcaattctgcatgtatgaccttatttagtcatacagctaggcaaggaggtgacactaagcatttgagtactgatggggtcttgaatgaacaagtaaatgaatgaatgaatggatggtggccgatgactgtcatctctagttcttacattatgtatcttatgcatcagactacacggcatggatattcagtgcaatggatttgattgtgaattgaggcccccttttgcaatcttgttgcatgttatgttcgtggagctcctgcaatgagcagaggctgctaagcagaagcagcgcacaggctgggggcaggacacagggcccccggcctcaggggagaggtctgttccagccacctcaagtctattcctgtgagtgcccctccacacccctcctggatccccccactgcaaactctctccccctggctccggactctctccccgtcctggaattaataaagactctgtgcagactgcggtttgcaagtctgaaagctggttcctgcccgygtcactgcctcgagaagagagggstccagctccccacagtagcccctgccttcctccttcccaggcaggcggaggcacgcagatataccattgacttcccctcccctgcagcaggcacatcctgggcatcgagcttcagaccctgcccctgagcagcccctaaccccaccaacaaagggtggcttgggggggctttcaccccagcataatctccatcagctaccctcaaagcacccccaaataaacacacaccgtaagtaagagctgtacactggctgtgtgcgtacatcttcaagacaattctcccagcatgcccctaccttccaaaattccagagctgctccctccaaagacccagggaaaaggaagggtttgtccagggtcctggggtggccccgtatagaccaaagcctgataactgtcctagaagcagagtacttgcagagcgagtgacggcaactgtggtattgacaccagtcctagcaccagctgaacacagagcatttttgatctagcagaaatacaagaccacgttgtatttgtctttgcaataatctcttagctaggaatactgatcacctgtagacagataaggaaactgatgctctgtggagaggttttcctaccagaaaggctagagccagaaatttacttctaggtccaccaatacctgcctttgaccaatgcctgcatttgacctttccacgctgagccacccctgctggcactccagactgccacagtgctcctgcctccacaaggggtctttaactcatccctcggagccatcgtggtgcagggaaaagcccacagggcgtgtggcttccatgctgttccctgactggctgtgacctaggacaaggaacaagtttccctctcctattctctaggtctcacatttcttctcctctagcagtagtgggaagtgaggggtgggggacacgaccctcccctgttccatcccacactccaacccccaaaatcccccagggtccccgtccagctcagtcctgggggcagaaatgcagagttctccaggaacgtggtcccagctgtttcagtgcaggccgccccctcctggccaccagcggaatgtcagccttcccagaggggccgggagaacagcagtcgagaagctcccagactggtgtgggcgctagctgtgctcagcgtggggatgggaggtgacccagtgataatgggaagctgggctgcctgtcagtctgcggggggctcccacctccctgttcccccacagggcacctggggatccagcctgatttttaccagaccctgcggcctgcatggggctgggtatagggctgtgaccttgacccatgcagaatagaaccctgtgtgtcgggatcctccatgtgctccagatgcccctggggacagcaccaacatggccttaactcccaagccattcccctgcctctaaccccctggcatctgcaggcatccaccccagacccacccaacacctcctccccagcttcaggcgctaggcagagaccttggcccctgcagaatgcagccctgtccagggtcccctaccttccccccagatccctcccagagcaataccaacccgggcctaccttccaggccattcaacctgcagccccccggcctctgtagacatcgcaccccccaaacccccagacctgcccaatgcctcccctccccagctttgggcagaacctgtctctagccagacctgggggtgttggggagtctggagggccggggtgggggctgaggcgcgggacagctggcccgtatcctcacactgggcccggggcccagccggaggggcgggggcctggccactcgggccttggctggggctgggatttttggcctggccgccaggccctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggtaaggacccctcgcccctgtccccagcgctgcccacagctgcgggccctttgggccaggtgactagacgctcaagggggagaccttcgtccctgggaactgcaaggggtcccaggtgggagcccctcagccactgggtcctcggaactgcccctcccaggagccagccccgtgcccaggaggaacctgtcaaagagacaccctcgactcagaatagtcccagcccagcatccaggctttgctgccctgcgagggctgagggggcccctgctcaggtgcccgggtgcccgccctgtagggggatcagagcatcctgggggagggcccagcgggaacccctgggtctggagacaccacagtctgcacacctgtggacacagctggggtgcacaccagccctggggacagggaacctgggcttgataccagctcaaccgcagtgagctgtgtgacctcagcaggttccttgacccctgggaagccgggatccccccgtcaggaaggtcagggctccgctgaggatgggtttgcaggttgggaagctgctgctgtgttctccctgctgaggcaggcagggactcctggtatgcatttgtgtgtgtgtgtgtgtgtgcatgcacacaggaatgagcgtgctgtgtgctcgtgtgtgtatgtgtgcatgcacaggtgtgcatgtgtkcagatgcccggctgtgtcactgaacagggaaagggatttctggaggggtacatatgtctgctcacaggttcatccttaggcaggtgtatgcgtatgtttggaggaggtatatgaagctgctccttagtgtgtgcaaaagtctgccacctgacagacatgtagacatgtacacatgtagacatgggcgatctggcatccaggtgtgacactggtgtggactgtcactgtgtgtgttatggagtgtgtacatctgtgtgtgtgaatgtgtgtgcgatgtggcacgcaagcatggaaaggcgggctggagaaggtgtctgtctcctggcagaggcagtgtggctgagacagaggctggagtggatcctggggcactgctgggccatctgctatgtgccccaacccaggcacagttggttatggggtttgagggtgtgccctgtggggctgctatgccgcggccaacgggggaggacagaagaggctcccgggcatgggaaaaaggagggcatttggtaggggggtctgggtggagtctggtttcctcgggagtcctccttgccatgagaaccaaacgctgagtggggggcgggagggccacggggtggagtcaagggcctgggcaggagctgcagctgtttccgtgagattgaacagcttcctgtgcagggtccgctgctggacctggatgaggccaagggacatgggtacccacaggcgggccccagcaggggcaacgagccagggcctgaaagcagcagccccgggtccgtctcagcctcctccccaggtgtagcccccaaacacccagccacccttcttcccagatggggccaccacctatagggtggcagttcatcatcaaggaaccttgagaattagaaattattatcatcacttgacaaacaaggaagctgaggctccggcaggctaaggcagtccccgggggttagtatcagccagctctctgccccaggtcaaggggcaagggggttaggagtgagctagcaggcaacatttggggaggggaaggcttggggctgagtccttaaagcaggcatgccctaggcagaatcagctctctccttgtgtcctcagtgacaccgctaaacgcccagctggcctcacactttgcagagatcaatctcagctctgtcccaggtggctggacttgctaggtccaaataaggggtgtgtgaactgatgagctcgtgtggggttttgcacagaagtgctactgaagtctgcagaggtcggggagccaacacagggagtggagcgctcagtcacatgctcactgccactcacctggctgtcctgggggagcctggcttctccctcaaggaggagggtgtcacttatgcaagttcagcggctccaaggaaggaaccctgttgcgggggtgggggagcaggaggaggggacaagccgcacagctcccaggctgtttcaaaagtgagcatgagaaattaacccagggataattcttccccatcccccagaaatagtatcagggattttttttttttttttttcctgatttcagaactgaagatggtttggaacagaggtttccttttcttttattttccttttttatttttatttttttaccttttttattttttttaaattgagacagggtctcgctgtgttgtccaggctggtctgaattcctgggctcaagtgatcctcccacctccgcctcccaaagtgcttggattacaggcatgagccactgcctctttttaaatatttttttaattattgttttccgtccttaagtaggaacaggggttttcaacctggctatctattagacttcccacccaagaayccctgcttgctttggttggagagggacctggacacagacttttcaggcttcccaggtgacggtggggtcgccagggccaagaagcactggtttagaggtcgatcccgctctgtgtgtctgccgaggccccggcatgagggcaaatgtgccctgtgtgggaggggacacagtcacccagtggaggacagcttgtttttgaaaacccttggcagccttctgcatgcaaacaacaaacagcttcgtgtggtcttatctgctccccaagccagccccctggactttggtttggcaaagccccctgccaagatcggctggccccaggctcgctcccaaacaggctgcttccagctctttgaacctggagcccagggcccaggcaaatggccctacatgtgacttggggtcagctgggggtcccagaccaggctcttcagctcactggttctccatttccctggctgcaaaatggggagaaacagccctgcctgaagtacctcctagggccagtgagagcttctagcaatgtaatatctggggggaaaaaaagcatcaaataaaaggaccgtgggaatgggcatttttaaaataatctattctcttattcagagtctgctaatttgggctcatggatccttgtaattagtgcacattgctaaggtttaatactccctctcrctacttacaccatgttttgtctagtggaggggcagctaatgtgtaaatagatgtgcaatgatgaaagaagcagacaggactcggttgggggtggccagaakgagccttgagaaatccaggaaggcttcccagcagaagtgacatttgagttaracctaaagagaaaagtaaatggggccaggtgcagtgactcatgcctgtaatcctagcactttgggaggcccacatgggcagattgcttgagcccaggagtttgagaccagcctgggcaacataggaaggcccccgtctctatttaaaaaataaatgaatatttaaaaagaaagaaaaagaaagaaagagagagagagagagagaaaggagagagagagagacagaaagaaagaaaggaaggaaggaaagaaggaaggaaggaaggaaggaaggaaggaaggaaggaaggaaggaaggaaggaaggaaggaaaatgttggaggacctgtctgtggatgaggggtaagtccccagactacaggccctggcaggcagaactgaagagacagaagagcagattctcgattggaggaagccctgtctgcagttagtgctgacagcatttggaggtggtgattttcccatcatgggaggtatgcaagcagaacacgaaggatgtttgtggaaggaggtccagcccaggccagaagactattatgatccctgagagtctaggatcgtgattctaagatgcaagagacaagttccaccctgggctagtcggtgaaacatgccaaaaccacataaaacaagacaagtgttctccaggccaactgcttagggccagctgagcagcacagtcagggagagccgtgggctcgggaaaggcaggcgggagagtctgagctcagccctggtgcgggggtaggacttggacagaggcaaggacattcctggcaggagaaacggcttgtgccaaggagtggagggagaagtgaggatgccccacggggcctggggaagcagctgttaccttttcaaagtcctttccaatttccagctgctgtcattttattctcacctctctcacttgcagagaggcaggaatccttcgtagcccctaaaccttctccatttcctcattgcaaagtggggattaaaacctcgggctccccaggccgtcaggttcaggcatgaagtttggcaaatgccaccatcatcagggtctgaacggtgggggtggagagtggggacagaggagatctgggggaggggaagctaagtcttccccccagaaagtgcctggggtgcaggagggcagaaccccaggagaaaggaagtcagggttcagccaggcccaggggctcaacaagcccaaggcagggggactcccagggcagatggggatgaaacaggttagagctggattcacagacaaccaccctgccacccctctacttaattcacccatcatgtattgagtaactactgcatacctggccctgggccacggactgtgcagtgaaatgggaaaaaatgaaacgtaagtgccactgtctttttatttttgagcaattactgtctgccaggtccagaagaggacatagcctattacttgaacccttttacaacttgcagcaaccttgcaaccttgcagcaaccttgcaaccttgcaacaaccaagtgattatctgccccatgtcacaaaaaaggaaaccgatgttcagagaggttgagtgactttcccaaggtcrcacagatggtaagaagcagcgaaggcagaattagaagccagaggggtctgttctgagcactttgctcttccccccacctccaccacactgttccctgcagtctgctctggagccagagagtagagaggaagggagagaggcacgtgaagaaygagggagagggggagaaagaggaggaaggagagaggccgaggcagagaaagacgcataagagactgttgagagctggaggccggagccagggaaggcatcagaggcccgaggcgggccatgtgtgtgcttggcagcggatgacagggcccaagtgctccttctcagcaggcccagcccccctggggccaccactccgagccttgaggttctgaccagattacttgcacacttcaggcctggactgcagtgcctgaggagccacaagccctgggagggggtggcgccggggtcttggctccggtggctgtgacagctccacagccctgaccctgctgggctgcagctgaggctgacagggccctggggccagcaagcccagctgtgcagcgtcgccaggcctcagaggccagacgtctggccgcgaggcctccctggacacattgcagagacacccgttcccccagccccgcccatgccccacggggctcccggcccctttcagcaaaagcagtaagggagggctgggctggggcgttggcaaggtggcttgtcaagctcagaggggggccttctgaggtggaggcagggcccccggtttgggaccctgtctgttgccatggcgatggctcaggcagggtctggatccagcatcacagygttccccagtgagagcttcactggtccatggggactgaactcgtgatcctgtctggccggtgaattcgcttttccttaggaaactattcactgtgctcattcatggcgtccccctgcggccccggcgcctcctaagacagcccgtgtcagacggccagagccccacccaagctcggctgcccagtggctgaggacgctgacctcacgccgtcctatcagtgtgggaatggctgcatttgtgctggcagctgcacctccttaatgctcgctgtagcagcccagcctgcccttcccaaagctctggcctctacccggcagctcagctcgggaagggagtgggctgcctggtgagaggtgctcagacccagtgtcttccaccccaggccctctccctgactccagggagaaccaggtaacacagcaagaacaatcatactctaaggactggcagcagggcgcaggggcctgtcatcctagcactttaggaggccaaggcaggaggatcgcttccaggagttccagaccagcctggggaacatactgacaccccatctttacaaaaaaatcaattagccagatgtggaggtgcacgcctgtagtcccagctacttgggagactgaggcaggagaatcgcttgaacctaggaggcagaagttgcagtgagctgagatcttgctactgcactccagcctgggtgacagagcaagactctgtctcaaaaataaagcactggcctgagcttcaatccaggccccgtctctttccagctgtgtggccccaggcatgtcccttaacctctctgagcctgatttcatgtcttaagatgatagtctctgggagcggtggctcacacctgtaatcccagcactttgggaggccgaggcaggcagatcacttgaggtcaggggttcaagaccagcctgcccaacatagtgaaaccctgtctccactaaaaatacagaaattagccgtgcttggtggcatgcacctgtaatcccagctactcaggaggctgaggcagcagaatcgcttgacccaggcagacggaggttgcagtgagctgagatcccaccactgcactccagcctgggtgaaaggccaagactccgtctcagtctcaaacaaaacaaaatgatgatagtaagccctgcccttccaacttcacaggccgatttcaaagagcaagaatgagaacacactttgtaaacagaaactgctctggagacaagcaatgtcattattgccatcagcattattcttgtttccatgtaattgtgggttttgccattgaaagtaatggcaaaaatcgcagttacttttgcaccagcctaatagttctggctcctggaggactgactctacctgtttcctttcaggggtccctggggccattcctggtggagttcctggaggagtcttttatccaggtaacgtacatgaaacttccacacacccaggtcatgcggatgatgctgatgtccataatagatgcacattttgacactacagaaggtaggaacattgacacrcctaccagaagtcacacccacttaaaaatgcaattaacaagacattgatttacagctattaagagcatacaggctggacatggtggcttatgcctgtaatctcaacactctgggaggcagagaaacaaggattgcttgaggccaggagtttcagaccagcctggacaacatagtgagatccccctctctacacacacacacacacacaaatttaaaattagccatgttctgcattgagaaaaatgaaaatgaagtatagaaattaaaaaaaaattagctgggcatagtggtgcacgcctgtagtcctagctactggggaggctgaggcaggaggatcacttgagcttaggagttcaaggctgcagtgagctataatagcaccactgcactgaagtctgggtgacagagtaaaaccctgtctctaaaaagaaaaggggaaaaaaagaaaagaaaaatcaaaagtaatactttcaatacttaaaaagtatttgaggccaggcacggtggctcaagcctgtaatcccagcactttgggaggctgaggcaggcggatcacaaggtcaggagatcaagaccatcctggctaacacggtgaaaccctgtctctactaaaaatacaaaaaattaaccaggtgtggtggcgagagcctctagtcccagctactcgggaggctaaggcaggagaatgatgtgattgaacccaggaggcggagcttacagtgagccgagatcgcgccactgcactccagcctgggcgacagagggagactccgtataaaaaaaaattaaaaaattaaaaaaagcatttgagtgtacagaagtgacctggaagtggggagagacgccagcactcccccagatacatactgacactggactactggccaagcagaagagaaaaccgaggcttgcagagagcaggtcttgcccaaggtcacgtagttaggcagaggtggattcagccatagctgggggtggcagcgggcttgcctggcagaagtaccgatgatctctctttctctttctctccccccacaggggctggtctcggagcccttggaggaggaggtgagctcagaaaccacacttgttcatcactgaaagggcctgggtttcacccgagccacatgcatcctcagacctgagaaccctgggagacccgagcatcaaggactccctcatttcacagacagcatccaggcggtgggaggaggcttctttgagaaccagaacccattggccttcccagtccctcccctagactttatgtctggtgccctctgccttcctatttcttcttttttttggtgggggaggacggggggacagagtctcgttctgtcgcccaggctggagtgcagtggcgtgatctcagctcactgcagcatctgcctcccaggttcaagtgatgctcctccctcagcctcccaattagcgaggactacaggcgcgtgccaccacgcccagcttatttttgtattttttctagagacagggtttcatcatgttggccaggctggtctcgaactcccaacttcaagtgatctgcctgactcggcctctcaaagtgctgggattacaggcgtgagccaccttgcccggccccttgcccggccccttcctatttctttttatcctcaaaaacctccctgccaagccggctgagcaggcaccatcttcttttttttttttttgagacaaagtcttgctcttgtcacccaggctggagtgcagtggcgcgatctcagctcactgtaacctccacctcccaggttcaggtgattctcctgcctcagcctcctgagtagctgggattacaggcacatgccaccacgcctggctaatttttgtatttttagtagagacagggtttcaccatgtttgccaggctggtctcaaactcctgacctcagatgatccgcctgcctcagcttcccaaagtgctaggattacaggcgtgagccaccacccccagcccatcatccccttttgaggctgagactctgggactcagagagtataaaccacgagttagaagtagagctaggttcccaggggctccaagtctgagcgggaggacctggggtgtgtgattccacactgcccacactttgcccgggttgggggttggataagtagtagatggataagctgggccaccccattcactatcttctcttccctctgcagcgctggggcctggaggcaaacctcttaagccaggtaagacccaaggcctcggagcattgagagacagcgagggagctggggagggaggagcctacccagctggraatgggacaaggaaactasgaacaggacaaggaagccaacgggcaggaggaaggagggaggtgtggacaccgattagcctcccaaggatgagtaggccggggccaggtcccagggcttccagraacaagaggctggaagcagctccatgtcctccctgtgtgagggcgtctagcatctaccctacatgtgcatgtgtgttcacccagctgtccagagactcctctctgcaaaggagaggctgttagaggcaacatcagggattgctccggttccagtggcctccaagccttacatgaccctcgggagctcagacacagatcctcagccccagacttcccctgagtggtcccctagcccttgaccccagaccaataccccagatcaccctgaccttgatgccattctgagcccttctcctgactccagatggagcactggtctcaagccaaagcttaaccccagcccaagccctgagcctaatcccaggctgaaccctgaccctgctgaccctggtcccacaggacccccaatcctggccttaggccaagccctgaccccaagcccaagctgagcaccgaccatggccccggataagctcccctcctaatctcaggccctttccagctgtgtccagaccacggagttttccagtaagaaggtgtggccggatctatcctggcctcgcccaaggggctgggatctgccacgagggtccactctcagctctggggaatgcacccccaggaaggaaggtggggcaggtccctccrggaaatactggcggataaggagcaggtggaggaaacagcgtctctgtccagattgatggtccctcggcatgagacgctccacatgtgactttggccgccccacaccctgagctgtgttgccctggctcagaagcccaagtctccaggacacagtttagatgtccaagagctcttatgaaatcctgatagttgataatccaagtgcaaatgaatcttcaagacccagattcccctgcgctaaaagtccatctgggttgtgaaacaccagggctggagccaggagaggcgggagaacggggtgcctggggtctacagggctctgcaaggccaggagaccctgggagcttgccacttatccccgccagcacctataccctgtcttcctggagcaggtgagggttcttagcagggtctttgacggtgaagagaggacaggggagatgatagtggtgcagaggtgtggaggtaggtctgtgcttggcctagaagacccaaattgaggaggttgtgcctgcaaagctggagggtacattcattgatcccactaggagcaagagacacatagcaggttgtggttaaacaccagaggaaagacagacaactccctacgaagttccaggatgtgtagttgcaaaagtgaagcttttgttaatgaaagatttaggttagacttctgaaagaacttccagctcagggtgaaggagtcaatccaaaggaaagtcagagcatctccttctgataaaaagggcagtgtttccaggcaaggggctggattccatgacctccccgaagactcagggctacagaagggtcggcagagcccccatggcacccccagggaggcccccacatccgggctgccaggacgtctgggcctgcccaggcaggatggaatggagcacaggcagcgcgtgtcatgcttgggaacaattaatcccttggtgacagagggtgggtggcctggcagctgcttttccacgtgggcgccaccacaggtccaagctggccctgccctgcctcagctctcagcgggggaccaggcagctggaagcctgcacacccaacaccctgagcactagccagaggccagccgcccactgagaggggcacgggcatggacaagaaggaactgggagcacccactgtgtgccctgggtaggttgcacaactaggtgctttctgcacacatgctcactggtcccagcaaggcaggtgatataatggccattttgtagatggcaaaaactaagcctcatcggagaggcaaattgacctgcttgtgctcatrgaggctgggtagcagcagcagggtctgaatctagaactctctgactctagaaagaaggaggatggagctggccaggtccctggactcccagctgtggtcagcccctccccgctttctcctcctttccagatgctagaatccttggggcatttggggcaggtgagtgcaaaggaaggagggcaggcagagacagaagtggtcaggccacakgacaggatgctcaggctgggatcatgggaaaaaggaagatggccccagagaagctgcctgccccycactgcagccccagcctcttctcacttcctgtgcagtcctcagcttcccctcccagcccctctgtggacaggaaaggtctgagcatgtcccttgccctctcagagctcaggaaacatgcctggcttgagagaagcgactgccagcgcaggtgggkctggcccgggtgctgggaagtgactcctgcctgatcgccaggcactcccgcccggaggcaaagatgcttcttacatgaggctggctgagtttcagaggggtccagctcccactagtaggaaatgagggacgaggagtggttagtaacggagaccacacccarggaaagccaggggggacctctccagggtacagcaggctccatgtttgggatccatccctggagaggactcacccctgaggctcaggactagcacttgtaggagagatcgtcacataattagaaacaaacctggcatggttgtgaactctgacctgatggcccattggtcctggccaaggcagtggaatgtctcccgcagtgggagacgaagcgattgggcccagatgtggggaggagagagccagagggacccatttggcgtctcataaacatcttagtaggaggctcctgggctgcagggcaggctggatggaaggacagatgggtagtggggacacaggagttccccgatgcaggtgaaggggaggggactgagtcaagagatatctgcaaggaagcagaagagagacctcactggcctggggtgaggtctcgctcacggactctgctctgtcccagcccttgctgaaagccctgctgaatcytgttagccagcagggcttctaggagaagcacaggcctggcccaggcttgttagggatcggtgcaatgacacctgcactgcacatagtagtcgctcactaaactactgrtggatgctattttatcaggatcgaccctgagcatcacaggcttagggaccagcctagggacctgagtggctgatcacagcactgccctaactccaggagacatttcccactctgggcctaggaacactgcctacactcctgtctctgtttcttatccacagttcccggagggcttgcgggtgctggccttggggcaggtgagtgctgacacccaagaaagatatcccctgtggggaccagcccctgagctcaacccagggctggtatgcagcacggtcatggaacaagggtgcaggccaggttccgtcctgggcactgacggggactgatgctgataccaactgccccaagcagctgcccaggacatgaggaaatcacagctgagtacctgggttcctttataacatagtagtgaaggctgcatggaggaagccccatggaccaaggaagcccaagggagtcgcttaactcagcaggggttcaggaaggcattctagaggaggtgggtggggaaatttgaccccaaaagatccatgcagttttcaggaaggctgaagtgagaggatcccttgagcccaggaggctgaggcttcagagagctatgatcatgtcactgcactccagcctgggcgacagagaaagacctcatctcttttgttgttcttgttgttgttgagacagagtcccactctgtcacccaggctggagtgcagtggctcagtctcagctccccgcacctggtgcagttgatctcagctcaccacaacctccacctccccggttcaagtgattcttgtgtctcagcctcccaaatagctggaattaccagtgtgcaccaccacgctcggctaatttttgtattcttagtagagacggggtttcaccatgttggccaggctggtctcgaactcctggcctcaagtgatccactcacctcggcctcccaaagtgctgggatgacaggctcaagccaccgtgcccagccacaagaccccatctctaaagggaaaaaaaaaaaaagagccatgcagttttgtcagagctgtctaacacattaacctcggcacacaatctagttctggtacttaggcgcggtggctcacgcctgtaatcctagcactttgggaggctgagacgggcagatggcttgagcccaggagttcgagaccagcctgggcaacatggtaaaatcttgtcactacaaaaaatacaaaaaaaaaaaaatttgccgggcacagtggcatgcacctgtagttccacctacttggaaggctgaggcgggaggattgcttgagcctgggtggttgaggctgcagtgagccaagatcgcaccactgcactccagcctgggtgacagagtgagaccttgtgtcaaaaaaaaaaaaatccattaccggtgagcagtgctcacatggatgtcctgcaggcattgatgtctggcagagagcggaagagcctccaatgtrcttcctgagtggggcacagccaggcagggccagagcgtaggagtcttcataggtgtggtagctcaggacctcaccccatcctcccctccgcagggctcggcgccttccccgcagttacctttccgggggctctggtgcctggtggagtggctgacgctgctgcagcctataaagctgctaaggctggtgagtggtgctctttgggacatgccacaagccctctggcttccgtggggccctccgctttgcaaagaaccttccctcaactcaggcttgggagccgggtgggtgggattgtcagttgcaatctactggggctcagggaggcagctagctgtgcccagtctgaaggtgagttagtaacggggccagacctcaatgctgggccctcagcatgcagccccrggcccttctgcctccccactgttccttacgcaatgcctcacctgtcctggctctgcaggcgctgggcttggtggtgtcccaggagttggtggcttaggrgtgtctgcaggtacgatggctatccccgaactccctgggtcaaagttgcaggcctgggtggagccaactctgatgcagccccttctgtgccaggtgcggtggttcctcagcctggagccggagtgaagcctgggaaagtgccgggtcagtgcggaatccctggggctggaggacagagggcagggaggggcagagggcagggaggaacagagccctctccatgccactgcacttgsggaggaagggcagggcctggcttcagtcgggcagagaaactagccaggctggtgcctgcgtctgtgaaatggggaggaggggcctggcccacttcccgggcccttctcccgggatcttggggtagaaagagacgggctctgtggcaggctgtcgggcgacagatggggaaactgaggctcaaagaggcgagtcagtgtggaagggcctgcagcgagtcccggcagagctgggggagccccgtgtcctctgactccccatctggtactcgttctgccccaccaagccctttaggaagtgacttcaggttaaacaaaagactgcctgagtctacgcagcagggagggacatctggaagctgttagccagaggtgggctggcccagccatgtaaacaggctccaggagacggagataaatccacacaccgaagagtttgcagatgacttccgaaactcgtgggaggagggttgtggccaccccacgtctgtccctggctgcccctgtcgggcacagaggctgtgggtttgagggccttggagctgcctgggtgggaagggctggggaggggtccctggaggctgagctgctgctagtaactttgctttcttttggccacaggtgtggggctgccaggtgtatavccaggtggcgtgctcccaggtgagagcaaggagggaaacagggactctataggaagaaagcagccaggacgcagtggctcatgcctataatcccattgctttgggagactgaggcaggaggatggcttgaggccaggagtttgagaccagcctgggcatcatagtaaggccctcgtctctacaaaaaaatttagccaggcatggtggtgtgcacctgtagtcccagctactcgggaggctgaggtgggaggattgcttgagcccagaaggtccaggctgcagtgagctacgatggtgccactgcacagcagcctgggtgacagagcaagaccctgtctcaaaacaaagaaaaagaaaaaggaaaagaaaagcagccccctcagcctccctagtacccccctcgcctccccgaaaagcagaggccaccagaagccctgggtcctgacctgagccatttccccaaactccaaagctcaggctaacagacataaggtccctggcagtccgtccatcccctgaaggtcaaccagccttcctgcaccccacccaagccctgatcccaggcacagaccatcatcacagcccgaggcgggcccccgaggacagatcccagtgtgaccagctatttcccaaaagctgtgagtcaccaaggggccacccaatgagtctgccctgcaggagaccctaaagagctgcccctcaccctcctttcccctgccagggcctgaccaccccacccaacatgtgacctcctgaattcccccaaaagcccagatttaggctgttatgtgggatttgctgatggagtggcccttcctccctctctcccccactacgctgaaagccaaggctgcccagccccaggggagacaggagaggtggaagacgctggcatggtcccagctgtagctggatggctgctttgggggtctgggttgtgagcgagagccccagagagcatgggcctccctggtctacgggcgagtggcaccgcgcagcagctgtccctctctttaccttttctgcggagggtggtcgagacggcttttgtgattaactccagcatagagatgaggctgactgaggcaccagctcacatggctgggaaataggattaaaactcagatcttctgaccttgagccagacagggaaggaaagtcagcactaaacaggtcctttctccacccaccccgtgagccgtgcctgtcactgacagtcagtcccaagggaggtcagctgggggacccgaggaggggaggggttcccagcagggcctgcaaggcctgccttcctayactcactgctttgtcccccggcaggagctcggttccccggtgtggggktgctccctggagttcccactggagcaggagttwagcccaaggctccaggtatgcagctgtctggacagagggctgatggcagggactctccaaccaccttctggccccgggtgtgaaatggggtgggatcctggactggctcagggccctctgggtgacactttttatgttccagccctgggcagcctggtgctgaaaaacctcagagtgtggctgggcacactggctcacacctgtaatcccagtattttgggagggtgagctgggaggatcgcttgagcccaggagttaaagaccagcctgggcaacatagcaagaccttatctctacaaaaacatgattaaaaaattagccggacatggtcacacacacctatgatcccaactattcaggaggctaagacaggaggatctcttgagcccaggagatcaaggttgtcgtgagctatgatcacaccactgcactccagcctgggcaacagagaccccgttcccccgcaaaataagaaagaaagaaaagagggccagatgcagtggctcatgcctgtaatcccagcactttgggaggccgaggtgggcggatcacctgaggtcagcctgaccaacacggtgaagccctgtctctactaataatacaaaaattagctgggcgtggtggcctgcacctgtaatcccagctacttgggaggctgaggcgggagaatcgccagaacctgggaggcagaggttgcggtgagttgagatcaccccattccaccccagcctgggcgacaagagcgaaactccatctccgaaaaaagaaaccccagagttcatgtgagcgcagcatgcgatgactggtctgggaagaactggccattccttgggcctcctggccccttggtgctgtctggcccagtgtccacagttccagggctgtagtgacagctttttatcattacaggtgtaggtggagcttttgctggaatcccaggtgaggcaaggctggtgggagaagmagggtggccagccaggcagaggctctggcgttgggaggggttgggcacccaagatcccatccaagcctgcccaatttctcccacgcctgcagagccaggtcttgcagtggctgtagcacaaagtggcacccatcccaggcctgctccccccactggcatagcagcccaaaattcaaaggagtccagaaaaccctccagcctgtgccaagggctgcaggcccaaactggggcccaggccccaggagggagagaatcccgtagcttcctggaggaagtggcctgtcactgggaatttctcaactgacccatgatggagattcagggagtccctcgaagcaggatggtttctggatgctgtagcaagctccttctgtctgagcagaaagtggagtgggtggcggagggtttggaagggggtgctgggacctgaacttgctctctttattcccacaggagttggaccctttgggggaccgcaacctggagtcccactggggtatcccatcaaggcccccaagctgcctggtaagtcagagggacggttcaagatgcaccactcggccgggtgtggtggttcacacctgtaatcccagcactttgggaggctaaggcgggcagatcacttgaggtcaggagttcaagactagcctggccaacatggcaaaaccccgtccctactaaagatacaaaaattagccaggtgtggtggcataggcctataatcccagctactggggaggctgaggcaggagaatctcttgaacccagaaggcagaggttgcagtgaactgagatcgcgctactgcactccagcctgggtaacagagtgagactctcctccaaaaaaagaaaaagaagaaaaaaaaaatgtaccactcactgcacctccctgcacagaagtcagcctgggtacaggtgtctctggtggcagggaaggggtgttgaagcccctgtatggtcaccagccaaggagagcatgggaaagtcatctgcaggtattgaactcacacacacacgctcatgcacagagacccatagtcccgatctgaagctattaggctggtggaaaggaacacggttcattggaaagatccctctaacatccacccactcgtgctcccgcccctacctctgcaatcagcttagacaataagatgctttccactgaggagggggtgtaaggaaaatactcagactccagggccatgatggggcttgaatttgtagggggatgggtgttccatgggcctcgggggcagaggtgtcctctccctccttcacccagcgcctttgctctcctgggagcagctcaggaccctgatgtgggaggtctcaagctttagcacctgtgggggtagatctgtccacccaggttggtgggagcccagcaaggcatggggcagcccctgagtttgctctgtcctctctccaggtggctatggactgccctacaccacagggaaactgccctatggtgagtgagacccttctagactgtgggcttccagctctttccctctccagggtcctagcaagggtgctgtgcttccagccctgggccaggagagcacctcgctggggcagggttggggtcttggagtgggaatctcagaaggaaagggcatggaatttggactcagcatgggtctccatccctgccctcccacctatcaataatgagaccttaagtgagctgtgttgcttctttgagcctctgtgttctcatctgtaaaatggacataacractccatacatgtgtttgtatttgttttcactctggctgggggtgacaggtgcagactcaggacagcttgggccccgagggcagagcagggggagggggagggcagcagtggtgatgtctgcacagatgaccatcaagcctctctgttttgcaggctatgggcccggaggagtggctggtgcagcgggcaaggctggttacccaacagggacaggtaaggaaagcctcacgtcacttccagccaagggagcactgatcttccaggctccagagccctggggtgggtgaggttccctcctgaaagcagcagcccaccctgcatccagaccctggtccaaacctggagcaggatcctgggggaggagtggggcagctccatcagcctctgcctactctgaagctcccatgtatacccacatgtcagtggattggctctcttggggctgggaacaagtgggctctggagatacaggagcactgtttcaaggtctctcccctctgcttccttcccccaggggttggcccccaggcagcagcagcagcggcagctaaagcagcagcaaagttcggtgagtgcccctggagtccccacctggtggcctccaggcccctagcctctccattcccattactattgacagcctgcctccaaagtggcccctacatacccccatttactcaaaattttcaacatcacccatctatctatccctccctccaaccattcttccatgcatccatgtatccattcatccttccatcaatctattactttctccatccctccctccatccattcccattcctccatgcatccatctatccatccatccattcatgtactcatctgcccatccatgcatccatccactcatccgtccattcattcatccatccatctctccctccatccattcatccatccatccatccattcctccatgcatccatgcacccatccatccattcacccatgcattcattcattcattcattcattcattcattcattctttcctccatgcattcatccatgcctccttccttccctccctcactgcctcctcccacccatccatatcagagatcagggacaaacaagagttctcttagagaatatagccactgttgtgggagtcaagaaacgggaggcatttttttctacctgaggaaagttagaaaggcttcccagagaaagtgacatgtgatttaggccttaaaaataaagatggagcttaccatgtggttaaaacaggaaagaggaggccaagcagagggaatgggtaccacggtggttagaaagataattttaggtggtgcatatataagcatttaaaatatttaatagttatgtatcaatttaatgtgtactataaaaatgttaactcactgctcaggtcagtgagttcttggctagcatggctgcagatggaacgtggtattcctgtgcccgtgcagtgggtggagtgggcatctgtcccctgccccaggtagtgcccacctcagggtcagaccactagggctgaagtcctccttcatcctcagccccagggaagccctttccttatctccccaccagcccgagagagcgagaatgtggggagaagcctgaagctgggcctcccagtggaggccccgcaggcccccctcccagcacccgaggctccttggccccagcggctggtggggacggctgcaatgtgggagcgggagagcagggctgtgaggggctgccagagccaagcagccaggcgcttggattacaaacttggctgcatcttcggaacacagggagaggaagtcttgaacattcctgcaggggaccctctggcccagggagcggccacttgtggtttctcagtatgtggcagtgattagaatgggatttgtctgaaaacatacaagtcccttaatgagtgtgttgaaatggacactttgggggagagtcaaggaacagtggagtggggtgggggcctccccagacaggcccatctggagacacccgggccccattcctggataagatcacactggtgaaaacgccggcgtctaagtggccatcctgcctgtcctcaggagggtccttgggaaactacattgcactgtccccatctcaacaggtgctggagcagccggagtcctccctggtgttggaggggctggtgttcctggcgtgcctggggcaattcctggaattggaggcatcgcaggtaacatctgtcccagcagggggcgggtgtgtccttgagatggccacagggcaaggacctcaccctctgtggctgtgttttcaggcrttgggactccagctgcagctgcagctgcagcagcagccgctaaggcagccaagtatggtgagtgcctcccggggtggcaagtccacggctcgggcccctgcatagacctcggagaccctagccgcaaagccagatggacttggcctttgttccttcccaaatatgcattgttcatgcctccttacctttgccccttctgatcactctacctgagatgccatctctattgttttgccctgattaactcagcagagggaggggaccctgcagaggggacatggctcctcccactccatcccctccagggccagcccacaggtgtctgctgcatcaactaaatgggtgcccagtggtgagaattctgactgtgctttaggaatagatcacattctagctatgcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcgaggctgaggtgagaggattgcttgagcctagtagttcaaggctgcagtgagctatgatcatgccactgcactccagcctgggtaagtgagaatttggttcaaaaaaaaaggaaagagagacagaaagagagagacaggaaggaaggaaggaaggaaggaaagaaggaaggaaggaaggaaagacggaaggaaggaaggaaggaaggaagggagggagggagggaaggaaggaaatgaaggaagggagggagggagagagagaggcaggaaggaaagaaaggaagaaacaaaagagagaaagagaaagaaagaaagggaaaggaaggaaggaaggaaaaagaaaagagggagggagggagagagagagagggagggagagagaaagaaagaaagagagagagagagagagaaagaaagaaagaaagagaaaggaaggaaagaaaagaaaagaaaaagaaagagatcacattcctccagctcactgattcaaatcctagagctctttagggaccctcttagtctctccacatctctctgatgagtaggatccatgcagaggaaatgtcaacccacctgcaatcctgcattcaggaccaactgtcacttccatactctactaaccacccttctagcccctctgaggttcccataggttaggggaacaatgctttttcttccacaggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggtgagctgggctgtgtgtgtgtgtgtgtgtgtgtgtgtgtgtgtgtgttattagagagaaatattgagactattgccaaaatttttgcattctccctaacaccataaccatctgcccatacccttgaccacgtctcatcccctcatcttctcttccttgggctataccaatctccttattagcttctaatcagtatcatattttccaattgaccttctggctatcagtgttctctggggggcaggaaccgtgtctttttcaactccatgttcctagcccttagctgagtaggtgttcagtttatggtggataaaacggtaagtgggtggatagatggataagtggatgaatgggtgggtggatgaatgaatggatggatagatgggtgggtggatggatggatgggtggatgggtgggtggatggatggatgggtggatgggtgggtggatggatggatggatggatgaataagtggatggatgaatgggtggatagatgggtaggtgagtggatgtgtgggtggatgggtgtgggatggataggtgagtggatggatgggggcatggatggatgggaggatggatggaagaatggatgaatgggtagatggatgagggatggatggatgggaggctgaatgaaagaacgggtggatgaatgggtagatgggtggatgaatgagcacatggttggaggggcagatgaatagacgggtgggtggaatggtgggcaagcaaatgcaaaatggatggttggctagatggttagatgaatggatagataggcagatgggataagttggcagatagatgagtggacagagagttaggtggttgggtgggtggattgatatccaaggatagacaaatggacagccgggagcagtggctcacgcctataatctcagcactttgggaggccaaggtgggcggatcacctgaggtgaggagttcgagaccagcctggccaatatggtgaaatcccatctccactaaaaatagaaaaaaattagccaggcatggtggtgggtgcctgtaatcctagctacttgggaggctgaggcaggagaagtgcttgaaccggggaggcggagattgcagtgagctgagatcgcgctattgcactccagcctgggtgacaagattgagactccatctcaaaaaaaaaaaaaaagacaaatggacaggtatagaggtgggtcattaggtagatggatgatgggggtggctgggtatacagatgggcaggtgggtggacatcagtgcataaatggatgtgtagccaactctatgttggcatgaaaggagatggcccaacacacagatgggtagacagagggatacatactacacagctctcctccaatctctcctgagcatttgtgtcccttttggtctctccaggggttgtgtcaccagaagcagctgctaaggcagctgcaaaggcagccaaatacggtgagtgctatgctgacagctctgccccaccctgtcctggcctttacttgccagaactaaaggaccctcytctacttgcccagagaagggaagtgacttgcccaaggtcaccgagcaagtcaccagcaggcctcaggacaatgtctcccccatttgtctcccaccacagggccatggggctgagtggcgggaaagtcccaggatggcattcccagtggggacagtgaccctgagcttccctgctctggccaaggccctctcagaggagcccaaaactgcctggggatgtggattctgccaatagtctctctgcatccaacaaagggggtcttcccgaagtgctcagagaggagaggggccagaggaggactgaagagtgtcagtaaagggctgggtgcagtggcttacacctgtaatcccagcaatttgggagaccaaggtaggaggattgcttgaggccaggaattagagaccagcatgggcaaaatagcaagaccctgtctctacataaaatgcaaaaattagctgggcatagtggcatgtgcttgtttgttccagctacttgggaggtcaaggcaggaggattgcttgaggccaggagtttgagaccagcctgggcaacatagcaagaccccataaataaaataaaaataaaaataaaaaataaaataaataaaaaataaatgaaaaattttaatttttttttctttttctttttctttttttctgagatagagtctcactctgtcgcccaggctggagtgcagtggcatgattttggctcactgcaatctctgcatcccaggttcaagcaattctcatgcatcagcctcccaagaagctgggattacagacatgcaccaccatgcctggctaatttttgtattttcagtagagacagggttttgccttgttggccaggctggtctcgaactcctggactcaaatgatccacctgcctcgtggatcccaaagtgctgggattatgggcatgagccactgcacccggccaaaaaaaagaaattttttttttttgagacggagtcttgctctgtcacccaggctggagtgcagtggcgtgatctccgctcactgcaagctccaccttctgggttcaagtgattctcctacctcagcctcccatataactgggattacaggtgcccgccaccacgcccggctaatttttgtatttttagtagagatggggtttcaccatattggccaggctggtctcgaactcctgacctcaggtgatccacctgcctcagcctcccaaagtgctaggattacaggcatgagccactgcacccggccccacattttttttaaaggcttcatggtggaggtgctggggacccaggcatcccagttttctgtcttttatggacaaggcctgggggaaatttacatcctctttcccaatccatcagcatccctcagagcccgcccagcctctctcactgagcttcttttctacttggctcccttccctctgcaggggccaggcccggagtcggagttggaggcattcctacttacggggttggagctgggggctttcccggctttggtgtcggagtcggaggtatccctggagtcgcaggtgtccctrgtgtyggaggtgttcccggagtcggaggtgtcccgggagttggcatttcccgtgagccttagtcacayctggggacatgggttgagaagggatgggggcttcttgtctgctcrgctctgcagggrcagtggggactgtagatcgggcttgaatgtgctcagggaggagttgggggagaagaagggaggtcgtatccatgccttacagggcagaagagctttaaacacggctcggaggagacccaggcacggcttctgagggtctctttctttctcgtttccttgtagccgaagctcaggcagcagctgccgccaaggctgccaagtacggtaagtgcccctgccctgcctgtccccaagtcctgctctcccgcggggctcagggtccaacctcagggcaaactggctcccaggcctccaggactgaaatggcctggaccaaggtcacgaggcccctgccccatcttccaaagccacactccactcttactgtccttttcagatgccccctgttaggactgttggtcactggctcatcaccccaccccccacccccagaattgaaggtgtctggcagggttgggtggctgatgcctgtaatcccagcactttgggaggccaaggcaggtggatcccttgaggccaggagttcgagaccagcctggccaatatggtgaaatgctgtctgtactaaaaatacaaaaattagctgggcatggtggcgggcacctatagtcccagctacttgggaggctgaggcaggagaatggcttgaacccgggaggtagaggctgcagtgagcagagattataccattgcactccagcctgggtgacagagcaagactccaactctaaaaataaaaaaaaaagaaaaagaaaaagaattgaaggtgccaggaagccattctcttcttcctccgattctcccacccacccttgctcccccaaaaagtgagtactgggaggggcaaggctgaaagttctccactccccgaggtgctgcaggagcaggagtgctgggtgggctagtgccaggtgccccaggcgcagtcccaggtgtgccgggcacgggaggagtgccaggtgagctgtgtctccagcccagagatgggtttggtttgtctcatggaagggtccctggagttgaccaaggtcgactgcaccattttacaaatgggaagactgagcctagagatgggaagcagggaggggtgtgagagattactctctcaccccttctcttcacacctccaggagtggggaccccagcagctgcagctgctaragcagccgccaaagccgcccagtttggtaagtccccctcacccccgccactggctcacggagaactgctttctcctgtgccctgctctggggtctgaccgcccagcttcctgttcctttccaccccacttaagctgtcacattctggggtgggccctccttagaccttttggcccactgatgaatgacctctaggagtgtgggtgrtgtttctgattaggggagcagggtgagcagtgtgagcctccctgttcctaaagcccctggtgcctcccaggctattggggacctgacctcatgctgagctccagctccccttgagggactccagttctcccccttctccttctctttctccttctccttcttcttcttgtgctcctcttccttcttcttcttcttctttcttctcctcctcctccttctccttctccctcctcctccttctcattcttcttcttctccttcctcttcttctcctcctgcttcttttccttctcctccctcttcctcctcctcctgcttctcctttcttctccttcttcttctttcttcttcttcttcctctttttctccttctttcttcttctttctccttcttcttcttcttcctctgctccttcttctttctcctccttcttctcttctcttccgtctttcttctcctccttttcctccttcttctttcttctccttctccttttttcttgagatagggtctagctctgtcacccaggatggggtacagtgccacaatcatagctcactacagcctcaacctcccagtctcaagcagtctgcctgcttccgccccccaagagctgagaccacaggtgcccaccaccatgcctggctaattttttaatttttttgtagcgacagcggtctcactatgttgctcaggctggtctcaaactcctaggctaaagcgatcctcctgcctctgcctcccaaagtcctgggattacaggcgtgagccaccacacccggcctgcagtacttcttgttccccatctcttgctacatttgagggccaccctggcagccccaggtgcccacacttttctgaacatggcaaatcgtggcagcaccaattgtagagctcaactgtatgtcaggccctgggcatggggtctgtaggccttggccctagggacctgtgggctgaaaggttcagatcagaatctctaggactgaataggccagagagcatttcgactgcaggtctgctgagccccatattctcacacacagcaatctttattatttatttatttgagacggggtctcacattgtcgcccaggttggagtgcagtgatgccgtcagctcgccgcaggcctcaaactcctagcttaagccattattcccccttagtatccctagtagctggggctacagtcacatgccaccatgcccagtttaaaaaaaaaaaaaattgtatgcgatcctcccacattggcctctcaaagtgctgggatgacaggcatgagccaacgtgyctggcctacaaaaatcttacagagttgattttatttttcccattttacagatgtggaaactgaggttcccagagcttaagtaacttgcctacagttgcacagctaaatggtggctgagctgagatttgaacccaaagcctttctgtcttacaaagtcccttatataatgtaaatctgcctccatcagcctcaaatctccaaggggtccttgtcactgaaaaggttaagaactcctggccaaatgcagcagctcacaactataatcccagaactttgggaggccaagtcgggtggatcacccaaggtcaggagtttaagaccagcctggccaacatggtgaaaccctgtctctactaaaaatacaaaaaaattagccgggcatggtggtgcgcacctgtagtcccagctactcaggaggctgaggcaggagactcacttgaactcgggaggtggtggttgcagtgagtcgagatcacgccattgcactccagcctgggcgatagagtgagactctgtctccaaaaaaacaaagttatgaactcctgagcctgcacacacttcatattagggaggaggaagctgaggcccagcaagggaaagtaactgatccagggtcacacagcaaatctatgccagggccgaggctccagccctctttccataagcttctgtcctctttgatcaggtcttggttaatgatcagctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggwggagttgcaggtgagtttcatgagtcaatgagcctgaggggcccccgaagcctccatgggccccgyctccatctctaatccccctctctctccctccctcagctgcagcaaaatccgctgccaaggtggctgccaaagcccagctcygtgagtgcctcgcccacctttctctcctctccccaacgatctcagagctggttaggggcaacagccagggaggaggccgctgcttggatctgggccccttcctctgggactaggctcagctccctgggcaggacacctccttaggggcatgctccctgcctgctgtcgccaccactgccctctgtctgcaggagctgcagctgggcttggtgctggcatccctggacttggagttggtgtcggcgtccctggacttggagttggtgctggtgttcctggacttggagttggtgctggtgttcctggcttcbrggcaggtgcagatgagggagttaggcggagcctgtcccctgagctcagggaaggagatccctcctcctctcagcacctccccagcaccccctcatcacccaggggtgcatagtaaaatccttgttaggttctcctaagcatctgggggtaacagatagcgggaggagggcagaccaggccaagggaccccaggctgcccaattgcagagtatctgcctcctcagtagaggggtggcagggctccagactgagaaaaagcctgccctccaaccagggaaggagcaggtagatcagcctggctccccttcagcagtgctctgtggccaggggaccactaggaactccagttcttcaccagctggtgactgagccccactctgtgcccagcctcaggcagtccatgctaggcctggggagagaaggaaggggcagacggaaggtggaggcactgttcagccctaaagctctgtgcctgtacagcttcagggctttgaggaagcaatagaggccaaggaagtcagggagggctctctagaggaggcggcagaactcccaggcacagagctcggctcctgaccactccccaacttttctttctccccagtacctggagccctggctgccgctaaagcagccaaatatggtgagtgcaccccacaaccacttgtggctcccttgccaccacaccatccctgacagcacaggactggggtggtcacaatagaaaaaggcagtttcggccgggcgtggtggctcacacctgtaatcccagcactttgggaggccgaggcaggcagatcacctgaggtcaggagttccagaccagcctgaacaatatggttaaaccccatctctactaaaaattcaaaaattagccaggcgtggtggcgggcacctgtaatcccagcactttgggaggccgaggtgggcagatcaactgaggtcgggrgttccagaccagcctgaccaatatggtgaaaccccatctctactaaaaacacaaaaattagccaggtgtggtggcgggcacctgtaatcccagctactcgggaggctgaggcaggagaatcgcttgaacccaggagatggaggttgcagtgagccgagatcacgccactgcactccggcctggacgacagagcgagactgtatctcaaaaaaagaaaagaaaagaaaaagaaaaaggcagtttctaggacacgtttatgacagtttaaaaacctggcccctgcccactaaatgcttatggtgccttcaacccctgtgaccaccaaaaacacccttgaaatcccagttgccccccaggaggcaattccaccatccctaagcttgccctgaccctgacagttacatggtccctgtgtccaggaagggactgggcctgctgtgggtatgaggagtctgggcagyctctgcctccacyccagctctctggcccgagcaaaggagctggtattcctcatctgggcaccccgggcccccgcccgccttcctgtcctgccagcaggaccgctcccaccacgagccagcccagaggacgtggcagtcccacagcctctgcacttggcgctctggcagccctgcctggccagacccacgctgtctgtagcccctgaattcctggcctcctgtgagcagcgttggtgggaggtggaagactcccccagggatccaccaaccagccgggcaggtccacttggggccagtttctacctcggaaaatcctggcttcctcagcgccgacccccagcagccctggcctcctcccctgctcactgctgactgcttggcaggcctgagtcaacagacattgccagggaaacagagtgacgtcatgtggtggagccgcgaagggcgcaggctccccagccacttcccgtccctgaagccctgagcacactgcttaacctctgctctgcctcagcgttctcatctgcaaaatgggaatgacaatagtgcctacctttcctgctgcaatgcataaaaaatgggctgctaagtgtgaagcactcaaaatgttaagtgcctgctgtagatactattaccgttgtttgtttgtttgtttgtttgttttgacagagtcttgctctgtcgcccaggctggaatgcagtggtacgatcttggctccctgcagcctccatctcccgggttcaagtgattctcctgcctcagccttccaagtagctgggattacaggcgcccgccaccacgcctggctaatttttgtatttttcgtagaaacagggtttcaccgtgttggccaggctggtctcaaactcctgacctcaggtgatccactagcctcagcctcccaaagtgctgggattacaggtgtgagccaccgcacccggcttacaaaagaacttttaaggccaggcacagtggttcacaccttcgggaggctaaggcaggaggatcgcatgagcccaggagttggaggctgcagtgaactatgattgtaccactgcactccagccggggtgacagagcaaaaccccatctcaaaatgaaacaaaatatggactggacttcctgtccactgctcctccacagtgtcacatggcccctgccacctgtctgcttgccttgtgtccctggggcagggagacccatcgttcagaaatggaacactcattttccctcctctccccgcaggagcagcagtgcctggggtccttggagggctcggggctctcggtggagtaggcatcccaggcggtgtggtgggtgagttgaaaccccaggaggggcagggtggggagggaatctaaccagtacagagtgcctccctgaactcggtctgtgttcccaggagccggacccgccgccgccgctgccgcagccaaagctgctgccaaagccgcccagtttggtgagcactgggtggaggtgggagctgccgccaggcccccaggcccccagggtgtgggaggagcttctgaccaggcactgtagactcagagtccctgccccagacacctcctggctccactgtgccatcgaaggccaggggagacctcaggctccacctgtgtccccagaggacacctccgccctccacaggccgaggcttcagtcccacctttctgaccagcggagtctaatgctcagctgtctccacaggcctagtgggagccgmtgggctcggaggactcrgagtcggagggcttggagttccaggtgttgggggccttggaggtgagagttgttctgaaatcagtgagtgtgtgtggtgtgtgtatgcgagacagagatggagacagagacagagacagagactttcgttcccacccctggcacgtctttgctcaagatgtcctcttggccaggtgcggtggctcacgcctgcaatcccagcactctagtaggccaaggtgggcggatcactagaggtgaggagtttgagaccagcctgggtgacatggcgaaacctcatctctaccaaaaatacaaaaataagccgggcgtggtggtgggcacctgtatttccagctacttgagaggctgaggccagaggatcgcttgagcccaggaggcagaggctgcagtgagctgagatggtaccactgcattccagcttgggcagcagagtgagaccctgtcatctaaaaaaaaaaaagaaagaaagaaaagaaaagaggccaggcatggtggctcacgcctgtgatcccagcactttgggaggctgaggtgggcagatcacgaggtcagatcaagaccatcctggctaacacagtgaaaccccgyctctactaaaaatacaaaaaattagctgggcgtggtggcagacgcctgtagtcccagctactcaggaggctgaggcagaagaatggcgtgaacctgggaggcggagcttgcagtgagccgagatcgcgccactgcactccagcctgggcgacagagcgagactccgtctcaaaaaaaawawatatatatatatatatatatgtatgtatgtatgtatataaattagctgggcatggtgacacacgcctgtaatcccagctactcgggagcctgagacaggagaatcacttgaacccaggaggcagaagttgcagtgagccaagatcacgccgctgcactccagcctgagcaacagagcaagacctcatcccaaaacaaaataaaaacaagaaatgtggcaaacgggagctggggctatcccttgccgccagggtcccagtcctccccctctcctctctctttcaacccacctgaccactgcggtgggagtaaattaggagaatgatggttatgccagttctccaagaaagaaatcaaagcttggagagaaattgctttccctaagtctccaccatggtggccgaccttgtgtggccatttccccctttcttgggctgtcattgtgtctccccctgtaaactagcctgcacagctcttcctgtgagtgccacaagaccagacacacagtaggagcttaacaattaagacttttggggccgggcatggtggctcatgcctgtaatcccaacactttgggaggcttaggtaggtggattgcttgaggccaggagttcaagaccagcctggacaatgtagcaagacccccccccaccaccacctctacgaaatatttaaaaattagctgggcgtggtgtgtgcctgtagtttcagctacttgggaggctgaggcaggaagatcacttgaacccgggagttcagggctgcagtgagctgtgatcaagccactgcattccagcctgggcaacagagcaagaagctggatagatgaaggagagatggggggatagactgggaggatgagtccatgggcagacggtaaagggtgagtaggtcagaagacagggcctagccaggtgcagtggctcacacctgtaatgtcagcactttgggaggccgaggcaggtggatcacctgaggtcaggagttcgcgaccagcctggccaacatggtgaaacctgtctctactaaaaatacaaaaattagccaggcgtggtggtgggtgcctgtaatcccagctgctcaggaggctgaggcaggagaaccgcttgaacccaggagatggaggttgcagtgagccgggatcgcgccactgcactccagcccaggcgaaggagtgagactctgcctcaagaaaaaaaaaaaaaaaaaagacagggcctgacaggtggcattggcattcctgagccgtcatgtgcctcatctccccaggtatacctccagctgcagccgctaaagcagctaaatacggtgagttcccctctgatgccttcctgccagtggcctgcaccccctgccatgcccatcgccaccctcccccagcccagctcaggcctccctctggctccccctacccctgaagatcttgtctgggacattccttaacccagaacccagcagggatatcagggcctcttcccgatgggggtgtcttatcctgaccccacctgcctcttctcaggtgctgctggccttggaggtgtcctagggggtgccgggcagttcccacttggaggtaggggtggccagctctgctacgtagtcctcagctctgtcccgatctagagggggcctgtccatctagcagtggggactcccagagcccatgtccacacaaggacaggagactggggctggtgagggcactttaggattgcagatgtactgggcaaacgggcaagctataaggttggggacagtgccaggctgagctcagggttgaggccatgaggtgccacacctggttgctaggtggcrgcatgttgtgttgagaaagccactctggctgtagtgagggggattggctgggcgtggtggctcacgcctgtaatcccagcactttgggaggcctaggtgggtggatcacttgaggtcaggagttcgagaccagtctggtcaacatggtgaaaccctgtctctactaaaaaaaatgcaaaaattagccaaacgtggtggacgcctgtaatcccagctactcgggaggctgaggcggragaatcactggagcctgggaagcggaggttgcagtgagccaagatcgcaccactgcactccagcctgggtgacagagcaagaccccatctcaaaaaaataataataaaataaaatataaaaaattatatagtgggggggatggagaggaggtgatcccagacagaggtcttgggtgagccagtgcaggcagaaagtgatgaggctggagtcagtttccacccytaccaacccaccaacctgaaatctctcctgcaggagtggcagcaagacctggcttcggattgtctcccattttcccaggtatgccaggctccctgcccctgggccctgccctggagctgcagccacctcctccctcctctcctgtgccatctcctgctcagaagggctgagccagcacccaggggtggaccccacagcctcaggtcacacgaggctggaccccgagctgaatgtagagcctcccctccttcttgctgacctcttataaacacagggaacatttgctttttaaaaacacagttcatggccaggtgtgatggctcacacctgtaatcccagcactttgggaggctgaggagggcagatcacctgaggtcaggagttcaagaccagcctggccaacatggcgaaaccctgtctctattaaaaatactaaaattagccgggtgtggtggctcacgcctgtaatcccagccctttgggaggccaaggcaggtggatcacgaggtcaggagatggaaaccatcctggctgaaacggtgaaaccccgtctctactaaaaatactatagtcttctttttttttttgagatggagtcttgctctgttgcccaggctggagtgcagtggcacgatcttggctcactgcaacctctgcctcctaggttcaagcgattcttctgcctcagcctcccaagtagctgggactacaggcatacaccactacgcccagctaatttttgtatttttagtagagacggggtttcaccatattggccaggctggtctcgaactcctgacctcgtgatccgcccgcctcggcctcccaaagtgctgggattacaggagtgagccaccacgtccggccgtctctactaaaaatacaaaaaattagccgggcatggtggcgggcacctgtagtctcagctactcgggaggctcacgcaggagaatggtgtgaacccgggaggcggagcatggtgtgaacccgggaggcggagcttgcagtgagccgagattgcgccactgcactccagcctgggcggcacagcaagactccgtctcaaaaaaaaaaaaaaaattagccaggtgtggtggtgcacgcctgtaatcccagctactctggaggctgagacaggagaattgcttgaacccaggaggcggaggttgcagtgagctgagactacaccactgccctctagcctgggtgatgacagggcaagacgattgcgtctcaaaaaaaaaaaaaaaaaaaaaaaaaaaccttcagaggcagatgtctgttcctgccccactctctgctcactgccaccaggtggcggtaaggagccatatctggctcaagcagggttaggaactgctccgggccgcgctactagacaatggtgccttacctaatacagactgatgccttgaaacagggttcacccatcagactattcccaggagggggtaggaatcctgggtttgagtcccagctcagacactatgtggataagaccctctctccctctactgggccttgatttacttatctgatgccctctcagatgtatgggtccaccccactccctgagagggccgtctcctgcagacactgactctcccttcatcccatgttccttgatggagctgctcttagcctttccccgaaaggcttcttggagcagtggagccaggagccagtgccaggccccgtccttccccagccaggccccatgacctgcccccttttctgcgagcgttggtttcatccaagtaatatcttgggggcttctcccgccccatctgtccagtggaagttgatggcatggatcaggtctgagtttggcctggggccatgacttggcttctcttggcttcttggagcctccattcgagtgggtcagagcaggcggggattagagccgaaactgagaggggccggactcacagtgatgtgcacctcctcccgtccaggtggggcctgcctggggaaagcttgtggccggaagagaaaatgagcttcmtaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacmtaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcsgtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaactgtgtcttagcttccttcgtatgatttaatctgccttcaactcgctggcctggatggggataagggctctgcttcagggaacctccaccacccacagtgtatttgagaggttgcccaaccaaaagcccctgctgctggcttctggggcatcgatctttctccaagtttggcttgtactttaacaatgaggccaggagtttgagacccacctggacaacatagctgtccagtggagaatcactttgtaccatatagctacaaaaaaaaaaaaaattacccaagattggtggtggtgcatgcctgtggtcccagctactcaggaggctgaggtgggaggatcgcttgagcccaggatttcgaggctgcagtgagctatgattgcgccactgcactccagcctgggtgagacagcaagatcctgtctcgagagagagagagagagaaacagaaagagacagagaggaaagatggctgacctaagaaaatgcagaagacagtcaaaggtaaccattttcctccgaaacagtcccctctgaggaagacccactctcatgcgtggccatgtaaggccatttggcttgagaagtttaagaagtgatacccagcagcaggttcagctccacccttactcagatgcacccattcccattctggcccttcctcctccccttgaggccagaaatccgtggggcccgggaatgtgttcacctgcagcccacatccctacctctagaccacgctctggataccagatactggaattcccttccccaaccaccaagcccacttccagggctcactcagcctcaggcctgtgccaccctcctgagagcgggccccgtgctgagtgtgcacacctctaagccagaaatgtggcaacagagctgttcgtggggagtgtgggtggggctcaccatgcagactggagcatatgtgggtttgcatacgaggatccttgcgatcccagaaggagctgggagggaaagagaaagctggtggagggtatgctcagagagagcttcccagaggacagtaaagggcaaaaaacattttaccaggcaaagaatagaacagagaggagggtcaggcctttcaggcagaggacaggacaactagatgtctggtaggagagggcagtgctgaggacttatggaggatgatcaggagggggtgagcggcgtggttcaaggagatgcacaagagggttgctgtaataatccagggaggggtgacacagcctgccctagagtggtgacaaagtagatccatccatccatccatccacccatccacccacccatctgtccacctacccacccatcaacccacccatccacccacccacccaaccattcttccatccatccatgtctccttccacccatccacccacccacccatctatccacccacccatccatccatccatctatccacccatccatccacccaccagtccatccatccattcattacttcactcgacaaaaatatccattgctggtttttcctcaggtctccggcctctaaaagtcagtaagccccagcattcaggcctgtggactccctgtcttggtttctcatagcttgcggttttatttatttatcagagacagggcctcagtctttcgcccaggctggagtgcagtggtgctatcacagctcactgcagccttaaactcccaggctggagcaatcctcccaactacaggcacataccaccatacccagctaatttttaaatttttttatagagatagaatcttgctatgttgcagccaggcgtggtggctcatacctgtaatcccagcactttgggaggccgaggcaggcggatcatgaggtcaggagttcaagaccagcctggccaacatggtgaaacctcatctctactaaaaatataaaaattagccgggtgtggtggtgcatgcctgtaatcccatctacttgggaggccaaggcaggagaatcacttgaacccaggaggcggaggttgcagtgagccgagaccgtaccattgcactccagcctggcgacagagcgagactctgtctcaaaaaaaaaacaaagaatcttgctatgttgcccaggctgctctcaaactcctggcctcggcctcccaaagtgttggggttacaggtgtgagccacctcagctggttgctcgtggctttaaatatttaatacgacctattcattggtgactctccaattgacatctccagcatgaccgctcccctgagcccaggacttgcacatccaaggccaattctaacatctctacctagaaatctcatagacatggcctaggtagcgtggttttccctccctgcctttcccatctcagtaaagggcagccctactcttccagaggttccggcctgcaactctgtaaccatctctgactctgctcttccctcactccccacagcagattcaccagcaaataatacggcaccaccttcagaatatatccagagttggccaggcacactgactcacacctgtaatcccagcactttgggaggccgaagtgggcagattacctgaggtcgggagttcgagaccagcctgaccaacatggagaaaccccgtctctactaaaaatacaaaaaaattagccaggcatggtggtgcatgcctgtaatcctagctgctcaggaggctgaggcaggagaatcacttggacacgggaggcagaggttgcggtgagccgaggtcacaccattgcgctatagcctgggcaacaagagcgaaactctgtctaaaaaaaaaagaatatatccagagtcctaccacgtctcagggctaagccacaatccccagtatctcttgcctgaattactgaaatagctccctgaaccccttagttctcccctggctccccttcggccttctctccactcagcaaccaaagcaatctttttttttttttttttttttttttgagatggagtttcactctgttgcccaggctggagtacattggcgtgatctcagctcactcaacctctgcctcccgggttcaagagattctcctgcctcagcctcctgcgtagctgggactactggcatgtgccaccatgcctggctaatttttgtgtttttagtagagacaaggtttcaccatgttggccgggctggttttgaactcctggcctcaagcgatcctcctgcctctgcctcccaaagtgctgggattacaggtatgagccaccacatctggcccaaagcaattctttcaaagcataagtcaactcgggtcatgcatctactccaagtcctgcagtggttcctgtctcactcagagacaaagccagaggcctttctatggccaagaagcccctacttgcatggcagcagctctcctgacctcacattctgctattcgagccatgcggtcgccctggccatcttacttttccttgagtgcaacaggtcacccactgccagccttggcatctgctatctcttctgcccaaaacgccctttcatcagctatctgtgtttctggctcactcagctgcttcaggtcttgactcaggtgtcaccttctcagagtgtcctacactgacacctttctaaaattgcaaattgggctggatgcggtggcctgtgcctataatcccagcactttgggaggctgaggtgggaggatcacttgaggccaggagttcaagaccagcctgggcaacatagcgagactccatctctatttaaaacataaataaaattgcaagctgcaccctcctcctctgctcattactccctcacctggctctacctccgttttgtgttttgttttgttttttgagatggagtctcactctgtcgcccaggctggagtgcaatggcaaaatctcacctcactgcaacctctacttcccgggttcaagcaattctcccacctcagcctcctgagtagctcggattacaggcacccgccatcatgcctggcaaatattttttgtatttttatacagacagggtttgaccatgttggccaggctggtcttgaactcctgacctcaggtgatccaccctccttggcctcccaaagtgctgggattacaggcatgaaccaccgcgcccagcctgtctctgccttctttgactccagagcacctgtcaccataaacaaaatatattttacttctttgttttctgtctctctacaccagactgtaaactctaagatgggcactgctttaagaataacacagcctggacacagtggctcatgcttgtaatcccagcactttgggaggccgaggcaggcagatcacttgaggtcaggagttcaagaccagcctggctaacatggcaaaaccccaacaacaacaaaaaaaattagctgggtgtggtggtgcatgcttgtaatcccagctactctggggactgaggcaggtgaatcgcttgaacccaggaggcagaggttgcagtgagccaagattgcgccactgcactccagcctgggcaacagagcaagactgtctcaaaaaacagaaaaaaaatttttttaaagaccctatctccaaatacagtcatattctgcagtattggagtaaatgcttcaagatataaattttgaggagacacagttccacccctaagagttacctcatggaaaaagggtctttgtagttgtgattaagtcaaggatcttgagagatagggagattatcctgctgggccctaaatgctacataggtattcttatgagaagctggggctgggcacaatggctcacacctatcatcccaacactttgggaggccaaagcaggaggatcacttaagccaggaggtcaaggctgcagtgagctatgattgtgccactgcactccaatctgggtgacagagtaagaccctatctgaggaaaaaaaaaattggaaaatctagataaaatggataagttcctagaaagccacagcctgccaagactgaatcatgaagaaatagaaaatcagcatagaccaatagtgagtaaggagattaaatcagtaataaaaagtctcccaacagagaaaaacccaggaccagatggcttcactggagaattctaacaaacatttaaaaaattaacaccaatcctcctgaaactcttccagaaaactgaagtagagggaacacttccaatctccttctaagaggccagcattattctaataccaaagacacaagaaaagcaaactataggccaatatcctttatgaacattgatgcaaaaatcttcaacaaaatacaagcgaaccaaattcaatagcagattaaaaggattatacaccataaccaagtggaatttttcctgaaatgttaggatgtttcaacatatgaaaatcaatcagtgaaatataacatataaacagaatgaaagacaattacatgatcatctcaattgcagcagaaaaagcagcaagatccaataaactttcatgataaaaacattcaacagactaggaatagaagcaaaccacttcaacctaataaaggctatagatgaaagcccacagctaacatcatacttaatggtgaaagactgggcttgagtggtggctcacacctgtaatcccagcactttgggaggctgaggcaggcagatctcttgagcccagaagttcgagaccagcctgggcaacatagcgaagccctgtctctacaagaaaatataaaaataagccgggcatagtggcacatgcctgtagtcccagctgttcaggaggctgaggcaggagaattgcttgagactgggaggttgaggctgcagtgagccatgatcatgccactgcactctagcctggaaaacagagtgacaccctgtctcgaaaaaaataaaaaggacttaaagcttttcctctaagattaggaataagacaaggatgcctactcctatcacttctattcagcatagtattggaagtcctagtcagaacaactaggcaaaaaaaaaaaaaaaaaaaaagaaattaaagatatccaaattgagaagaaagaagtaa

SEQ ID NO: 17616 - DNA, 20082 bp, Homo sapiens
ttaaaagtttactggaaaccacatacctttcttcctttacgacaacctgtcattcatcacagctaaaacatccacccattaaatgatatttttacaagattaaagaatggttttaaaaagaaagaaatctccttagttaaaaatgaaccaaacaaaggtacctaatcactgatcagcatcaaagttttgttccacacatgaaaataattcatcaggccaggtgtggcggctcacacctagaatcccagcactttgggaggccaaggtgggtggatcacctgaggtcaggagttcgagacctgcctggccaacatggtgaaaccccatctctactaaaaatacaaaaaattagccgggcatggtgacagatgcctgtaatcccagctactcaggaggctgaggcaggagaattgcctgaacccgggaggcggaagttgcagtgagccaagatcacaccattgcactccagccggggtgacaagagcaagactctatctcaaaaaaaaaaaaaaaaaaaaaaaatcatcaatgtaaaaatgaattctgcctaaggaggggaatttaaaaagtcagagaaaagcaaggaattaaaattcagaaacaagctgttttataattaagcatctgcaatttaactatactatgtcactctgattttcatctttcctttctcataagagtcatagatgttctccgctcatataaaggtggtaggaagggagggagggcgccatgctaatagaacccacatcatgtttactaagaactaggcagatgtggacaaaaactccaaagatttaaaagtttcttgactagagcaagacatcttcaagaactcatccaacatggtgcctagccttcttcagagcaagacaagccactaagtcatccctgggtgtgtgttcagcagcagcccactaggaagtattaggtgagctacgatgggagagtaatgggcaggaaaatcataggaaagcaggtctggatttgggctggctgcttagctgcatggcaccttgcacaagttataatcaggtctcttgcctccatttcctcttccacaaaaaatggaacagtaatatccatatccaccctacagactgtgcaaagattaaagaatactggcgaggtgcctggcacctagtcattgttcagtgaatgccagtcatgatcacgaacacagtccttgctaagagggtgatatgatttggctgtgtccccgcccaaatctcaacttgaattgtgtctcccagaattttcatgtgttatgggaaggacccaggtgaggtaattgaatcatgagggctggtctttcctgtgctattctcatgatagtgaataagtctgacgagatctgatgggtttatcagggtttccacttttgcttcttccacattttctcttgctgccaccatgtaagaagtaccttttgcctcctgccatgattctgaggcctccccagccatgtggaattgtaagtccaattaaaacctctttttcttcacagtcttgggtacgtctttatcagcagcatgaaaacagactaatacagagggtaatcaccacaggaatccagacggggagtggggtcagttcactggtacaaggatcttcatcaaaggaactcatttcccacctgatccctattcactccagggtccacatctaggagtcccaaagaccggcatgcatgggttgggtcaacaggctgcctggaggtttacctcattccaggagttggagaagcactgtgggaggaactggggttcaaatctgcaaacctccaaaacataggagggatcttctaaaagtttctgagagttctaaccacagattaggggaaaaaaaagatgccctttcatcaacatgggatgaaatgctaggatttagacatggtttttttgtgtgtttttgtttttgtttttttccaattcagaaaacactaaatcatgtaaaaatcttggaagaggagatacagattctgacctaataagatgctactgctctgattccaccatcagaatacctttaggttggcaccacttgcaatgtattagtgcagcaaactgcacgaatcccctcattagatccagggcccctgagagtagaaaggggagtggggcagtaaatggccagggaacaggagacagtgggctggagggtgtcccaggttctaaccccagctgggccttcagagccctggtgtggtctgggctaacctctcaatccttttccaagtcttaagtttccttccaactcactgtgattcttccagagaattacacagggcaggtgaaattatttcctagaaaatgcccatggagtacagaggttctcactgaacttctctattccagggccgatgcctttgttttaatggcagcgcatcatcgactaaccaaatccacaggtactgcacaggtctgaaggatccggctctgagggataccgaggcatccggggctccctctgtcttctttctgtgtacacaaggtaccttcagtgactgcaaggaaaatcctcttgctttctacatcagagcacgttccataagggcaaagtgctccagtcatcacctcctgttttctctagccagacctgctctgagctggagacccactgcagtcaagcaaacttttagacacaagaaaaaatgacaacgtgtctattacagaggtctcagcttaatcagaaaatggcactgtgggccagagaaaagctgacggtgatggctcctaccccagtgcaataggcagatccatgagagctctcactggggctgctggagaactggctgctctctcccactttagtaacccctgcttcataactgtctgtgccagaaagccacagtgagcccccagtggcccctgtattacccacccagagagacaagctctcccctccatgaaactcatttctgggacccacacctaaactttaacacaaatcagaaaagttgagactccttaaaaatgcgttttgcaagctcacaggttcttggttcataagtgatactatggaacaatctggttgggaagggtggcacacaatagaaaaagttaatgattatctggtgtagtttgctttagtctgtgagttcaaaagtctcctcatttacaataaccttaaaggataacaaaataaagtcctagaagaaatgtaaatttaattatttccattttctcaaaatattaattgctgatacaattaaatggattggcctaaactgctccaaagcttttcctatctgctaattaaatttgccctcgctgccataatacaaattctgggaaaccttctggcttctgggcacactatgtaggatgagagaatcaaatccattcagtcctaatctactgccccacttaataaacaaaaaatgttaagaacatgcattttaaaaaaaatctaaatgccttcataatatagatacagcaagtcttcccataatgctaatgaaggcttctcacaagagtttaatgagctagtatccagtatcttccaggcccggggatgttagcttctcctcccttagtacagaggttgctcagacagcaatcagcatcatgatccatactaaatgcaacggccctactctttatctttatagtctgtaatccaagtcactctattaacaggcagaaaaatcccagctagcttcaaaactccctcatctttccattatttcaaatgacaaccttttcccactactttatctttgcattaagtaccaggagctgaaagatgcaatcaatttaatatttccctctgcccatttacatgacttatttgtttcggcagatcttctttgccacaaatccttcatttgcccattcatgtctgcatacttaacatagatttaatatttctccaggccaaagatcatatgcagagtttttctttgactggaggacagaagagacaaggagagaaggagaacgtctggaattcctttgttcttggagacaactccagagaacaattctcaataagaaaagttataaaaagcttcaatcagcaccctcacgtttctgatttaaagttggggtgggggagcgtggaataaaaagagagggaactaaacatgtacgaaactcattctagcgtgagacgttgtcaggtactttgctgacattttatcataaaactctctctcggtggccacgggttacagcagggaacctaaaacctagacttgggaccccaagtcctcgcttcacaaaaatcatgacatgggtgttgaaccagtttctgttcagccacacagaaactcattcaagtccttcaagaggaagaatcccaccttcaactccacacctcctccagcaccaggcggagatgctcctgattccactgagaatcctcctgcccacacaggcaggaaactcggggcactcagtgcctgctctctcacccactgcatgcccacagacctctgcaaaggcagctcctttattcccccaatcctgaacatctgttaagtgctaaggcctcagagggggctttttaaacaggcacaaagtagaaactaccagctttccaccactcctacctcatccatcagaaaacagagccaccagccttccagggtagggttcatcaagccttttcctccccatggaactaagctgtacacagtagtcagagataaataatgtctaagccaaaccggcttgagggcacatatggaggtggggggcagagggacactggcctgggacctaaaccaccattcagacctcatctttacaaaatagtatactccacattccaaatgcctggcaaagttttgcattacaactcattcacgagtcgagggccttgtatacagtgttcggcaaacagtactgagcaagtgtggacatttctcatgaaaggcctcgatttcaaccagacccaaatattcttttaatccaaagttccaaatgtggaacttaccctcctctgagctcctagcacttgttgcctctatttctcttctggcaaaagtcgtagagtgtctcgtcacaccgcataagttgtctctctcttttaaatgtcaagtgtttttatcttatctcacaacagaatcctagtttgtgtcatctcatactgcctagcatgagacttgcacaaaacgggggcaccttaattgtgcagctgagggacacgatggaaactctggccaaggaactagcaaggaaacctgcaaagacacatccagacctaacctaggtgcgacttataactcaaacctcttccccagtctccctctctatgggagtgatatgtacacaatgtgttcgcttccacttccttaatgatggtggactgacatgaataagaatgatggggaggaccataggaccccaaataattcacaagtcagcaaagtgaagaactcacctaggccatacatgtgcacacattctctagcacacacacttactctcacactctactgttatttagtttgtttattcattccagctagaaccagggaccaatttggtcatccaaaaatgttttgtaaatctctttataaaattcctgcacctctcagggccagcaccagagcaaggcaagattggtgtccaggatacaaaatgtaaacaggtgctccctctcatggtgcactaccctgagagaagacctcttttgtctctggtccaagatttctcactctggtccaagatgccaccactgctgccactgccatcgccacctcctcctccttcccttcctcctcccccaagagaactatgaggaccaaaccactcagacactaagtggggtcaagcccacatgggagatggatttttacagagtatctcctccacgggcttcccattagctgtgaggttggagaatcaaacattataaacaaagcatgagtcctaacccacaagtggtttctcaactgtttggggagagagatgaatgaggagtaaacaaggtcctctgaacctactgataaaaagtacagagaaaccatcatcactgaccaaataacccagcaatggatgagcacaaaagcaacctggaagcaagagtcctcagtaaggaagatttggggggcttcatggaagatcaagtgggtgatggttaaggagaaaccacgaagagcgtagcctcagtaggtaacgtctgctccagctagagctcaccatgcatgcacaccaaacccagatgccgaaaaccaaaaaatacagcagaacgcacccaactcccaaaccactgagaaagtattttaattttgctttgatcactccagctgcgcttcagagtccccagcatttcagcagcatcatagaagaagacatcaatcactggccatggcacaaggaaactcctgcttggctatcgggctgctcagattctggatgagggaaagcttactttagtggaaaagaatgacttaaatgaatttaaattcattccacataatcgagttacatcagcatttctcatatgcacttatgaataattcactttggtaacagcaaaagccagaccagagaaagtcacttcaaagatctaagacttaacatcaatcctacctgaatttcctgctctcaactccttccctaaccactttatttccttctgccctatcactgaggtgctttgccagcctcctgtcctacatccgttatccctcagtaagctctctggaacttcccaattgcagccacctcctaatgtccacagcctcctcttctagatctagtttcgtaggcagtccctaagggtagggcccatcctaaaaagttcgactgcttcataccattccaagtctagaacatgtcctcagtctctagtagtgtttactgaaagccacggccaacagatctatccgaggtccccaacaaccttgtcttcaaaactgaatctcagagctggaaggaaagtcagtagaagaggccagatcgtgctttctgcaatagacaatggtgcttaagtgtacacaattttcatgcaaattcccccgatcatgaagctgggctgctccctatacttcttgtcatttgattctccaggccacctgcctctccagcccagctttataatggtaaggcactgatgagtttgcatttatttagatacactggagggattttgcgactggagttacaggaggctgaggagctggcatctgaaagtccatgcttcacgcttttcaaatgcactatgtataaccaagctcatttccaaaaacagaatctgaactagctcataataaaccattcaccttttattttttgctgaaggggtcagagcatcatcccaattaccatttctctctaatgaccacttactcccttcttacacattttcatcagctctttattctacactgagtatttccaagaattaggataacactacygcccaataagatagagttggggttacccaaataagcaacagaagctttccagtgggaccgagtcaagtcaagggtctcaagtccccccaccctaaagcactgaacacgaagttcagggagcctgtgtctgaggcctaagcacttgccctgcatcacaatgagcagaagacacaggaggcacgacagccgtcatcactgcacagccaccagtacacctcgaagccaattaatcctgcaaaacaaattcctctcaaaatggcagtctgttaggtcaagtttggctgttttgttaatcgcctatcaacagaaacagctttgctaggcacacccagaagttcatctctcctcatcacccacctttggcacccagtgacttttccaaggaggatctttttcccccctcagcaaacaagaaatatttggtgagctaaagaagcattcttctgagaaaattatacattctcagaattccattcataaaggactactggtcacaaaagaatggccaggggtaaggcaggggtgggaggaggaagggcaggagacccaacggatggtgctgcctggacagtccctgaagtgataaagagttagaaccagacacacacttctgcattcagctgctgtctttccttgtgagtggaaaaacacactcagtacattctctgcaatcctgcttaaaacctcttctaaagcttctttgacacagttattcaaaagcttctaaaagtagtatcgacgtattacaaaataatccaatcatttcaagttcactgaggaagagaacaaaaatatatccttacatcctatctgaagaatagtctaagcacctaataatatcatctacttagcaaagcagaaggggccattcagaggtcaagaaataggaacggaaacgttgtactaggttaccaccccaggaacaaagctggtcttttctaggacccaaggatctgactagtttccatttgtctctgcattacaactaatacctctgggaggtgggggtgggggtgatcctaattcaaacagtaaggctgcccaggaagtayttctaataatatcaaccttcgtctttccttttttgtactgtaggctctttgtctcctgatcttcttttattttgttccccctttttactactaagcccaactcctggtctcagcagctgctaaaacacgtccaagcactttgcatctatccggaaatccagaatggcagcctgggttcacagatctgctgccaagggcagatgtatscgcactgcagctgggccctcctccccaggggccccatgggcacaagcagctcagggtgggccagcgagcctcagtcacactggctgccctcagccccaccttctgcatgaagggtggctaagctccatgggccactctgcattaaccccaggaacggcaacctcactaacttcatccaggtcccttcattaggacttgcaaaaacaaatcagatgcagctacacgttggggcagtgggtgcagcttctctaaacaaggccatgggtatcaagcaaccgacagtccctaaatacgctgcctctgttcccatcccacatggattctgggaaaaatggcaggaagaaagaagagaggactgggcgcttgtttgtgaccaaggcaaagaaacaaaaagcgacttctgttcaataatgagatgaaacagaagcccggcttcgggcagaggcctggcattcctgcacaacattttcccacccacctgatccccttgaacggaaggaagacctaagggaggacagagagccagtgtttgtttcctgcaatgggggtgagaggaggaaaatgaaactaaacaaaacaggagaagaggctgggtgggagaataaagtggtacgcacatacacaaacacacacgcacacgtgcacgtgtgcacacatatacctagcgttaccaaagaagaggataaacaggcacatgcttcatcctggagcagatggttggctacctatgtgagacctaaagttgtcataaaaatgcacatctttgtaatctttaccaataactgtgcccactctaaccactttaatgttatccatgcaaacagacagaggcatttaaaaaatatggtatttaatgatttaatgtcagtatcatacaagaatctatggatatttcttaaatgctcccaaataccaaacttgcaaacaaaataaattcagtttcggaaccaaataaatagagtttacatatgactagggtgactccactggcaccccgatatagacatatgtacctcgctgaatgttctgtaaagatacagtttatctggacagacacaagaatttgaacagtacgaatcaaattagcaagaaccacacctacagtatggcccgctatttacaataattgaaattctacaatttagaaaagcaatacagaaggaccatttagttatggtagtgaacatatatagtcaacacagcttaagactcagaattttagatggtctyagaatgcaactcttagatagtttaatttaaaaaaaaaatagcagcagctgccaccatttaccaaaaacctatgtgcttggaaacatgttagatgcttttcaaatactgtcctattcctgtctcactgaaggaaggtgaggtctggcagctttgtcctagcaccacatacctgaggcaaacagatggcactatctcaaggcatcaacggtccttaaacctttgcatatgataccacttgtccacacaggaacgtagtttaaaagaaatacatcctgttctgtacaaaatgatgtattcttgcagatctcgctgttaatatgccatggggaaaacaagcaggggaaagctgtacatccgcatgtggagccacctaaacatcctgaagaccagtcacactgagagtgagggcaggcacaggatggtagcttctgcccccacggactccacaatattgtaaggaacagatgctcagggatatcaggggtgaggcctggccagccccatgacatcctgaaaacctaacagcggccaagctgaccccgcagaagaagtgatctaacctggatggtcacccttccctgcctaagactcaccctttccaccsgccccagaagcccttattcctccttgacttgaaaagacaactgtcccccataagccctcacacctcctaccaagctccaaggactgttctgttcttctgcctactcccgcaatgcagttcaaacgtttaccagggctctrcagtgagctacttttccaaagacagaaaagcaaggctatgtgcaatcagacgaaactccagctctcattgtaacatccagcttaaagccatatgttagccagtggcaggtacagattagaacccagaatggtctagattttgggtttctacttggggttccttcttccatataaatgatctctaaatttcttaaaccctgattcccaaattatacatgatgatcagtgtgccatttgatgagttatgaacattttaaatgctgcataccttgcctgtatgtactaggatcaaagaggagagagagagagacagagagagagaccaagcaacacgaacacacaggcagatcaggaagcaagaaatcttctcagagcagaccacggaaaccctcagtaacttactcaattttagagtttgaggaaacggcacaggtagtccgatgcaagccccccgagttcaaagaaaggaaatggaagtacagggcagacaggtgacgtggcaaccgtccctaggaaaggcactgctggacccagctgtccctgtccctcaccagcctcacatgccsaagtcccatgtacccctggggctgccatgctggctgctgagccatgggcgctggtttggagrtgaacttcttcgaggaaagcagcttcttatcccccagaagttctgcagatcatctgtgcactttggtttttacttaaaatgtgatttaaacagcctgctctacttaatactgcctgtgccacagacagaaaaatcccatctcccacccaccagcctccctggaacaaacaccttggctgtctctcgctacctccragtcaggggaacattccaacyaggatggtgctcagagaccccaccttttatagccagagtccctgattcacaccatatgcccaaaggaggcgtgtttctaagtgatgcttccaacttcaccaccagccaaacttaacttttgaaccaccctatacacgcaagttgagcaaggcaattcaggacaagattaaccacgggcccacacgctccacgtcatccccactctgccgagaatgtcacactggcatacacatgaggaaagcaagacagaggtattaacgcaacaaagaaagaggcttttcaagcacaggaagaaaccagaacaawtgtacaaataggtttaactggtgagagctgaaggggctccagatattttccaaatacttggcatgcaaaaatcaccacaagtcagtggttctgaaagctttttggtctcttagacgagatccctattaaaaacttctgaaggaggcccaggatggtgacaccatcactaatgacaattagccaaaagcaaagtctttgaggcacaaggcacacgccccaagaaatgaggtgggctaagccaggtcccagggaacctgcacacaaactgcttcaccatctcggcaacaagcgtcggcaatcaggcagaagagaatgtgagctccacgcctgactataaaaggcatagcaatgaggcctgggggcatgtgacccccttctaaataaagatcacccccacactgggagcagctgaccagagcagaggccttccagggcaaccgagacaagttcctaccaacaacacaaagccagatgcccctctcctggctgccttctcctccagggtccacaagcccctcccaagagtccacctgaaaatgcaagcctgtgtcatgatcgtcttagcagtctggggaacagtggcctgcagaagaccagcagcagaccacacagtgcttaacagaaacatctcagctcttcacaagtagcttaagtttaaaaaaaaaatgttaagatgaaatactgcacatcacatgagtgaagtctcactacaaagacaatgtgcccctcttccccccatccagcaggtgatttacacattctttttttattattattttcctttctcaaagctagccataaaacttagttacaaaatctttttttttttttctcagacaggatttcattatgtcgcccaggctgaagtgcagtggcacaaccacggctcactgtaacctccatctccccaggctcaggcggatcctcccatctcagcctcccaaagtgctgggactataggcacgtgcctccacaaccagctaattatttaaatttttttatatgaacaaggtctcaccatgttgcccaggccagtcttgagctcctggactcaagcgatcctcctgcctcagcctccccaaatgctaggattacaggtgttagccactgcgcccagccttcaatttacacattcttaaacaggtcctccactttgatctagcaggtcagccacaccaacctatagaggaaaacgagggaaggagagcgcctctactccgcaagacaacactgcccttgtgagcagtggctgacaaacaaggatataagaacgtggcggtggaaaaatgtagacttttttttttttactacaacctgccttcattttaagtcagtgagatgccatcagtgagatggcagtaaaatgttttccttttgtcaataaaaacagccatttactgccttctcgaaggctccaatctgctattttcctggtttctcattttgagggcaataggaaatgcaacaaactccaggactgctgctcccagtcaatgcccttttaattgaaataaggctgccccaccagctaagccagcttccaacacagcccggccctgccttcctggatttcctggcaaagcccaggccttctcacacgcactcagggtgatctgagcagaccacaggctgttcatcccawtgggttaaaaagtacttggaracttagttgcagtaaggtcttaggttttgttggggttttttttgtgggaaagtgaaggcatctgcacctgaaatgaaataccagaaagcctccacagcaagcaaacaacaggcacttaggtaaattcagcaggaagtaagaaaaccacaggtactcaggaggattcacctccgtccctcccagggcagaactggccttcagcaaaactgccttacaaagtcatgaatggcttcacgtgccaagcttcaacctttcagatgatttccatacttctccatcatctttggcctggaatcatccccacaatggcaggaaagaaaagagctacccgccatagtggtcctctctgccaactaagagttgcagatgattctggtcagtactcctcagtagcaatgacagcaacaatgacacagtaaacatctgcatttcataatcctggtacaactggctcaccgaagactgccaggatacgcyactctctgctcaaggggaaaatgtatcttccgaacaataaatccttcactaagcagatgcagtgcttgcccttggggtgacagcatacagtggaggatacacccagaatttacagtggggcaaaaagtgtcccatcaggtgctgggagacaggcctcccgaaatctgcagagcctttacatccttgagaggaaaaggcaaggctagagttcggccaggtgagccgtgccggctggtcagcacgggagagcaccactggggccaaggacacagcaggcaggcgggagggagtggcacatggagtgtggcatgttgtcacggggtagctgttgaccactcaggagcttcacactgtaccacatgcctatcctatagggacttgctacaggatttcaggtaggggagctcatcagtccaaagtgcacactagatggccgggcgcagtggctcatgcctgtaatcccagcacattgggaggccaagaccggtggatcgcctgaggtcgggagttcgagaccagcctggttaacatggtgaaaccccgtctctactaaaaatacaaaaattagctgggtgtggtggtgcgggcctgtaatcccagctactcaggcggctgaggcagtagaatcacttgaacctgggagcccggaggttgcaatgagccaagatcgcaccactgcactccagcctgggtgacagagtaagactctttctccaaaaaaaaaaaagtgcatactgaaaagctccccagtgctcggtggagccacaggacacaatagcaggagagaggctatgtcactgctgtaagggggaggagcagaggaacacagctgaagcagcatttccattccattcgggagggaaagggcctggtatccaactggagaaggaagtgtccaaaggacacccacattcctgacataagaaccaggggaacaaaagtgtggcccacttaagagggaatagaaaagaaaaaaaataggcaaaagtgaggaaacagggaagaccatcagaggctgtagtgaaatgctcgtggtggtctgatatgaatgacaagtcctgggttcaaaagggttctgggatggatatgaatgacaggtcctggactcaaaagggttctgggctggagatacttggaagtttaggtggagacaggaggcaatgcagttaccagtggatgagatgagaacaaggaaagtgaaaagagagcccaggacagaactccagccatgctatgatctgaatgtttatgtcccctcaaaattcttatgttgaaacctaatccccagtatgatggctctgggaggtgattaggccatgagggtggagccctcacaaatgggattagtgcccttataaaaaagacgccagaaaaaaaatccctcgccccttccaacatgtgaagacagtgaaaaggtgcttctgtgaaccagagtgtgggccctccccagacagttaatctggtaagcaccttgaacttggacttccagcctccagaactgtgagcagtatttctgttgtgtgtaagccactcagggtatgggattttgttacagcagcctgaatggactatgtcaggagaccaccgttaaaagccagactgagggaagggagacagagaagcggcacctgtgggggtaggaagagactcataagagggtggcgttggaagacaaggaagaagaatcaaccacaccacatgtcagggggtgccacacaactatgttcttactgaaaggaaaccactgtacacagttctttaagggtcaatcgctctttaggaatgactcaaaaatgtataaaatccactcctaaatccaaaaagaaccgagaaatacagaagtgtgcagagaacccacagagggatcacgtccatagagggagtagagtctactacgctgccagacactgcagagtcacggcacagaaggagtttaaaggacagtgccaagtgaaaaccgcgcaacagcacgacaaaatcgagtaggctcaacgatttcacacacacccttgacgtgtttctccagatgttctccgtagttctacagccagccaacagaagattacctgaatgggattcttctgtgcttaatgttttcgaatggccatcttaatgcttatgttgaactcaaggtagccattctgcctggactcaatgcccttcatggagctccccaaatgattcctaagggttctggctggagaggtacatgcggggctatgagcgctgcagtgacgactcagccaaaaagatgatgaggggaagaactcctggtgttaaaagaaatgctctaaagcagcttaccaacacagaatgcaagccacatctgtaattttaaattttcaagtagccacattaagaattaaaaagagtcgggcatggtggctcacacctgtaatcctaacactttgggaggctgaggcgggcggatcatctgaggtcaggagtttgagaccagcctggccaacatggtggtgaaaccccgtctccagttaaaatacaaaaattagacgggcatggtggcacatgcttgtaattccagctacttgggaggctgaggcaagagaatcgcttgaacccaggagacggaggttgcagtgagctgagatcgcgccgctgcactccagcctgggtgatgagagcgaaactccgcctcaaaaaaaaaaaaaaaagaataaaaaggaaacaggcaggtgaaatttaagaacacattttacttaatctaatatatccaaaatgttatatttcaacatgttatcaacatagtaattattaatgaaatggtgtacagagtttttgctatactatgtcttggaaatctagtgtatattttacacctaaagcagtcccaattcggacaagccacagttcaagtactcaataagccacgtggcttactcaataagcggctaccacactggacaatgcaggtctaaatggaatctacgcaaaccaagaggaagttctgattcaactagaaaatctccaagaaatatgcccatgcctgagttttcaggacaaggggaagggaagtcaatttcccggaaagcagttaccaattttatataagtactccattgtgaaatcacaaggaacatcagcagggctgggatggtcaaggagaaggctgcagggcgtggccttggggaagcaggtgaccaaccaacaggtgatatcaaggctctgtctgtcaccagcagagcccaccttctaaccatcgttaacattttcacggtgcttttccttcctccttttcatcttccaacagccctatgaggaaggcaggctttaccccattccacatatgaagaaaccaaggcccaggcaatttaaataacttgctcatttctagtcgccactcttagacttggacccagaatgcaggcctcacccctaccccaggggtcttcaatcagtagctcatcagaaacagccaaaaacctatggcaagaccaaagtaactacctacctagttcgtgaacaactctccacttaatgacgtttcatatggcacctcccttctctaaagagcttatgagttttcaaaacatcctcatgcccatatatgatcaccactaagggatgtactggactgccctagaaatatcctaaaaaagcccaactacagcccagaagggctggcccatccaaggtcattcctggccctcatcaccacattcaacatctcttttctactccatgctgcctcccttgataacaccttttacttttcagataaaatttttaaatgtcaaggttatttaaaaaatatattttgttgttttctcaaaccagtgggtaacttaatgatagggcagttttaatcaaccacacaagtgactttagcataagatctccctccaactccagccaaccttaaagtggcctgactgcattctcagagctctacaaggtactggctgcagccagtgggacccctgccctcactaatcaatgttcacatacgcactgatccaattctgcagaatagaaaagtgcgtggcagatcagggtacacagatccttttcctgcctcaggactggttgaacgggaactgaagggctacctgggaggtctgtcctttatttactttacacacttcacccctgtggggtctcgccttttatttattttaggcaagtctaacaatttggggtttcttggttcttcataactagagaacatgggttccttacatctttaactgggccaacacttaaataatagctatttatagctaacacactgacttcaaaccagtgaggaaaagcttcctagccaatatacataactattgctgaatgcaataaggtgaaggctcagagtcacattttaataccaaacagcctggttcttaaggaactgatcacatgaaggcaagagctcagttattctcaagggaaaataagcatattgcagataaatatacaagaagcttcaaaataccaccatctgacccccagaacagtaaatactttccaaagttccttcactcgtgaaatcttaagattttcacaactgttcagtaaacaggtataaaagaacgaaaacagaatcccagaggtttaaaaatgcaccctgctacacagctacctgcaagtacagcctgaacctgggacttgcagaaatgggtccagaggtctcccacctgggccaggtgctctgtcataaccaggacacctgagtatcataacatcatcactaggacctaaggaccactttcacaggatatgagttagtgctttaccttccctttatttaaccatattccaagtccattcaaactaaggaagtcctgcagaacaaaaaatatcacttcgcacaaaggatgaaagagctgacacataagcagcccccagctgccaaggctcagggacttccaagcacaccaggtcacctttctcatcaggaattcaaagctgaaggtcagcaagtgtctagcccaggagtgtgctggattatttctaacatgtgatttgaacagtcttgacagcagccatgatggcctccagccacgccacagtcccgcaatccaagagtcccagatgcaaaggaaagccaaccaagacccccactgggaaccacttccgcacagcaggcatgccacgtcctaaatgcaacacgactgcaccctgcccagcggaactcgtgcactcagaagagaagggaggtcaaggaggaggagaggagagagagaggcagagagaaagcagcagtcagcatcattcttacttttctggcagcggtttgtggtccagcagcggtagttgtactcattgttgatggtggtcttctcacacatcggcttctcctccatggtccctggacacaggtccccacattcctttgggggcttattccccacaatgtagttattggacaccgcatccaggatcagggaccagtccacagtggagaggtaacagaggtcagcatttttctcaatcctgatggccccccgagtaatgttcctcaggttgtaaagcccaatatccttgagattggtcatctcgaagatgaccagggcgtagttgtagaagagtttccagccgcggatgaccgtgaggttggggaagaggtctccgaggctctcgaggccagccactcggaacagcagcaagtactcggtaatgaccgtgagcttggggaagcggtagctgcggtagtcctcggccttggagatgagcaggatgtggaggtagccctcgatcaccgtgcagttctccaggcgcttcagctgctgatagtcgttgcggatgtcgatgcctggcccgcagactgaagggagacaagagggtaaacgtctcagttagaaggaaataatttttaaactattttccaaacaataatacagttggttttcaggaatcctgtattattattaaagaaatgaggttcaattgttcactgcagagctgtgggttgcagactgacagtttaggtggctaaccagttagctggcatttatacagtgccaacactggaccagacgctgtgcaacacactccaaccgaccatgggagaggccatccccgttaaccgtgcaaactaaagcttacagcccagaggcacacagaggcagaggcgaaagttaaatctgcaacccaggccagccggactccaccaccgcacactcctggtccgttctgcagagcgtcagttgccaaggcctgaacgacagctcag

SEQ ID NO: 17617 - DNA, 199130 bp, Homo sapiens
  misc_feature (1)...(199130): n = A,T,C or G, or insertion/deletion polymorphism (see Tables 1-2)
tttttaataacttagcaccaaggtaactcaatgaaggaaacaacaaatgatgttagaactactatatatttgtgtttcaaaaaaaactactctcaacctctaccttaaaccatacacaaaatataattcaagaattcattcaggatacatcacagacgcccatttagcagaacaaaatatggatgtctgagtacctgggtactccatggcctctcaagtagttaaataatttatttttctaatgtaacaacaaaacattacagttttaacgtaatttgaccaagccccttagatcaacaggtggctccactggggctgcagtgagctatgattgtgccactgtgctgtagcctgaatgacagatctagtccctaaaaaagggagtaggggggaaggtagattaaatgcgagatatttggtcagtcattggtcaaacactgctaagcactatgacagacaaaagtcagccaatagcttcgtttatgagcccacaaaatcaatgatcacagttattatgtgatcatcactgtgataacaattgaaactcatcttaacctcaaaatttctcacaacaatttcctaggtgcaaatacctgatcaaactctataagagcagtctgctcttataaaagtctataagagcagtctgctcttataaaagtctataagagcagtctgctctgcaggaaaatacataattatcacattgcacattccaccttcccagagtcatctaaaatttagcggcgtgctggtgaaatgcttaacagtcggctttaggcaagggctgatttgtagtgtagccaatttccattgcgtattcattcatcgtgagcatgacattactgaattgtgaaactactgaacccagagatgggaagagacgcacagtagagcaccatagtatagtatctcctccacaaagatacaatagatgtataaataacctcaaaagtaaagtaacaataaaacatggtaaataataaaagtgatgagtttttagtattttcactgcctttgtttttaacataatttacgtaattttacgtttatatgattgagttttcaatgatggctctgtttagcaatgggatcccgtgagtcagtactaaattaaatacaacctaaacattcaaaatagggtaagacgcataacttaaagacgtgctccactgcgaattacacggaatctttgactatgccgactaaacagaaggctattcctaagtaccatcccatatgtgctagtttttcaaaaccaacaataaagcagttggggaggtgccttgtacacagaatgacgccacgaggcatttgagatgaacgtccaaagggacaaagaagccagaccgcttccgagaacggggacagaatgtcttcgggcttctgcgccgggggcggcgccggaaggctgggtgagctccactggagacgacaccccagggtggttaggccccagacacgcgcgtgaccttggccggaccctgggagcggctgagccaggggcgatccccgagcgccctccccgtccccgcgccgcttggactccccggggagctcggtcgcgactggcgggcgcggagcccttccccttccggagcccaggaaggcggctccccgcggcgccggccgcgcgcgcgcccgcccttaccttgactggacgcggccatttcggtgagcttgtctcgcgaggacacacgtagaggatctgcgcggtaggccgcggagtggcgcgcagttgtcgccaccacttggcttccggcacgtggggcagatgtttccattcccacggcggcagcggaagagggagggccgggcgcgccgcggctgcttgcagtctccgcaagcggctacatcacagagctcagcgtgcggtgtcacaggccccgcggtcccgcccaacagatgcaccgagatgcgcgtgcgcagaaagcgtcccgggggtgaggctccctccctcgctctccctctactcccgccccactctcccccactttcccccctccacccaccgcggccgtcggggctcgctcgctcagtacctggaggcgagttcctgacgcgactgcgactcaatcctcgcctggtgaagaatattttacctatgactcactgaaaataaagacggctgagtgaccgtgtttgttcatgtaaacattgaacaaatatttatcggcttctgcgatgtgtcctactcttttagtggaggaagacacattttatttatgtatttaatttttcttttgaattttacatgcgagttatacttaataaaactcacttcaaaatataccttcaacagaaaatccagcaacagtttctattatgttagttaaaacagccagtcttttcctttacttttaaaaattattcataaatgtaattagtgaatgataataaacattgacatctgatccactgctttaggagtgacacaaatgaagttaactcaggctattttctttataatcattgtgctattgttttctttttcttttcaattatactgcttaatataggattttgtggcaccataggagttgagtaaaaataaaaggaataaaaatataccttatctggccgggcgcggtggctcacgcctgtaatttcagcagtttcggaggccgaggcgggcggatcacgcggtcaggagatcgaggccatcctggctaacatggtgaaaccccgtctctactaaaaatacaaaaaattagccgggcatggtggcggccgcctgtagtcccagctactcgggaggctgaggcaggagaatggcgtgaacccgggaggcggagcttgcagtgagccgagatcgcgacactgcactccagcctgggcgacagagtgagactgcgtctccaaaaaaaaaagaaaaaatacgttatctatgaagatttccaatttgatttctatttatcacaaatggccacagtactcctttgtactttaccacataccatattgtattcagtaattatttgtgaatatgtaattgataatattgtaggttttagagaatccttgaaaacatgaaaatttggtaatggggtctattttgattatttatttatttatttatttattttatttttgagacagagtctcgctcttgttgcccaggctggagtgcagtggcgcgatctcggctcactgcaagctccacctcccgggttcaagcgattctcctgcctcagcctcccaagtagctgggactacaggcacgtgccaccatgcccggctaattttttgtatttttagtagaggaggagtttcatcttgttagctaggatggtctagatctcctgacctcgtgatctgcccgcctcagcctcccaaagtgctgggattacaggtgtgagccaccgtgcccggccatattttgatttaaaatttagcaataatagataaaattttcaatcaactaagcccttgggccagggaatgctattccttaaaaagtgcttctatcaatatagcctctgactcattactttgttaatttttaaattgtatttcattcctgattaacattcccacccagattattaattatacaatctgttaactgtagaacctcaaacatgttggattgtactgtatttgtctggaagacacatttttaaaacattgtaatcgctataagagaagcactgggaaagaaaggagcttctatgcctgcagtgcctgaggagccctttaacagtgtgccccgcccctaagctactcatgcagtcatccccatcccagttagtcaactttattccaaaaaacttggtgttccaaatttttccttctcaaagcccacagatccaaaattcatcagcagttcccacaaacgttaccctcacaatgaatccagccatttttcaccctctccagtggtaccatcatagcccaagccgccaccatttctcacccccggttaacaggccaccctccttctacccttatcctgctagagtttgttttatctacagtgatcagaaagatcagcctaaaagataattctgatcaccaccctcctctactcacaacccggccgtgtctccccattgccctcagtgtagaagtcaatgtccctttgctgaaatgcaaccttagtgaaactttccatgactaacctcctttaaaattgcaacctggtccacccttactcccccttaccccacttctcttttttgcacagcacttattttaccttctaacatactgtataatgtactcatgtattgtaattattgcttatcatccctctttcagttgcttatatttttcatcaatgtgtacccagtgcctaggacaatatctgtctaggacaaatgggtagttatgtggctgtaggcaagccatttaacctctctgtacctcagttactttatctgtatccactttgcggtgttgtcatgaggattaaatcagatagcctatgtgtagcacctggcagtgaatttatcaccctgtactgtaactgtctacttttctgtctcctccattggactgtcattcccagggggttgggaactgggatttcttcatttctgaggcatagaagtatagcatagtggttaggagcatgacttctggagccagagtacatgggtttgaatgctaccactcacaagctgtgtggccatggagaagttgcctaacctctccgtgcttcagtttcatcacccataaaatgaaggtaagaatagtacctgtatttaaaagcacctagaacagttcctggcatatagtgtcagctgtcatctctgcatccttgtacctgtcagagaggagtgtttatcaaaggggcttcttgctgcctgtttccaaaccagtcgacaatataccaattgctccctaacacattcttgtttgtgcagaactgagctcaatgataacatttttatagcaaccctgatcaagtttcttctcataatctcttacactttgaggcccctgcaggggccctcactctccctaataaacattaacctgagtagggtgtttgagctcaccatggctacattctgatgtaaagagatatatcctatacctgggccaaatgtaaacagcctggcaaaagtgttaggttaaaaacaaaacaaaataaataaatgaataaatgccaggtggttatgagtgctattgagaaaaatgaagccaagagggatatcagtgatgcaggtgggggtaaagagcttacaacataaatgtggtgttccatatttaaacctcattcaacagggaagattggagctgaaatgtgaaggagttgtgggagtggaactacgtggaaatctgggggaaaggtgttttgggtaaaagaaatagcaagtgttgaggtccaggggcatgagtgtgcttgatattttagggaagagtaaggagaccagtataaccagagtgagatgagactacagaggtcaggagaaagggcatgcagaccatgtgggatgctctaggacctaggccatggtaaagatgtagggttttaccctgatggaggtcagaagccattgaaggattctgagaagaggagtgacaggactcgctttatagttttaaattataactataaattatagtttttaaaacaatagttgcctaacctcatgttatatgtaaaactacagttttaaaaactataaattcctcatactggcagcagtgtgaggggcaagggcaaaagcagagagactaacaggttgctggttactcttgctagtgcaagtgaattctagaatcttcgacaacatccagaacttctcttgctgctgccactcaggaagagggttggagtaggctaggaataggagcacaaattaaagctcctgttcactttgacttctccatccctctcctcctttccttaaaggttctgattaaagcagacttatgcccctactgctctcagaagtgaatgggttaagtttagcagcctcccttttgctacttcagttcttcctgtggctgcttcccactgataaaaaggaagcaatcctatcggttactgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatrcaaatagagctctccacctgcttctttctgtgccttttgygattctgctttagkgccaccasaagatrctrccbgggtgcagtggwactgtcakgggaytatatgcaaagtgatctcggtgagctgcctgtggacgcaaggtaaaggcatgtcctgtagggtctgatcggggccaggattgtggggatgtaagtctgcttggaggaaggtgcagacatcgggttaggatggttgtgatgctacctgggccccaaagaaacatttctgggtaaggtgtgcacacatctgtgttattagcagaaatgctaactgccaattcttttcataggtctgacctatttgttgatattttgttctgttttgtccattgcttctcttcgtcatatgctgctcctccagaatctagagactggagtagagggagggtgaagggacaaagacaaaacttccctctgcctgcccaagcttccatagagagaatcaaggcaatgaaatccaatcaatatcacacacaagtttcatgtctggttctcttgtgtgtacatgcaatgtgtgtttttataatatcttttcctactttgggtgtaaggataatatgagccttgagttcagaagcttttcgtgttttgggggttctggtgcatttaggcagagtattaaataactttatcaatattgtctatggtcatcagttgattcagatttttctacctcttcttcagtaaatattggtatattttggtctatactttcatagaaagcaatctactgtccctagatttgataatgtattggtatcaagttatgtaagagtctcctgtgattttgttaaactgttctgtgtctgtagttatattttctttttcattccttatgttgtatatgttctcttcctctcttttaaaaataatatttccaggagttttcttgattttattggtcttgtcaagaattttcttttggtttgatttatcaatctcttttttctttctgttgcatcagtttctgcttctactttcattgatttattccttccttctaatttcctttggttcattttgttgttagatttttgcttcttgagttgaatgctgaaatcatttattttatttttttgtcttctttaaatgtgtattataaagatttaaatataatacatagattgtggctgtgtaaacattaaatgtggtcatgttgtacatactttatattctttttggttctttctgtttggctccccaccctctttccacatcagtccccttctcccccacctcagctaggtaaccccagtatgataatatatattcacatacacatacacacacacaaaggttttcttggacattatttgttttataaaattgggacattatacacacatttctcactcattaacacgtactagaactctaagtcaattggtatagctttaattcattatttttattggctatataagattctatggtatggctgtatcacaatttagtcaatatgttcactttattccagtttttggctactatatcctatatcattacatactggtgcttttacttctgttgaacaaacttgcaagaggaatattaatggaacgaagggaatgtttccttctaagttttaatttccaaagaggtcagaacttttcaaacatttctaccatcgaagtatgaaaatggccttctctctgcattcacatagcgataagttttatcctgtttttaaaatttgccaattttacaggtgtagagtgatattgcatcattactttcattgtgttatttttatttmtaataagttgagcatctttttaaatgcttgttggctattggatttatttgggggatttaattagtcatatgatttgcccattattctttggactctttcatttaaaaaaattatgagaacccttttattattacaaatattaactctttgtcatgtatattgcagttttccccaagatctattgtttgtctgttgactttcttataacttttaccaaaacagtttttaatttttataatcagagatatcttttctttcatatcttcagagtcggcaaggttggttaaaaatgtttcccacacctcaagattgtacgtgtaatctcccagattttcttgcaagatgtttactgtttcgctttttatatgcattgcttcaattatctgctaattacttttgtcatatggcatgagagagggatttgtctagttttatttccatccagatcaatagcctattgtgatggcaccttttgccactgatttgaatcaacacattcatcatataaagttctcatatatattagcatatatttctggattcattaggctgtttcactaatctactattatcttgctatgccagtaccatagtgatttgattacagtgagcctatgatatcttctgatatctggtgggtgaaagcaatcctcactattctttttgtacctttcttagctattcttagacactttattcttccacataaaactgttaagatatttttcaaattaaaaagatccaagcyctgttgtgattctaactgcaatttcattaaactcagaccttaattttattaatgtaataaatttaaatatttttcttattacatttatctctgtgtattttataagtgtgatgctattgttaataagatagttttctcctatttccatttatgagtgcttagtaccaaatagagataagctatkggtttgtgtattttcagctttttcttttgagcctgggtctcattttgtcacccaggctggagtgcagtggggtgatctcaccttactgcagcctcaacctcctggattcaagcaattctcctgtatatcagccccccaagtagctgggactacaggagcaggccaccatgcccggaaaatttttgtatattttttagagatgggtttttgccatgttacccaggctggttttcaactcctgagctcaagcattccccccacctcagcctcccaaagagctaggattacaggtttgagccaccgcacccagccattgtatattcatcttaaatctagctaccttaccaaatttgcctattaattctagtaattttaccctaaagtctctgtgagtattgaatcatatcataagttaaatgagacagattttagctcatttccaatatttatagccagttatttcattttcttatcttattgaatttattagaaaacaagagcaaatgttaaataataacaatgaaagtgaacattccttctactctatgattttacttgaaataatttttgtattttgctatttagagtaacatttgctgttttggtttttgtaaatggtgtttattctattctcatttgccacaaaatgtttatcataaataagttttcagcagctggtatcatctgaattgtcttctttgatatgctgatgaacaaattatgttcatagatgtcctgacactaaatacccttacattcttggagtaaaatctactattcatggaatttgatcattagtgggttctatgtactatttctttagactattcttagtagattttcactactcaacctactaataataataaacaaagttttgttggctttatcaaatgaattgatgagtactccatctttttctattgcttagaatagcttaagtaacatttgaattatccattgtctaaaagttaggtgagactcacttatgaatccatttggtcctagtggcatttgcaatatctttaatcacccctccaggctcttctatgataatcagtcaattcaagtttcaacttccaataattatatacctttctaggaagtaactttatttattttttcaattttgttgccacagtgttgcatgtagcactcactcatgattcttttactccacattatctgtagttatgtgccctttcttattcctaaattcctctatctttgctatttatctttttttccttgaataagcttgccaatgacttgtctattttgttgctggtggtgctcttttcaaagaatgggcttttggattttttttttttctagttggtataaagcatttttattttcactgagcagaaaaagaagctattgattcattaactgtgctgctttattggcatgtagctatgcactgttcacacattaatatataaaactcgtcagtctgttttattttgtctgatgggaaaacatgaacagtgagatttcttatgcaaaaagtgaacagttcaactatgctagctccatatacctttattaacattccagagacttatcctctcaacatgatctgatttctgtaggataacttttcaggaaaagtattttctgatcagtgaagcttggagatataaataagcaatcggccaggtatggtggttcatgcctgtaatcccagcactttgggaggccgaggcaggcagatcacctgaggtcaggagtttgacaccagcctagccaacatggcaaaactccgtgtctaccaaaaaaaaaaaaaaaattagctgggcatggtggtgctcacctgtaatcccagctactgaggaggctgaggcaggagaattgcttgaacctaggaggcggaggtggcagtgagctaagattgtgctcagcctaggtgacagagtgagactccatttcaaaaaataaaaaaataaaaaaaagcagtatctctcatattcattaactggaccctgactttcttaaagctcaccccaaagctgaagtccatgaaggcactagttctcaaacttcagtgtgcataagaatcactcgggaagcttattaaaatttacattcctaggccccatcctcagcaaactatttagtccccaggtaattctatcccaccccaccccagctttattgtggtataattgacaaataaaagttgtatatatttaaggtgtacaagataatgttttgatgtaagtatacattgtaaaatggtatagcatgaagggttttcttttcatttttttcagaatagtttgtaatatcttctttgatttcatctttgataatctagacgtatgattttaattgctttttaaatttgtttatcaagttagtttgtagtatttgggtcaacattgaatatcctgttaatttcctattgctgtgtaacaaactacatcaaatgtatcagcttatgacagacccatttactgtctcacagtttctgtgagttagaagtccaggtggactcagctggatactctgtgcagggtcatacaaggccaacaccaaggttttaatagggctgcactccttagtgaaagctcttggggagaatctgcttacaggctcatttggaatgttagcaaattcagttccttctctcactttccatgtagtgccctctaccagcaatggtgcatcaacactctctcatgcttggaattgctctgacttcaattttccgtgcatatctctggccttttttgcctctctcttttacttttaaggactcatgtgattacattgggccgacctgggtaattcagaatactctccccatctcaaggtcagctaatcagccccttaattccatctgcaaagtttaatttgccacataatatatttttggacatgacaccaaggagcaaaggtgatgtgggccaaatttttacctgccacaggtatagtttacatacaatgaagctcatcaattttaaatatgcagtttgatgagttttgacaaatgcatacacttgcataaccaccaccctaatcaacatgcatttacatcaaccctcctgcaactttttaatgagtctctcccactgacctggcctcagccaataaactgctatctggaagttacagatttgttttcacatgttctagaattttacatcagtggaatcatacggtatgtattcttctatggctttttttcttcagcatcatgatttggaaattcatgcaggttgttgtataaagtatttctatcctttttattgctgattactgctccattatgggattatatcataattttggattatttccagttaggagcaaatacaaataaacctgctatgaacagtgctccacatgttttgtgtgaacatctattttcatttatcttagttaaatatctaggagtggaattgctggatcatatggtaagtgcatgtttaagagaaactgccagacagatttcttgaacgtaccattctatactcccaccagcaatgcatgagagttccagttgcaatatatcctggacaacatttgatgttgccagtacttaatgactgcacagtggtatctcactatacttttttttttttttgagatggaatctcatcccatcacacaggctggagtgcagtggcgcaatctcagctcaacatctgcctcctaggctcaagcaattctcatgcctcagcctcctgagtagctaggactatggtcacacgccaccgtgcccagctaatttttgtatttttggtagagacggggttttgccatgttggccaggctggtctcaaactcctggcctcaagtgatccacccgcctcggcctcccaaaatgttgggattacggcttgagccactgcacctggttatacttttaatttgcgtgtctctgatgactaaagatgttgagcatctttgcatgtgctaattagccattcctatatcttcttggaagtgtctattcaaatcattggtcctttgtttttaaacgtagtttcaacttttattttagactgaggaggtacatgtgcaggtttgttacatgagtatgttgcatggtgctgaagtttgggttacgaatgaatgatcctgtcactgaagtagtgaacatagtacccaataggtggtttttcactccttgctacccttcctcctccctctttcctctagtcatctccagtgtctattattctatgtccatgtgttctcatcatttagctcccacttctaagtgagaacatatggtatttggttttcagttcctgtgttaattcacttaggataatggtttgccagtttttaattgggttgtttgtcttgttattgttgagttttgataattttttatatattctgggtacaagactattcagaggtacctgttttgaatgtttttttccaatctatggcttgcattttcattttccaaatggtgtctttcaaatagtggaaatttatagttgtagttaagtccaatttagcttttcttcttctatgattcatgcttttttttcccctgtcctaggaaatctttgcccacctcaagttcacaaagcctttcttctgttttcttctagaacttttatcattttagcattagtatttaggtttataatacattttgagttaaattttctgtatggtgtgacttttctttctctattgaattcccttggtgcctttgtagaaaattaaatgactgtatataggcaaatctgtttatggattctctagttccatagatgtgtatatctgtgcttatgccagtaccagattgttttgattgttgtaactttatagtaagtcttaatatcaggcagtctaaaacctccaacttacttttttattgaaattgcttttgatatatttaggcttttatatttctgtattaattttatagtcaactagccaactccaccaaatagccaactgggattttgactggaattgaattgaatctgtagatcaatttggggagaattgacatttaaacaatactgaatctttcaatacaacaacatggtatggctttgtttctttaaattttctttaatttccctctaggatattttgtagcctacagagtagttcttgcaagaattatattaattgtatccccaagtattttgagggattcgatgctattgttaattgtatcatttttatttgttttcgttttccaatcatttgttactaaaatatagaaattcaattgatttttgtatattgaccttgttcactctaatcttgttaatttgcattttagctctagtagcgttttgcacttcttttagaatttctacatatacaataatgttgtctgcaaataaagacagtttgcttcttcctttccaaactggatgctttttattttttttttcatgccttactgtactggcaagggcctccagtacaatgttagatagaactgatgatagcagaatccttgtcttcttcctgatttcagagggaaaatattcattattttaccattaagtacaattacttgtaaattttttcatagatgccctttgtcaaattgaggaagtttccttctattcttggtgtgagagtttttatcaagatttgatattagattttgtcaaatgctttttctgcatctattcaaatggtcatatggtttatcttgtttattctgttatggtgaattaccttgattgattttttaatgaggaactagctatgtattcccagggaaaaaatccacctggttgtgacatattacattggtaatattttcgctatggactgaattgtctccacctccccccaccccaaattcatatgttgaagtcctaactctcaagatgattatatttggagatagggcttttaggaggtaaacaaggttaaatgaggccataaggatggagtcctaatctgataggactggtggcctcataagaagagagaaggttctctctctacactcatgcactgaggaaaagccatgtgaacatacagcgagaaggcagccatctaccagctgggaagagggctccactagaaactgaccgtgctggcaccctgatattggatttccagcctccggaactgtgagaaaataagtttctgttgtttaagtcacccaatctctagtattttgttatggcagccctggccaactaaaactgttttgttaagggttttggtggtgatggtggttttttagtttttgcgtctgtgttcatgatggatatttggctgtgattttcttataatgtcattgtctggttttgatataagagtggtattagtccgttctaatgctgctatgaggacatacccgagactgggtaatttataaaggaaagagatttaatggactcacagttccacatggctggggaggcctcacaatcatggtggaaggcaaaggaggagcaaagacacatcttatatggcatggtggcagacaagagagcattgtacaggagaactgccctttataaaaccatcagccctcatgagacttattcactataatgtgaacagcatgggaaaaccccactgccatgattcaattacctcccacctggtccctctcacagcacatggggattgtgggagctacaattcaagatgagatttaggtggggacacagccaaaccatatcaaagagtaagactattcttttttttttttttttttttttttgagacggagtctcgctctgtcacccaggctggagtgcagtggtgcgatctcggctcactgcaagctccgcctcccgggttcacgccattctcctgcctcagcctcccgagtagctgggactacaggcgcccgccaccacgcctggctaattttttatactgatagtagagacggggtttcaccgtgttagccaggatagtctcgatctcctgacctcatgatccgcccacctcggcctcccaaagtgctgggattacaagcgtgagccaccgcgcccggctgactattcttataaaatgagttgagacgtgttcactcttctatttaatgaaagagtttgtgtagaattggtatcatttcttttttaaatgtttattcaccagggaaatcatcttatcccagtgttttttgttttggtttggttttttttttaagggtctttattgtgaattctatttttaataggtaaagggctatttgaattttctatttcttataggataaattttaataatttcttttaagaaattccatttgagactgggcatggtggctcacacctgtaaccccaacactttgggaggaggcagcaggattgctctaggccaggagtttgagatcagcctgggcaacataacaagacttgacttctacagaattttttttcattagccaagtgtggtaacatatgcctgtagtcccagctacttggaaggctgaggcaggaggatcacttgagcccaagagttcaaggctgcaattaactatggatcatgctactgcactccagcctgagcaacaaagcaaggctctgtctcaaaaaaagaaaagaaattccatctgagctgttgaatttaatagtataaagttcagaatatttccttaccattttttcactccttggaggtatgatttacatactgtaaaaatcacttattttcagtgtggagattcttttcctttcctaaatctccacatttttattgacatatactttacatatcataaaattcaccatttgaaagtgtacaattcagtggtttttagtgaatccgtaaagtgtacaactatcatctttatttaattccagaatattttcatcacctcaaaaagaaaccctgtaatcattaaacagtcacttctaattttcttcctttccccagcccctggcaaccattaacctactttccgtcactgtggttttgcctattctggatatttcatgtaaatgaagggataaaatatgtggccttttgtgtctagcatcttttgcttagcatgttttcaagattcttccatttttgcagaatgatagaggagttaaaataagaaaataaagatatagtaagaatgaaactattttcattttttaatttaaaaaaatcttccatgttgtagtatgtatcagaatttaactcctttttatggctgaataatactccattgtatggatagaccacattttgtttatccattcatctgttgatggacttttggattgtttccccttttggctattatgaataatgctgctatagaacattcatgtacaagtctttgtgtacatatgcttttatttctcttcggaatatacttaggaatataattgctaggtcacatggtaattctatgtttaacttttagaggaactgccagactttttcaaagcagctgcaccattttacattttcactaccaaagtatgagtgttccaatttttccatattcttatcaacacttgttactgtctgtctttttaattatactcatcctagtgtggataaagtgatatctcattgtagtttggatttgcatttccctgatgacttacgttgttgagagtcttttcatgtgtttattgaccatttgtgtatctcctttggagaaatgtctatttaaatgctttgcgtgtttttaattggattatttgttttttagtactgagttgtataagttctttatttattcttaatattatacccttatcagagctatgacatgaaaatattttttcccattctgtgggtagtattttcactttcctaatagtatcctgtgatgcacaaagtttttcattttgatgaaatccaatatttatttattttacccctttggttgcttgtatttttgttgtcatatctaagaaatcaatgtcaaatcaaagatcactaagatttaaacctatattttcttttgagacttttatagttttagttcttacattgaggtcattgatccacttggagttaattttggtatatggtgtgaggaggggatccaagttcgttctacagcctatatagcctgcagatgagcaatgttagtgaccttgaaagtagaggcccagrttrtcagtagcctggcatctaactaaacaaccatttatccattaaagttagccctgttaacaattaatattgagataattttacttaatacactgtgtatattagtgtccatctagcatgcagcctgaggcacagagaataatagtttgagtataaamttgaattgaatggaatacatcattaatttattatctagctttctgttattgtataggcagtcacatgtatttaccagaaaaaagttgatagaatttttattttaatgaaacccttttatactttagattattttgatgctgattaacaggataagctgactctggacacatcctgacagcctctgccaaggtttgaaataaacagctgggaaaattcagttttatattatctgttcccrcagctgctcagtttcttctaaccacaggtcagggaatataataggttttccgattagttttagataaaatgtgaaagaacagttcatgtcaaggacaatggttgccaaatatatttggcaggatttctatattgaatcccaaaggaaatacacaaacaaaaccccacaaaagttaggaaggagtaaaacccaggaaccctggaacattttgtcatttactatgcagatttgcctgaaagtgagacaggcaaataaatcacatgtttctgccagcgtggaaaatattcactcaaatggcaaaggtctcaggctggggagctggatattgtcctgtaataggttcatctcagaactgaatcacacacttggagggtgttaatgctcttaggaacatctagttattccctttgaatagagtcctgtcctgaatcacatatacttgacctagggcctaggcctttttgtttttctgtctcacaatcttgtttctccatcaattatgtgttttcactcttccctcagagagggaaaaagtgtttctgtgtgctcttgatcctgttccctctctgatcttccaatctattgctctataacatattttatatgtgtcttatatcttcattttagtcagaaacatttatttatttatttatttatttattttttgagacagagtctaactctatcccccaggctggagtgcagtggcatgatctcggctcactgcaacctctgcctcccgtgttcaagcgattctcctgcctcagcctcctgagtagctggcattacaggcatgccccaccacgcccagctaatttttgtatttttagtagacagggtttcttcatgttggcctggctggtgtcgaactcctgacctcaggtgatcctcccgcctcggcctcccaaagtgctgggattacagatgtgagccattgggtctggcctttaatcagaaacatttaaagtgaaagcactgtggtaacttatgttgaaataccttagaaatcaatggaaactgcacagagagggggtaggatagacgtagtggaaccaaggatatgatatggaaaaaggagaaaggtagcaaactagggatgagttggtgaatgtggaagggcataataatgttaaatgactgaaaactacataggcttatgttaagactagtgccatggaaatttttagaggtagatgacattagagtatgtttaaatataaattaatgttcttgcagtgagccgagattgcgccactgcagtccgcagtccggcctgggcgacagagcgagactccgtctcaaaaaaaaaaaaaaaaaaattaatgttactggttgtgttccctagatgtagactctgagatgaagattaacatgcaggaattttatttggagtgttcttgggatcaacacctgaggaatcagggataggcagagggagaagcgcgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccaatggctgggactggggagttctttcctagactgccatccgggcgcccctcaccctcttgctgctcagctccaggtcgtcgtgggttcagggctcagctgcacgctcctgcccgcgccctgggcgtgatggcacccccagcccctgccattcttccccctcaccccctctccctgccactgctctgcattgccctgggttagcctggcggggccaggtggcacccgccgtatactcttgcctttctgctgcaggggcctttctgctgcgggtcccagagctgcagggaggggcggcagagactccccacgtggctcattggcgggggtgctaatcagagttcttttgctgccactctttgattcccaaaccccatgtaatcttcttagtggggacacagaatcatctttgaattcatacatatacagcaccttggaggctggccctccatcctcacagagacctgcctccaagctggagttctacctgtgcctggttgtggacccactccctcatctcttttgctgtacaatgattccccaggtctacacggtgctatatggaattccacatcagtgaatcaaatcctctgtaagatttcagatagtggtgctggctaaggccctgaagggaggaaaggctaagttacgccaagattaggtatcacaatgaagtcctgtcctttctaggatggaaggagttcagtgtgtctggccaccgagaagctggtttgtctctgtgatggacaataccatattgcagcaatccccaacctttttggcaccagggactggtttcgtggaagataatttttccagagactttggggttgttgggaatggttacggcatgaaactgtccgcctcagatcatgcggcattagttaggttctcataaggagcacaaaacctagatcccttgcatatgcagttcacagtagcattcgcactcctatgagaatctaatgcagcagctgatctcacaggaggcagagcccaggcggtaatgcaagtgatggggagccgctgtaaatacagatgaagctttgctccctgcctgctgctcacttcctgctatgtgaccccattcctaacaggccacagaccagtactggtcaggggcccaggggttgggcccaatatggcatattgggagctcagcattgatttttgttgctggcaggttggactttggtggcaacagtagctagatcagccttagtcagtgggaagccacgcttttgggtccatgcattaattctctccctgctgctgtagccacttagctcatgtcttgccagtactgcgatggcctatgcagaggctagctgatgtgaattgccagagtcatttttatatgtgttgttggtttgtgcttccttcaagatggatgctttctgttggcattaacgtattacttggagatttttctagtttgtgtccactcactaatatgcctttgtcccaacttttttctggaagagcttccttatcagtacgctgggccctggccctcagccagtacagaaagtcatttgtcaaggccttcagttggcagacgtgctccctggactacgtgctttctcgggtgtcccagaaaccctggaatggagtgaaatgcagggctacgtgggagagcagggaggcaagaattaagtcggccccacctttgcccaactcagtgggtctccttgagagaggtctgcagtttcaaggagacttttcagccaatctgctgcgagatcctgtgaaggggtgtgaaggtcttcctctgtgactatagattggccagtctctccttgtgtgtccaacagttttcattatactttatgtgaattaatgcaaaactgctaggtttaaactgctcaccattttagggatcccttctggattttaccttccttaaggggaaattttcctcctttcctcagttcatcctttctgccttggctttgacgtggtctggaggccacagagcctcctcctgagaacctctctctggtgtgtctgtttgtgtccgtccctctcctttcgatcattccctgtggttcctgttgggcgcggctcccataaacgcacagagcagggtctgctttgtctgcaacctgatgcattgttatttctcaccaaaacttgcagtccaaacatcacatttccgggccacactctttgtcagagctccaggggcacaaccccggggacctgctggaaggtgccaccgtgacgtgtgcctagatgcgttttccctcagttaccacagcgttcctctggttctggtggctggagggtgaccgcgtgcttcatgaagggggtccttactgcttcgcatccacccttttcacggaaagcactttgtcacatgttttcagtgtttctaagcgattttctgccaatcttgtgtgctaagattgtgtggcagcgtttccacagatttatagctggcaatgaattctcccaaaggaaatcagacaaaataaaatgtttccaacattgttcacatactgacaacttatgtgcttccttgggtgattttacaactttttaagcacatgaataaaaattattgtctgcttttttctccttttttctctcttttttttcttgcatgcagaaagtttataggagggggatcctctggatcaacacccatgggggagtgaaggaagcaggattgggtaaaagaagttgaggtgatacagtctgaataaaggtcagtcccacagggagctcaagctaggatggctctgcagagatgttctctattgaggcaagttgtctggacctatatagtcccacctttaccaggaataaggcatgagtttggatgtggtgactgacttcagccaaaattggttctcagagaggaattcagattagagttgtcagctgtcagcacacccagcagcttaggaaataagtgctttagtcctgaagcggtgaatctggacaccagcctccactgtggtccaccctttctgctgctcagattcatttgcttcataagttctggaatggttccttcaggattctgatgggctccctttcctggggaaacaaaagagaaaggtttggaacacagcacaactcctgctgctttagcttttcttgagtctgcaactggtactcatcatcttccccttctactacccattctagatccctccccccaccaccctctcaattcatacttctgctgctccaagtgggttaccagataaggtatctggtcatcatgccctttgtaagccatgactgtacttgtccatttatcatcaacattgaacaagggaatactaagagatacccaggcagatgacctggctgccaaatatattctcctctgtctccattgtgtaatgtcagcccttcctcctgatgatcaggatcggttacgcttgccaggatagtgactcttttccttacctcttggtctcttaatagtgatctgaagtaatatgatggcaaccatagtttcaagtttaatgagactcttggtgtgtccactggcggacatattccccttttaagaaccagtacttctaaactctcagagcccagagttgggataagaggcatagtttccctaattgggtcactgggagtaatggtagtgtgaggctgctcctacttacactccttgttttccaaaaccatatattttacttcgggacacaccccactaaacgatggccattgatctagagtatatactgcatcctgcaggatggtgcctcgtccttaggtattatgtctaagctagtgcctcagctgtgccttcaacaagctgtcctaccactctatcaagtgggtagcttctgggtagtggattccatggtcatgtatcttcttgctttaaagtaggtctcttggtctgatgcagtgttatgtaagatcaaatattctgtgaggccttgaatggtggtgtttactgaggctcaccaagcaactgaatgattttcttgagaaatggtgacatatcagagccttagctttggtctctgttactggcaagttgaacattaacaacatcagtagctagatctgtattgatgagtccatgatgttgggcccatgcatagcctctgccatggctcctcctttcatacatccattttgtaagaattggggcaccaacagcagagactggtaagcatcaaagtggctaagtcattcagtctacttggttgtttagtgctgtttctgtggctgatgttcttttcatttattcattctgtaatgcgtatcctttgtagattcaatttccttctctctgaacaacttctttggatatttattgaaaggcaggtctactgtcaataaattccttaatttttattgtctgagaaagtttttatttctccttcatttttgaaggatactttcacagagttcagaattttaggttgactgttttttctttctctcaacactttaaatatgtcagtgcactctcttcttgtttgcatggtttctgaggcgaagttggatgtaatttttatctttgctcctctatggataaagtgtttttccccatctggtttcttacaacattttttgtctttgattttctggagtttgaatataatatgcctaggtgtagggtttttttatttgtttgytcgtttgcatctatcttttttttttttttttttttttttgagacagaatctcgccctgtcacccaggctggagtgcagtggcgcgaactcggctcactgcaagctccacctcttgggttcacgccattctcctgcctcagcctcctgaatagctgggactacaggcacccgccaccacagctggctaattttttttgtattttttagtaaagatggggtttcaccatgttagccaggatggtctcgatctcctgacctcgtgatctgcccgcctcggcctcccaaagtgctgggattacaggcgtgagccaccgcgcccagctgcatccatcttctttggtattctctgagcttcctgaatctgtggtatggtgtctggtgtctgacattaatttgggggaaattctcagtcattattgctttaaaaatttgctcctattcatttctgcattcttcttctggcatttccattatgtgtatgttacaacttttgtagttgttgttccacagtttttggacattctgggcccatgcatagcctctgccgttgttgttggtgtttttttttttttcagtctttttttctctttgcttttcagttttgattggaagtttctattgtcatgtcctcaagctcagagattctttcctcagccatgtctcatcaaccaatgagcccatcaaagacattcttcatctctgttacagtgttttgatctctagcatttcttttttattctgtcttagaatttccatatttttccttatgatatacatctgtcattgcatgttgtctactttttacattaaagccattagcatattaatcatagtttaaaaaattcctggtctgataattatgacattcctgccatatttgactctgattctgatgcttgcttgttcagtctcttcaaattttgtgggttttgccctttagtgtgccttgtaatttcttgttaaaaggtggacatgatgtactggctatgaggaactacagtaaataggcccatagtgatgtggtgagatggaaagaaagaaaagatgctcaacatcactaatcattagagaaatataaatcaaaactacaaagagatactgcctcacacccattaggatggctactatcaaaactaaaacagaaaataatgaatgttggtgaggatgtggagaaattggaacccttgtgcactattgcaaatgtacaatagggcagtttctctaaaaattaaacagaattaccatatgatccagcaactcgacttctggctatatatgcaaaagaactgaaatggggtcttaaagagatatttatacatcaattgtattagggttctccaatgaaacagatccgtgtgtgtgtgtgtgtgtgtgtgtgtgtgtgtaaatatatgccaatggtaaaagtacagggtctgagtcagaaggcagaaccaagaatgcttatgtccaagggcaggagaagacagatgtcccagttcaaacagggagagtgaatttgcccttcctctgtctttttgttctattcaggccctcagtggaatggataatgcccacccacattggtgagagtgatcttctttaccaattcacatgctattctcttctggaaacatcatcacagacatacctagaaatactgttttgccatgtatctgggcatctcttagcccagtcaagttgacatataaaattaaccatcatatccatgtttataagcagcattattcacaatagctaaaatgtggaagtactgcaagtgtctattgacagatgaatggataatctaaatgtggtatatacacacaaagcattacgaaagaaggaaattctgacacatgctacgacatagatgaaccttgagtatattacgctaagtgaaataagccagtcatgaaaagacaaatgctgtatgattccacttatattgggtacttagagtagtcaaaatgatacagaaagtagaatggtggatgccagagactggaggaggtgagagttattgtttaatgtttatacagtttcagtttacaacataaaattaattctggaggtagatgggagcatattacacgttttctttttggagatgggatctcactctgttgcccaggctggagtgcagttttgtgatcatagctcactgcagccttaactgtctgggctcaagtgatcctcccaccccaggcaccaaagcagctaagaccacaggtgcacaccaccacgcctggctaattattattatttgtagaggccaggtactgctgtgttgcccaggctggtgttgaacccctgggctcaagtgatcatcctgccctggcctcccaaagtactgggattacaggtgtgtgccaccacacctggccagactatttaatgctactgaactgtatatttaaacatgcttgggctgggcatggtgcctcatgcctataatcccagcactttgggaagccaaggagggtggattgcttgagcccaggagtgtgacaccagcctgggcaacatggtgaaaccctgtctctacaaaaacattaaccgggcatggtggcacacgcctgtagtcccacctactctggcggctgaggcgggaggatcactcgaacccgggaggtggatctcgccactgcactccagcctgagcaacagagtgagaccctgtcaaaaaaaaaaaaaaaaaaaaaagatttacgatagtaaattttatgtgtattttaccacaattattaaaattgaagaaaatccccatgggtcactggtttaccaatttagccattttcaccatttttagattgcattttccttctctatctcagcattctgactaaaggaaaagcaaaatttcttacaagaatgaatgattctccagtgtggctgctcctgaaaggaacaatgagacttttgttatttcaccacaagactgagaaagaaataaacaagtgataaatgcccagaccccttcttattcattccacatcctggtaatctgaggcatggtgtggcttttactccaagcatatgaatacttacaatcagaagctgcctctcctttccctcactttatcattattgccatcatttatgacaatggagggagtgtctcactggatgatatttggggttctttcttcagtggtccgccataccaagcatttatttgtgctgttctccatctttcacatctaccacttttcaaaagtccctgagagtcaataagacatgcgactcgaacaactgcttcacatctaagtgtatgtctttaaaaatctctccttttccatgtttatgtctgatgtgttttgttatggcaaagtggcatgtagtatacggttcataagtgaatcgatgtatatctgtggagggcaaatgctcaattttagatctacacatgaaagcttttttccagggcaggagccttgctttctccaactaagccttaattacccaaatgcccatgtgttgtgcctttggcttgttgaaatgataccaactggtaaaatctgatgggagataaaagttagatgtccagaagcataaaagtcaggaagagaggctctttatggcatagagaaagctgcagaactgctccatggtgtgcaaaactcatcagcacatgaaactagtgagtggagatagtcaccttcaaccactttgtaatttctaccaattcacttggggccagtgtcccttattcaccaagattcacattggtccttttgattatttggcgtgaggaggcccccagacatgctaaactgtcatgcagggagagaggaaaagttgggaaccagcctttgcttaaaagggctttgacaatggaggcaaataataacattttgggaacatttatataagtaattatataatttctgattcagtagctggttcatgaataaatgagtaattgggagtatctgagtggagacaagaatgaacattaatgtaggactgattctgaattacagcttctggcactagtaggtttcaatatacatagtctgctgaaaggtaattttctctgtgatattcctggtatccctaaggagggaagtataattttaggtacatactgacaaaatttgaacacaaggtacttagatgaaagttatagtctgttttagagatgaaattgaaggatgcagtagctattgctttggcaaaggatttttggctgatgcagtgtatggttattgattttatgattcttatcatatggcacctaatgtatcagttgagttgtgaaaacagtgtttcggtttaatggatgttagggatttatatacaacttcaaatttgcctccttgctaatagtagaaaagagtagtatggaagcattacttccagctgctttttgaagtgtccaccaaaatgaacgactttttcctttcttcacgcagatttcctcctagagtgccaaaatcttttccattcaacacctcagtcgtgtamaaarasactcygtttgtagaattcacgkwwcaccttttcaacatcgctaagccaaggccaccctggatgggtaatgaaaacaatgttgaatgctatttatgaaattgggtatcttattttctatcacagattccccaatcttgaggttgcagttaaaaagtgcagctgccaaagagaatgtttccctaactgctacctatagggaaatacactgactgcattttctgtctttttgctgggccgtcttcctctgcttggtctatgccaactgcttacctccacttagatgtcaaataaagtatgtaacaacatgttatgacaggacattttctgtcttagaattgttgctgagaattataggtgggaagtatccccttattctaaagagagatatcagcctatcgatttagaacttgttcaggtagtagtccaaaattggttctgcaacccttaggccctgactcacctccaaccttgtataaaaaaaggctaggaacttatggaagactttagatttgaatatttattatttggagagcctcttcggtgttttatgtgttgcttaccccatggggagtgggaggcctgtccctcatgtcaaggtataatgaaggaggcttcaggagaaccacttagaagactggacaaggtacctatggaacttgggagacactgaccactgcctggtttttatctggataaattttcaaggtcagaggccaaaaggacttctcctgatggaatagcagggggagtgggcaatagtgggagctaactgcactaccattgttaggtgtaaggccaggaaggtcactgaatgggacttgtcttacaaagactctgcctgagaggtcttcctgccaggattagataaccccaatagaaaaagcctgtatgggttgtactgccagaagcagaatctgagaggagagatacaagtgaccagctggagaaggtatatcccatgccaagatcaggagcagtggggtgtctccttgttggcagggagaggtctccaaataactcataagttccctaagaaagaaaggcagaattttggtatgtgtcacaactagggagtactaatgccacattatcactgctccttccaagaaagactttgtcattgtgcctatttgtttttaccctcccccctcctttccacttgctcctaccttggcaggtccagagacacaaaggtgagttggggaggaagattaggagaggaaggtgggaaagcagcgaagctgccaaaacaaattacctttacatattgcagatttctggggctgtcagaatgtagctggagaaggaagggaacttgcaattgcagaagacatcaaaaatttggtattagactggactggacttgttagaacctaagagtgatactgttggttaatacctgaaggttactggaaaagatttgggatcaaccaaagtgcaagaaaagggagatctcacataaagtaattaaaagcagtggtctaagaaaaataaggctattttatgtttttatcccactcaatccagttcattcaacagactgtttataggcattttatacttagtgtattcataaaacagagctcttaattttcctcctgattttctgtcatggcctgactaacaacccagttgcacaagccaaaatcataggagttttctttgactcctctctttttttctatctccacatcatatttatgagcaagtcctgttgactgttcctccaaaacaagttccaagtcttcttattttacttcttgtaaaatccaaattcatccaaattcctgtggcctgcaaggtcctacatgttatgtttcctttttgaccatattttctgttactcctctgctgattcactgtgcttcagccacactttacttgactataccaaacttatttctgcctctggacgtttgcatttgttttatctgttttcaatgctcttccactagatctttgaaaatcttgcttctttttcattagtcagatctctactcaaatgtcacctcctcagagaggcccttcctgactactacactgaaagtatcctctacctcctgcctcatcactttctagcagaccactatcttttatatttataacaacttgaaattttcttatttatttctttatgtgcttaatgtcttgagaatatgatctccattatctgtcttgtttgctactgcacctccagtgcataagacagttcctagaatatagtaggaactctagttgaatgaatgaatgaattgaatgattgccagaaatcttgcctcagagcaaccataaggttaggctgatgttggcagcaagcaaatactactttttgtcagtaattacaggggcatgcttctccactgtgaccttgactctaacttttggaataacaggttttctggagtactatccccaagtaacctttggcggacatctcattcttacagrtctgctagbtcctaccatccaggctgaggtttatgatacagtggwcattacacttamgaacrtggyttccyrtcctgtcagtcttcatgctgttggtgtatcctactggaaagcttctgwgsgtgagtaaaataccctcctattgtcctgtcattctatgaatagaacagtgagatgtgtgtgctttgtaatggtggcgttacaactcttttaaggtcctaactgaacattatgtgtatttcttaacatttactagattataaatatctcaagatagggaaatccatcttatttattgctgtgtccttagcatataacatattgcctaccctatagtagatactcaatacaagaatgagggtgtagtggacaccagtcattttttcttcctaaaattaaacatttctcacctgtataccccctaggaattgcttttctgaatatacttcaaacagaacctgccattttcttaaagcccatgcctccctagccatagcagttgatctaggagtgagcagttgacacgggtatcccacctccttggccacagttgattggtccagagatgggcaccttacccaagctaggccaatgagagtacttgcactagcattttgaaatttatgagaaaaaggacctattattaccaggtaatcctatacttaggggatggagcccaaatataataaaatcaagattctactacttcatgtatatcatgtgggccatggatcttataggagtcttaagggggtgttggtcttgtccttttcttagttgcctagctctttgcaggcatggtgcaaaggcaggacaatctacctttatctgctccttctataccactgatcctaccctaaacatgtagctgtataatcagagacaggaagccatggcaaatctggagggtctcggcttggctatatcttaaagagttacatgtaatcgtagttcaacattggggaaattttccaaaaattggtggagaaacgagtggccaatgcaattttatctttttttttctgctgacatcagggagagataagagctttaaaatcacaattatggggagataatattttaaaatccagctcaagttaaacccatcagaaaaggtaacaccttttgggacccccaaatggccacatcttatccaatgaggggacaccaaccatagagtctatactgcacagttcaaatggtagccatgagctatcaggcacttgaaatgtggtgagtcctacttgagacatactgtaaaatatacaccagatttcaaaggttaagtacaaaaaagactaaaaatatctcattcattgtttataagtacaagttgaaatgcttatatttggatatactaggttaaacgaaatacattattaaaataatttcacctgtttctttttacttttcttaatgtgactaccagaaaatttaaaattacatatgtggtttgcattatatttctattgaacagtgaaatgtttagcatatgttgaagttgctgctcctgatgcagtggctcatctcagatttggccaagttcttctgtccaaggaaaactaggttcaacccattcctggagaggaacagactcaaatctttctgggctgggtcacttaccttggttaaatctgttctccacctattctaccaacaaccaaagggatggacatagctgaaataaaaatcacgcaatcacactgaatggtatctcacctcaggtgggccttcagcattgcctagccattctactgctacatttcccctaatccatttactctccctctccccaagacagctataatgtttcacacattgttagcctctcattgaacctccaacatgtgctcccgcccctgcccccaccacaacgtgagccttgggaaaaagggtatttttttcctaatgaaatatttcaaacaaagataaatacagaaaataatataacaaacaaacatgtgcccatcacctcactttgccaaatcttaacattttgtcatctttgcttaatttattttacaaaattaagcattttacatacagtctgtactcctctatggggctggcaggaaaaggctctcattgtcaaagttcaaagtaattgatcattgaaaaaataatgatcacattaaaaacaacacttatataatagagatacatattgtaatactcataaatgaaatgatatcctgtctaggattggcttcaaacacatccaagctgatgttacaatcattaggtgaattcctgatgtggaatttgacatttgtatggcgccaaaataatatcccagtgatttttttctgattgtaagtggaaatgttaactttagaatggaggtatcaggctaatccacaggtcagttttagtgtcactaaggatgggatggccagatattatctgcccctgatatggcacaatatgagggactcagcatcatctttgatatattttagccaaaaaacttatttaatttgaatctaatcagaacttaggcatattcaatagcatgggatattctacaggactacaagccaaatttctttcaccaaatgagtgtcagaaaaaaagggactactccatactaaaagagactatgggcctaaacaaccagatgcaatctgcagtcttaggttggattctgatttggaccaactagctacaaaggatgcctttgaggcaattaagaaaatttgaatattgcattgatattaggtgatattaactggatcaggtgtgctagtgtcattttgtttatgtgggcaatttttttttaaagatgacttctaaagtatataggagtggactatcatgaaatttgtaatgtacattaaaatgcatcatcataaaaagtgtgttgaaagaaaaaagtgaaagtagcagtgcaattctaagaataattttctaacatccactcacaaaaatattaaattctttatattaaacacatgaaaaagaacacaaatatatctgtctttcaagattcatctcaaattccacctccttcatcaagcattactgaagagtaggaagcttgtttactttttttatccactgtgttgctcgctccaagggcatagagacttctatcttgatctttatattttcagcttgtagctgagtctggtaaagaataagaactcaataaatatttgtgaataaataggtgaatatttccacatggtattataattatatctttatatgtctatgtcccccaccaaacatagtgttgtaccactaggaaagaacaaagtttaagaaattttcttaaatctctctttcttactgttccgtgaccctcactagtgcctaccaaagagtctgtgacaaagtgtatttgttgttgaattgaattaggcaaaaagatgcaataatggaagcaatttattatttaacagaatgtggagatatcaaccagaacctagtttttactgctcatgctagggttagtgatctcaagatcctctggagtatatgaagcttctccccatttgtggctgctgcttgttagtttttcaaattaagatgcagaaagtaggccgggtgtggtggttcgcgcctgtaatcccagcactttgggaggctgaggcgggtggatcacaaggtcaggagtttaagaccatcctgaccaacatgatgaaaccccatctctactaaaaatacaaaattagccgggcatggtggcacgtgcctgtaatcccagctgctggggagtctgaggcaggaaaatcacttgaacctgggaggcggacgttgctgtgagccgagatccagcctgggcaacagagtgagactccgtctcaaaacaacaacaacaacaacaacaaagatgcagaaagtccgtttcttatgtagaacctattggtgacaataaacttgacatgtttctttgagtgtacagtggatatagaaaggacaattttatttcttcctgctataggagctgamtrtgatkrtyagaycagtcaaagggagaaagaagatsataaagwcttccctggtggaagccatacatatgtctggyaggycctgaaagagaawgdtyyaatggcctctgacccactgtgscttacctamycatatcttyctcatrtggacctggtaamakrcttgaattcaggcctcattggagccctactagtatgtagagaaggtaagtgtatgaaagcgtaggattgagatgaaataagcagagaagtacaaacaactgaatctatcyataacagttagcatttgtgttccttcacctgaaagaggcttttttactctagcatcatgctcatggaaaggagaataatccagtttctgagagaagcagatatgcattctatataaccacaataaactctaagctgggatcaggaggagctgagttccagaattaaatctctctcctcaaagcattgctattttcctcttcaaatctgtgggctttatcagtagtgatttctactgtcctctgccttttgcaaactttgagctaggttccttgaaaacttcatggaggtaaacacatccaagtgtgtgatcaatggcatatagactggttcaggtggttagtttgtcatctgtaaaccaaaagtatataaaaatctaagaaaagtcagcatttatttatatgttactgaaaattaattaatttggattgaattaatatattctaaaataattctaatcamacctgtttttawtttataccttagcataaattagggaagtaaattttgcataatttgtttttatcctattttttatggtgaaatcagcttcactgtaccttttccttgttccatttatcttttactgcataactccacaatttagtggcttaaaacaacaacagtctcttattatctctcatggtttctgtgagtctcatggaatttgtcagtgttttgacttggtggcctatctaagtgtgtctcatgaggctgtagtcaaacagtggctagagctgaaatcatcccaaaggtgactttattcacatgtctttgaccttggcttgatggtactctccacatgatctctctcacatgggttttacagggtagccagacttcttatatggtcctgagatagcccattagaagctgtttcacgatttctaatgtaaccttggaaatcactcacataacctacattctattagttagaatgcatcactaagaccagtctataaagggagactccaccttttgatggggaataggcaaagaatttattaacaggaatcaccatactctttctgaatggtgatgatgaatgtgattcaaaaaaaggatgggagcggggagtggagaagatgagaaaggtttgtagtttataatagtttcagatgaaagtatgatttctcatatactgagttcagtttcatagtcataattaatgagaaagtgccaaaaccacagtgtattatttatgggatgtaaaggctaatggaacaatgagatcatcaaaacattagtgtttacatatgacatataaagaaataagttaaaaacccaaatgattctttgacacagagttgaactaaagagtctacagaggttctagttccaggtgaaatggataaacacactccaccctttatttcccattgaacttaactataaaaccttgacaaaatgcaaagcccagatatttaaaaatttctaaaaagcaaatagaacaagtatatagagaaaagacactagaattgaaagtattaccaaacttgtgggggagtatacctttttccccactctagtattccttaacctgaattaaaacataactggagacttcgaagtgagtactatgttgcaaagagagctccaggacaaaccctctggggtttcaaggagtgagaaaggtaactctaaatgctcagagagcgtgggaggggaaatcccctagggtttttgtcctcttttccaccattctctcaagcttcagtcccaggttgcctgtggcaatgacagtggctggcaacagaaacctgccggagtaaaaacttagggaggggaacattattcttcattcagtacagctacagatctaagacattgggggaaaagcacattactttctctctgtctttccccttccattgcttgaccttagctatgatgtagttgtggaaattggaagcttctggttagaaaaccaaaaaagggagctcacagaactggaaagtttatagatgacagagagaaaagatcccaggaaagtaaacccataaagttgtgcattaactcctggattcacccccaacctacacatccaggtatgtagtttcagtgtcagatctgttttaaaccccttgcagtgccattgagtccaacgcagtggccagtctggtgcttgaggggaaatctcagtttcacagtcttcaacatgttccattagcctttacgtcccataaataacacactgtggttttggcactttctcattaattatgactatgaaactgaactcagtatatgagaaatcatactttcatctgaaactaacgcccacagaattccttaaaacatgtctgatggctgaaagcaaagatagaacattgtgagataggttttttaatgtatggtagatacaatacataaaagaatcatagcataacaagaggagggtaaggaaaactttatggtccattcaacttcattccaattcaaatggtaaaatgttgactctaagtagatgatagtgaaaggttaagtatgtattttgtaatccctagagcaaccaataaaaaattataccaagagacacagtaaaaagtcacaataaactaattacaatggtatatcaaaaatattcaaataactcaaaagaaggcaagtaaggagagatgaaaatcagagagaagaagcagtaaaatcataataaaatgataggcttaaatctaaacatatcaatacttacattaagtgcaaatggctaaaacacaccaattaaaaacagagattagcatactggatataaaagcttgaaccaattatatgttgtttacaagaaactcatttcaaaaaaatgatataggtaggttaccagcataaagatggaaaaggatatatgatgcaaacatgaatatgaagaaagttgaagtagtacaaatctgtaatcacaacattgatttttgccaggagtgccaaaaccattcaataggggaaagaatagtgtcttcaataaacagtgctgaaacaggtgaatatctgcatgcaaaatactgattgagtatcccttacctgaaatgcttggaaccaagaacgtttcagatttcagatactggaatatttgcacatatataatgagatagcttggggatggaacttaagtctgaatatgaaattcattttggatataaatcccttgccagttatgtgattggcaaatattttctcccactctatagtttgttttttcattcttttaatggtgtcttttataaagcaagagttatatggacaaacatatgaaaagatgttcaacatcattaaccattagggaaatgcaaattcaatcaacagtgatgtatctattagaatagctaaaataataatataaaattgccaagaatcctgtcaagaattcagagcaacagaaagtttcacaatgcacaatggtatagccattctggaaaacagaatggcagttttgctgcttggtagagaaacagtctctggcagtttcttgtgaaattagatgtacactatagagggatagcaggagggagttctttttggatattgaaatggatctgtatcttgacgatgatggggtttcatgagcttatatctttgttaaaagttatagacctatacaccaaaagaaaaagtcaatttcactataattgaaaatttatataaaagtaattagaatgttttaagacagctttatacgtattttaaatgtgtctctaaagtttttaatccagtacttctggtaaagatggcacagggtcttcctacttagccatttttccatcctccacctcaaccccaacctcgctgaaaaccaacaacaaagataggtaaaccataaatagagaaaatcgaataggcatggtcagctgaaaaagaagataaatatttgtggaccagaagcagaacaggaactgtgagtagtaaaaggggtggaaattacaggccaactgagatctgggtcaggaagccagctgcggtagccaaggagtcaggatgacaaggataaatagtgctccccaccagagggactgagagcccatatcatagagttgggctcttcttcacttgaaagagagctgagcacagctgctgctcactctttgtttagggccatggctttgtggaaactcagagtcctagaagaggggaaagcaaacccagtcctagaataggaactgaactaagttttcttggttcagtgggggaatctgcaatatccccaaggtttccattggccagtatctccaaaattccattctagggtatgatttgctagatagagaatagtgaacacatcctttgcttaatcaaccaatgatcacaagggacagcaaagatcactatagttcaacaaagtcagatttattggctcatggcaacaagagactgtggacacctccctaaacaaagggaaatactgtatagagttagtaaagaattttggggaagggtggaggttaggtgatatttaaatgaagcaaagtagagttgtgtgtaaagaaataaccatgaggtctagactgtgaagtgttctaaaaagttaacatagacatgaaaggttaagtcaaggcaccccttacctgaagcttgagctttaaattgagctgcttctttgtgtcaaagtaatttagatgacctaggaaagaatgagatgtttcattcttgttgctattagttcaaacatttctggcaggctgtgaattcagagaacaaacaactcaattgagtaagaaagcaagagataatcaaagcaaatagttggcattcagtgagtttatacagtggcaatgtgtccttgggagaaatggtgttgttaactctgcagttagctttatctatgtctcttatcccagcctgatgagtagcagcacacgtactgttgctttcttagtccaagctaatttttatttctaagcattaagggtgcgagagagagaaagaacggcaaaatgtcataaacaaaaatctttctactcaaaataagcctgtaaacaaaagtttccagtcaaatttaaaaaatatataattctaagaaagatagccaacaagctcaacagttaaagcatgaaacaagctagtttgttccattaaaaacttcagctatcgatatacacggtatttatttaaaatgtgagtataattagaagcactgtgggctattgaaaaaaaatcatgagtatagatgtttaatatggacaattgctattttactcaaaacttttaatttacaattgcagaagtataaaaagttacaagagtaacagaaattatctataatttcactattatcacacagtgtgtgagggcttgtattttgtaagtgtttttaatttttttctttagtaattcatttttatcatattttacacaagtagtggtcttcatcaaagttgaaataaaaaaattctttgctccagatagttttagaaacactgctataggagacctgacatcaaagccaagttatcaagagacagaagactacatttgttcttactgtcaagtaactgatgaagaactgtctcctcctagtgacaatttcctacaatgagattttttaaatagaagataaatgttctcacttctttttcagggagtctggccaaggaaaagacacagaccttgcacaaatttatactacwttttrmtgkatttgwtrawggttagtgagtcttaatctgaattttggattsctgaaagaaatcctctgctactattaagaggaggtgattatagaaagatcataaattacatkactgttcaggaatgaaggagatggggttaaaaatgaattccaagaaaacaaaacgtaacctcagttccactggcagctatgaggtaagaagatagaggagctggataacggactggcctcatccccctcattaagactgtcaacaaatactttgggctctactttctaaatactttctcttatcttcatctattattaagtgcacaacctttggcaagttatttaacctctctgtgtctcggtttcctaaatggaaataatagtacatttttcataagattgttgtgagtgctgagtgatttcacttaagtaacctagagcactgtgtggcatagagtaggccctcaatagtgttagtacctccgcctcttcctcctcctcctaatgtaatcactatgtaatcatagtaacataatattcttcttgcccccttatcaatttacattgccatcttcttaattgaggccctcatgatctgtctcataactctcaaaggaagcttactgaagtgagtatctgatcttgtcactctagcctctacaatacttcagtttgccagtttcggtggctcatgcctgtaatcccagcactttaggaggctgaggtgggcagattgcttgagcccaggagtttgagaccagcctgggcaacagggcgaaaccacatctctacaaaagaattaaaaaatcagccggtcatggtggcgggtacctgtactccagctacttgggaggctgaggtgggaggatcacttgagcccaggaggtgaaggttgcagtgagctgtgattgcgccactgcactccagcctgggtgataaagccagaccctatctcaaacaacaaaacaaataaaataattcaatttcaaggtaaagtgcaaaatgcattatctattctctggtgacatttccagccttgttgtgttccatttcctgccttatcttccatgtcacccaaatatgtaatgctttttcttgcatgagacctctgcatatgcagtttcctctgcctggaaaaatctgtctccctctttacactaagtaagcttctcctttttctttaagtctgacttacttcagttatccccttccttaattccttctcccaggatgacctctagtctggattagatgcctgcttatatttccacagcatcttgagcttattccttatcatactatatcagtattttctactttatttaatatttatcttctttgatctcatatctttttcccttcaagcaaagtgaaatttcttctcctctctgctccctgtaacaccctactctcatctttattatatcactctttactctttattataattatcagcttctctgacgattccagctagagtgtaagcatcttgaaagcagaggctgtatcttcctctctatcatcagtgtctacaattagtagtgctcaataaatatgtgtttgaatgaatgaacaaatgaatggctgcctcataaagttttagcactagctaccagtccttcacacaaaggggtaactccagggagtcactgttcaatagtatttccagtgcttcagcccttatcaatttcagagacagtgttagggagctttcaggttcctggggtttcataaatataagctgggatgaagcaattataacggagacagggactgacagacagcctttttcctaggacaattttcttttttcttttcttttttttttgagatcgagtctcactctgttgcccaggttggagtgcagtggcacaatcttggctcactgcaacgtccacctcccaggttcaagtgattctcctgcctcagcctcctgagtagctgagattacaggcacatgccaccatgcccgcctaatttgtgtatttttagtggggatagggtttcaccatgttggccaggctactctcaaacgcctgacctgaagtgatccacctgcctcagcctcccagagtgctacgattacaggtgtgagccaccgcgcccggcccctaggatgattttcataagctttcttttaaataattcagctaataaaaagaattgaatcctgatgcctcaagctaaccaatattctgtcttctattattatccattcccacttattgtcatggacaaatggagggagagaaaatcagtttgagcaagagatgtctgcctttacataattatcttctccctccctcacactgactttgagaggataagtgctgtgtgcctactttgctgacaaaaatgcttaaggtgtgagcacactgggagcagggaaggagaaaggggaggcggtcattcatgagacacatgcttagctgactctatctttgccttctctctcatcagggaaaagttggcrctcagaaacaaagaactccttgatgcaggatagggatgctgcatctgctcgggcctggcctaaaatgcacacagtcaatggttatgtaaacaggtctctgccaggtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaccaacaacaacccagagctcacatgtgaggatgagacagttcccggagccacagagaagtgaaaaaactttgagaatcagacttccacatccatgactctccttcctcctattctgcccagcaccaagtgtatggaaaatctcccctcaactcatggtttctacactggaaaaagtgacattgaggtgttcaaccagcttctccaccttcttgggttccctggggggagatttgtccttgccttaacccacagaaaacatcatgactgtctgaaggcagaaatatcccagagtacaggcagagacaaatgagggaggaaggactaccatccccagccctggaaattctgctctataatttggccaaagacatgcaaattcagaatggccgtgcagcagcaccatgctgtagcaggtttatcctacaggtcaccttggcatgaatcactagctggccttccaacactgctatgataatccctttgggacctcacccacttgggacaggcagggctctgaccacttactggaacacctgtaatcccagcacttgagctcagcacaataacaataggagatggctactaccgttaattttatgcagttrcgatttaatactggatctttacgtttgtttacatttgtcccaactggcaccttcatcacctccaccctccccaccccagactatggtaaccacgattctactctctattttcacaagatccactcttttagctcccacatgtgagtgagaacatgtggtattgccctgcagtgtcacctatgttgatgcaaatgaaaatattcttttttatggccaaatagtattccattatgtatatataccactgaactgtacacttaaaaatggtaatgatggcaaattacatatgtatattttacatcaataaaaagaaacttaaaaataaggtaacaataggattctatgaaaaacaatcataacaaaacgtgctcataaaaattataaacacaatggtcaaaatagaaactcaatagaaagtactaagaatagataaaatctttcataaggtcaaacaaaatgtggttgagaatatagttgacccttgaacaatgtgggggttggggtactaaccccctgcacagtcaaaaatccatgtataacttttgactccctccaaattcaagtactaatgacctattgttgatcagaagccttatcaataacataaacaacaaatattttgtgtatgtattatatgctgtatattttcaataaagtaagctagagaaaggaaaatgttatttatacttttctctgcttcttgggagtacttccagcatcactagtggcactttatacgggtcccaagtatccttcaaagtttatggagagatgaaatgcttatgcagagatgattagcatcatgcagagttttcagtggatgcctgcagcactcgagctcagcacaataacaataggagatggctactaccgttaattttatgcagttgcgatttaatactggatctttacgtttgtttacatttgtcccaactgggaatggtgccrtgtatggttgtaagtatgtaagtttttataaatttcaactttttataatagatttttgtatattttatggtaataaatgataaaatagtctagtatcaacatgtatatgtatatataagtgtgtatacatatatatatatatwtattttttttttttttgagacggagtcttgctgtcgcccaggctggagtgcagtggcgcaatctcagctcactgcaggctctgccccccggggttcacgccattctcccgcctcagcctcccgagtagctgggactacaggcgcccgccacctcgactggctaattttttgtatttttagtagagacggggtttcattgtgttagccaggatggtctcgatctcctgacctcgtgatccacccgccttggcctcccaaagtatatatatatattttttgagacggagtcttgttctgtcacccaggctggagtgcagtggcacaatctgagctcactgcaacttccccctcttgggttcaagcgattctcctgccccagcctcccaagtagctgggattacaggcatgtgccaccacgcccacctaatttttgtagttttagtagagatggggtttcaccatgtttgccaggccggtcttgaactcctgacctcgtgatctgcccgccttggcctcccaaagtgctgggattataagtgtgagccactgcatccggccatctccatatattttttgcattcataacatacctttttcttaatttttttgatatttttaccctatgtggtccatctgacagttttttcaaattgtcataaatttccaaaaaaatctcactatatttattgaaaaaaaactgcatataagtggactcatgcagttcaaacctgtattgttcaagagtcaactgtgtgttttaaagcagattttaacatcaagaaatgatagaaaaatgataagaattaaaagagataaatattcatattagaattgcccatcaggagcttctgagtagctgaacgcatggaggttcctggagagtggctggccccatgccccttcccacatacccttccttatatatgcatctcttccatctggcgtttataagaaaaggtgctgactgctgaattataaggacactgtggtctactagataaaggttgaggagaggggtttgggcttctattgtcttctttccgggccttcatctcctgcttgtgattaagtagtgcatgctgagtggagcaaagtggtggaataggactcttcagcaataatctcctcacagaaacatcaaggtaacaactcgatgcgtgaaattaccttcagaagagttaagaaaacctgaacccatgagcaagactgtgaagcccttttggactgcaaagacgagtaaaaccatagttgcacataaaggggattggttctttatgactgagaccccacccgcaagccactgcagtaccacaggcggaaagtcaccatggacccacggtttttacaccggaaaactctcccgtatggcctgagtgccctctgtggatctccactaattagtagcagagccagcatgagacttgcgtctaacctgggctcagggcgccctctcgtgctaaaaggaaatacaacagccagtcctttcactttctttttgatatggtctctgttgcctaggttggagtgcagtggtgcgatcatagattactgcagtcttgaactcctggctgggctcacrcggtcttcccacctcagcctccagagtgggactacaggtgtgtgccactatgcctggctaaattttcgggttttgtgtgtggggtggggaagattggggtattgctatgttgctcaggctgggtctcgaactcctgacctaaagcaatcctccagcctcagcctcctaaagtgctaggttacaagtatgagccaccacactcagccccactcaatttctaaacgagctcactgaaatagagcagtcacaaacaaacccagactgtgaacatgagaataaatacctaattcttcaatgtgtagacagggatgcacatctgcaaagaataagaatagcctaagaaagacagcctcaacaaatgaacaaaaaatcgtgccagtgactaatcctaaagacatgcaggtgaatgatctggtagacaaagaattcaaaatagctattttaagaaaactcaacaaacttttataaaacacagagaaacaattcagaagtttatcaaagaaatttaacagagaaattgaaggaataaaaaaagtcagaaatcctggaactgaaaagtataataaaaaatgacacatgcaatacaagacatcagcaacagaattgatcaggcagaagaaaggatcagcaagctcaaagacaggttatccaaaaatacaatcaggaggggcttcaggatggttgactagatgcatctagtgttcatcccttccatggagaggaaccaaagtagcaagtagataattatactttgaataggtcatctaagagagaacactggaattcaacagagcagtgacaggaagcattgaaagcaagggaggagagagaaataaggcctgtttgcctgggattggctgggagtctggaacagcttcctaatgtggggaaaaggtaagagacccttagtgttcctcattttcaccaaggactcttgcaatcctagccacaggagagcgccttattccttgacagcacagagactagcatagggagttgcctaaagaccgtgtgaaggcattgcaacagagagctcacgctggattctgcaattctcccaagcagctgcagcacagcaccattttgagaacacagcccacacatcctgccctgctatgatggccgtgacttaggcaggagccctgagcagtgatcctgccccacccagcagaggagtgcccatgcattttcacatattccaagaacaaattccactacctacaaccactgctgctgcaggctgctgtggggccaaaacactagtgaaccttgtgctcccaagctacctgcctacagctactccctgagaaagcaaccccaccttcaccaagagcagggctatagcacagctactgctgcaccccaacctgagcattttgctagtgacctcggtatcaccccacccctgcatagcacaaccagcacctcacacaccaccaaggagcctgagggcaggttcacgtagcccagctctacctgcccccagtacccaagcatatcatccaggggcctagggatcacttagccctgtccaccactggtggcacctgagcacctcctggggtctgaggtcaggcccactcaacctgccactactgccacagttagcactcactgcatgcaccacttgagggtctggagactggccatgcgatccatagcagccacaaccaacgccagcacagaccacttgagattcaggttgtttcattgctatgattgccatcaaccatgccactttgctgcccaggaacttgagaacccacccacccatgtgatccatcaataccacttctggcacccaagtaaaccacttggaggcccacaaatcaacctgcctggacctaaaaccagtgcaatcatatgccaccatggtacaccaaagacaagcacactcagcccactgctgccaccattggggcctgaagacaggcctacctggcatcccacttctcagaaaaacttcaccacagcctccactaataaccacaccctaagccactgagaaaatcacaaatatcactgatgctgtttagaatcttatacagaggctactacattcaccgagaatcaaaaccgaagtgctctacccaagcaacaccacagatacatcttcaggaaaaagttctttcctacaaaagcaaattttaaaaattggaaaaagtgattattacaccagatgtgcagatatcaatgtaaggacacaggaaacatgaaaaatcaaggaactatgacactccaaaggagcacaataattctgtagcaagagatccaaataaaaaaaatttaagatgggtacaaaaaaatagaaagaatgaataagacctgctatttgatagcacaacatggtgactatagttaataataacttaattgtacattctaaaataaagagtgtaattggattgttaataactcaaaggataagtgcttgagggtatacatacctcattctccatgatgtgtttgtttcacatcacatgcctgtatcaaaacatctcatgtgttccataaatatatacacctactatgtatccacaaaataaaaaaatcatagtttacaagcaaaacagtatatgtgaccattggtttttaagtaaactggccaacatctctttaaaaatttatgaaatcctggaaaaataattccaaattttgatactaaataaactcagtgagatacaagagaattctgaaaaaaatacaaagaacacagaaaaacaattgaggctatgaaagagaaatttacccaagagatagatatcaaaaaagaaccaaacaaaaattctggaaccaaagaattcattgaatgaaatacaaaatagatttgaaaggttcaacaatagaccggaccaagcagaagagtatcagaactgaaatacagatcttttgaaataacccaatcagacaaaaataaagaaaaaagaattttaaaaaatgagcaaagatttcatgacatattaggcactataaagtgaccaaatatttgaatcttcagtgtcccagaaggcaaagagaaaatgaagaggttagaaagcctatttaatgaaatattagatgaaaaatttccaagtctaccaagagatttagacatctagataaagaaggctcaaaaatacccaaataaatacaatgcaaaaaggtcttctccagggcacattatagtcaaactatcaaaagtcaaagaaaaaaatttaaaaatagcaagagaaaagcatatagtcacctgtaaaggagccgctatcagactaactgtgaatttctcagcagaaactttacaagccaggagagaatgagagagagagaaaaaaaaaaaaaaacacctgccagccaaggatactgtacacagcaaaattatccttcataaatgaaagagagagaaaaatattttcagacaaaaaaaaactgaggaaattcattgcaacctgatctgctttacaggaaatgctaaagggagtttttcaaactgaaagaaaaaggtcctaatgtgtaacatgaaaacatctgaaggtataaaacccacaggtaaaagtaagtatcccgacaaattcagaattctctaacatggtaattgtagaacataaatcacttacatccttagtaggaagattaaaaaacaaaacagataaaaataattaccataacctgttaaagaataagcaatataaaaagatgtaaatgatgacatcaaaaacacaaaatttgggagtcgattttttaaaaaattttcttgcaatcaaaattaagttgttatcagttcaaactaacttgttataactataaggtattctgtgtaagcctcatggtaattacaaagcaaaaatttttataatagatacactaaaaataaaaagcaagggattaaaacatactgatagaagaatcacttaaccacaagggaagagattaagagaggaagaaaggaacaaaggatctacacaacaactagaaaacaagtaaaaatatggcactaccaagttcttacctatcaaaaattaccttgaatacaaatgggttaaattctccaactaaaagacatagagtgtttggttttttgttcttgcgatagtttactgagaatgatgatttccaatttcctccatgtccctacaaaggacatgaactcatcattttttatggctgcatagtattccatggtgtatatgtgccacattttcttaatccagtctatcattgttggacatttggaccgcatattctcactcataggtgggaattgaacaatgagatcacatggacacaggaaggggaatatcacactctgggaactgttgtggggtggggggaagggggagggatagcattaggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaatttaaaaaaagacatagggtggctgaatgaatttttttttaaaaaaagatctaactacatactgcctaagagaaagactttacctgtaaggacacacatagactgaaagcgaagggatagaaacagatattccatgcacatgtaaacaaaaagaaagcaggaatagctatacttatatctgataaaatagacttcaagtcaaaaactataaaaagagacaaacagccagacgtggtggctcatgcctgtaatttcagcactttgggaggctgaggcgggtggatcacctgaagtcagaagttcgagaccagcctggccaaatggcgaaactccatctctactaaaaatacaaaaattaaccaagcatggtggcaggcgcctgtagtcccagctactcgggaggctgaggcaggagaatggcatgaacccgggaggcggagcttgcagtgagccgacattgcaccgctgcactccagcctgggcacacagcgagaatctgtcaaaaaaaaattgacaaacaaggccattatataatagtaaagaagttaatacaacaggagaatgtaacaagcataaatatatatacacccaacattggagcacctaaatatattaatgtttgatctttgtattttctagtctcattaaaagtaagggcaaaaactacaattacttttgcaccaacctaatataaagcaaacattaatagaccaagggggaaatgaagacagcaatgaaataatagtagaaaactttaacaccccactttcaccaatggacagatcatccagacaaaatatcaacaaagaaacactggacttgaactgcactgtagaccaaatagagcaaacagacatttacggaacattccatccaacagctacacagttcacattcttctcaactgcacatggaacattctccaggagattatacattaggccacaaagcaagtcttaactaacttttttaaaatgaagtatttttttcctgccaataatggaataaaactataaatcaacaacaggaggaacaactgtacaaatacatggaaattaaagaacatgcccctmaacaaacaatgggtcaatgaagaaattaaaggagaagttaaaaaatttcttgaaacaaatgaaaatggaaacataacatgccaaaacttatgggatacagcaaaagtagtccttaaagaaaagtttatagcaataaatgcctacatcaaaaaaaaatctcaaataaacaacctaatgatgcatctcatggaactagaaaaacaagaacaaacaaaaccccaaattattagaagaaatgaatgaatacagatgagagcacaaataatcaaaatagaaactaaaaaatacaaaagatcagtataatgagttagttagttctttgaaaagataaaaaaaagtcaataaacttttagccagactaagtgataataaagaagaaaaacagaaataaatcagacatgaaaaaggagacattacaactgataacacagaaatacaaagaattataagaaactactatgaacaactataagccaacaaattgaaaagcctagaagaaatggataaattcctggacacatacaacctaccaaggttgaatcaagaaaaaatggaaattttgaacaaatcaacaatgagcaacaagattgaagcaaaaatacaaagtctcccatcaaagaaaagttcagtacccaatggcttcactgctgaattctaccaaacatctaaagaactaataccaattcttcacaaactattcaaaaaattgaaaaggaagaaactcttccaaaattattttaggaggataatgatcattatcctgatcccaaaaccagacaaaagcacaataacaacaaacaactacaggccaatatcctcaacaaaatactagaaatagaattcaacagcacattaaaagatcatttaccatgatcaggtgggatttatcccagtgatgtaaggatggtttaacatatgcaaattaagaatgaaggacaaaaattatattatcattttaatagacacagtaaaggcatttgacaaaattcaatatcccttcatgataaaaactctcaacaaagtatagaaggagcatacctatatgataaacctacaaacaagatgaaactgagtggggaaaagttgaaagcttttcctttaagaactggaataagacaagcatatccaccctcaccacttctattcaacacagtactggaagtcctagccagagcaattaggcaagacatccaaattggaaagaaggaagtcaaattgtccctgtttggccaggctcaatggcttatgcctgtaatcccagaactttgggaggccaaggcgggcagatcacttgatgtccagagttcgagaccagcctggcaatatggtgaaaccccatctctactaaaaatacacacacacacacacacacacacacatgctagccagacatggtggtgcgctcctgtagtcccagctactcgagaggctgaagcaggagaatcactagaaccccagaggcggagcttgtggtgagccaagatcgcaccactgcactgcagcctgggcaacagagtgaaacactgtctcgaaacaaaaacaaaaacaaacaaaacaaattgtccctgtttgcagaagacatgatcttatatatagaaaactgccaaaactacaccaaaaaactgttagagctagtaaatgaatgtagtaaacttgtagtctacaaaatcaacatacaataattgatagcatgtctatatgccaacagtgaacaatctgaaaaagcaatcaagaaagcaatcacgtttacaatagctacaaaaaatgtccagaaataaattaaccaaggaagtgaaagatctctataatgaaaactataaaatattgatgaaagaaattgaataagacacaaataaatggaaagatatttcatgttcatggattgaagaattaatattattaaagccaaagcaatctacagattcaatgcaattcctatcaaaattccaatgtcattcttcacagaaatagaaaaacaatcctaagatttgtgtggaaccacaaaaaatcccaaagagccaaagaagtcttgagcaaaaagaataaacctggaggcatcacactacctgatttcaaattatactacaaagttatagtaaccaaaacagcattgtgttgacataaaaacagacatatagaccaatagaacaaaatagagagcccagaaatacacccaaacatttaaagccaactgattttctacgaagttggcaagaatacatgatgggtaaagaacagtcttttcaataaatggtgctgggaaaactggatatccatatgcaaaagaatgaacctagaccccctatctctcaccacgtatgaaagtcaaataggccaggcacagtggctcatgcctgtaatcccagcactttgggaggccaaggcaggcagatcacttggggtcaggagtttgagaccggcctggccaacatggtgaaaccccgtctttactaaaaatacaaaattagccaggtgtggtggcacacctgtagtcccagcaacttgggaggctgaggcaggagaatcacttgaaccccagaggtggaggctgcagtgagcctagatcgtgctattgcactccagcctgggcaacagagtgagactctgtctcaaaaaaaaaaaaaaaaaaaaaaaaagaaagacgaaagaaaagaaaagaacaatagattaaggaattaaatttaagacctgaaactctgaaattattagaagaaaacatagtgtaagcatttcatgacatcaatttgggcaagaatttgttagacaagacctcaaaatcatgagtaacaaaagcaaaaataaagaaattggattacatcaaactagaaagcttctgcacagcaaaggaaacaatcaacagagtgaagagacaacctatagaatgggagaaaatatttgcagattatacatctgacaagggattgatatctagaatatataaggaactcaaacaactcaatagcaaaagtccaaataatcctattaaaaatgaacaaaagacctgaatagacatttctccaaaagagacctacaaatggccaacaggtatatgaaaaatgctcaacatcactaaccatcaggaaaattaaaatcaaaactacaatgagatatcacttacccctgttagaatgactattataaaaaagacaaaataacaagtgctagcaaggatgtggagacaaagaaacccttatacactgttggtgggaatataaattagttaagccattagagataatggtatagagatgcctcaaaaattaaaaatagatctatcatattttctagcaatcccactactgggtatataccaaaaagaaatgaaatcagcatgttgaagaaacatctgcatccccatgtttatgacagcattattcacaatagtcaagatataaaatcaacttaaatgcccatcaatggatgaatggataaagaaactgtgatatagatacacaatggaatactattcatccatttaaaaaagatgaaatcctgtcattttcaacaacgtkgatgagcctggaggacattatgttaagtgaaataagccaggcagagaaagacaaatactccatgatctcagtcctatgtacaatctttaaaatttgatctcatagtagttgagattagtgattctaggaagataagggggaagtgggagatggggagagattggtcaatgggtacaatgttacaggtagatagaaggaataagttctggtactctattgcacagtagggtgacaatagccaacaataatatattgtatatttcaaatagaagagaggattttgaatggtctcacaacaaagaaatgacaaacatttaaggtgatggatatgataattaccctgatttgaataattacacaatgtatacatgtattgaaacatcacattgtacccataaatttgtagaattatttatgtgtcaataaaaagtaatacagttaaaaaaataaaattgcccattaggataaataaaaagacccacacacaaaattatcattgtggcatttcagagcacagagagaagatacttaaagcttcttctgagaggaacaggacgcatacaaaagaatgggaattagactggcgatataattaagcaatattgtaaaagatctaagggaaaaattatttggaacctagaatttttagtcaaactatgaatcaattttgggggaagaaaaaagacattttcatatatagagggccttaatagtcactgaatgtgtactatagtaaaaccagaaactacataaaagaggaatttgggagattcagcaacccaagagaataatgaagtatgagggggatgttttctccttagttcttttccgtatttttcaataatttgataataaacatgcataattttataattaaaaaggaaattaattttgacaacatgcaagttcctgttctcacataccttatagtggagggacagattgtagtcaaataagcataataatacatgcaaaattacaaactgagcattactctgaaggaaaattacataattctatgtaagcctataatacaggaatctgacctagactggggaatcagagaaggcttccctaagcaagtaccccttgaacttagctttgaaactgggaaaatgaggcaatgtgagatgaagctgttagaggtattaggaatcaaacctattggggccttctagtccttagtagagagtctggactttattctatgtggaatgacagcctccagtgggttttaggctggcggatactacaatcagayctggaatgcagaaatagtacaccagtttctttgtgggtaaaagtcttagaggggagaatatgaccaactgtagggagacctgtaaaaaaagtttatcagtagctcagacgagataatggtaacttggattaagatagtggtagtagtaacagtgaaaaactagatacatttgaaagcttttagagccaaaataggaggcagctgtgcccttgttgttaccagtgtgggatctgaacacatgactacttgggttcaaatactgagcaaattaattaacctctctgggcatccgtttcctctcctgcaagacatggatgataatggtttctacattcatagggttgttatgaggaatgaatgaattaaaacttgtaaaatactttggacagtgcttgacataaaacaagtgctcaatacatattagctattattgattatattgccctggtcagtgtcaaactgcatatgggagatgagaatggtaacaaggataactctcacttgcatattcaaatgcaggatgctgccattcactgttataaaaaactctggaagagaatgaagtgatgaaaattgtaaatttggttttgaacatgtgggttttttgagatatctaggtggagatgttgagaaagtgattggctgtatgagcctggagttccagaagaggtcagsaggggagacagaagaaggagcagtctgagaagtaggagaaaaaaacccacagagatgttggcacagaggccaagggaagagagagttttaaaaacgaatgaatggtcaacaggtgcaaataaagactgaaaaatgtccattggatttagcagcatgatggtgattggtgaccttggcaagagctgttggtttgatagtagcccaatgttcttgataaatttgtttacaagtcaaggtagcaataaagtgtctaaagtcaatttgtccattctgtcctagcaagtgttttccatttcagattctctacttcatagccataggtgtcttattcctactttacaggtctgattggatgccacaggaaatcagtctattggcatgtgattrgaatgggcaccactcctdaagkgcmctcaatattcctcdraggtcacayayttcttgygaggawccatydccagsmgtccttggaaakctygccaataacttyccttrytgytcaaacactcttgatggaccttgracagtttctactgttttgtcatakctcttcccaccaacatggtaatatcttggatctttaaaatgaatattataaatatccagtcctacttttaataaaatttactggacaatgtacaggaatatagtgtgttgctgaaggggacattatagagttactgtattagacctcagccaagatcccctagtttccagcttccagtgtaaagtttttaccttgactataaaagggcttgagtattagtaggactcatggatttttagttaaatgtctgtgatggagaaaagatggcttatggatgattgaggtgggaaaatgaggagaatagtatgcccttggtttctcagccttatcccattaattacgctccaatattatggagagaggaactgcaagttgtagctgaagagattttttttttttttggagaaatctagggaaatgggaaaaaaaggcattgtccagattgcaactgtaagggctccactatatcattagtaatgcccagagcagtaaatagcaaatatgacaggctattgtagagcttgacttcagacaccagacagccagaggcactctgtagatacctggcagtagatgagagacacctgtgaaactgagggcaggtcaggagctagtgaattttagaagtaacatgggattgaaaggactatttggtgggaactttggaaagggtcaaaggttctgtgtaagcaaattaggacgatggtaactacagttttaaattattgttaatgtaactttatttgtaactgctagttgtgcaaattcagattgcatcatcatttcaccccaattttccttacttttgtatttattctgctaactcttaatcttggatcaacctaataaccctctttctctacccctctcgtggccattgaaggctcttagtcagtttgtgctgcaataacagtataccacagaatgggtaatttataatggacagaaatttattggctcacatttctgggggctgggaggtcccatatcaagttgcctttttctgcgtcttaacatggtggaaggcattatatgaccaaagggcaaagaaagggtgagagagagcaagaggagggtgagctcactcctgtgataacaaatccactcccatgaacactttccccagataactgcattagtccattcatgagggtggaacgcttatgacctaaacaccttttatatgttcacctctcaataccatcacgatgataattaaatttcaatatgagtttcggaggggacagacattcaaaccatagcaagagttattggagaaaaatgtcggagaggcctaatcttttatatttaatagcatttctttcttcctattactctcatattaaccttctcctcaggttccttggttgacttagaaaagagaattgatcttgccatgcatccaccattttcctccttatgttctattagtgaccttgtttattgtcttctgtagtgattaagaatagaaatctctcttccccatgtgtcacataatatttatggaattttgacaagaccttagtggacaaaatgtgtcatactgaatgagtaacaggaagttgatgcacaaacaacattcttgcaggcacagaggaataggtcatttacttgtatatgatcattgtcaatcaatcattgtccagttggaccccgattcagtttattttttgttttgtttttctccttttcacagattctatccactaattttaatctttatttttcagaaaaaaatgctttatcttattgaacctcagaccaaacactttgtttttcgatgcagactgagttatgtttaaggctacatgaaccccagactagttgtttgctgctcctaaaaccttccctgttcctcataatcaagtaaacaggtctcccttcttagaagtatttgatcttcaaaattgccctgtggtataaatagggcaggaattattattatccattttacaaagcatgaagatgagactgagaatgttgaatacatttgccatagggtttacaactagtcacaggcagacatgctcttaaaatatatatctccttgattttaagttgtatcttgtcatggttttatgaacttggaacatgtcttaaagtttatatctacactaacatttttcccaataagctgttattaaatcaatgatttgtggcaagaagggatagtgatgtggaaagggggggtacttaggggagagcctggaaggcctaataagagagaaagaagtcataaaagttaaggcaagtgatatggtttggatatttatcttcactgaaatctcatgttgaattgtaatttccaatgctggaggtggggtctggtggcagatgtttggatcatgggggtgaatccctcatggcttgatgctgtcttcatgatatttggtcattcagaagtgtgtggcaacttgcactctctgtcttgctcctgctttcaccatgtgacatgtctcctcccccttcacctacccccatgattgtaagcttcctgagacctccctgaagccaagcagatgccagcaccatgcttcccatatagcctgcagaaacatgagccaattcaatctcttttctttataaattacctagtctctggtatagaacagcctaatatagcaagacactctracattgtttggtttgtctgactccagatggcaygraagcttawgtcaaagtagacagctgtccagaggaaccccaactaygaatgaaaaataatgaagaagcrgaagactrtgatgatgatcttactgattctgaaatggatgtggtcaggtttgatgatgacaactctccttcctttatccaaattyvcyhagttgccaagaagcatcctaaaactkgggtasattacwktgctgctgaagrggaggactgggactatgctcccttagtcctcgcccccgatgacaggtaagcactttttgactattggtactctctcttccccatactcaaaaagttcttaccagttattcaaaccaacaaatcctgaagccatgtttaaggttaggtacaggtatggaatcaaatggcaagggtattaacatttggaaactaacatagctgagcatcagagaagcttgtatttttctcactccttgccttgattgaatcatataagctgttttagagttggatttgagcctacctagaatttttcttcccaacctctmatctttttttctcttatacagaagttatawaagtcaatattygaacaatggccctcagysgwttgdtaggaagtrcaaaaragtcygatttatggcawacacagatkaaayctktaagactcgtgaagctattcagcatgaatsagraatcttgggacctttactttatggggaagttgkaracacactgttggtaagttgaagaaaagatttaaggtcaggtaagaagaaaaagtctggagagttttgagtttctaaaatacctcataaktcagccttgtctccaatggacatgatcttttaaaagctataaatgttacacaaataatagctgattgtatgtatttaaagtttgagtatatagaataaaaatttaatgtcacccactaaactcgacactcctttgaaatactgcttagactttgatacatatccttccagatctttctccattaattatgtcatataggagtcagcagactatggcctgtgaaccaaatttggcttgtggcctgcttttgaacagtccatgagcttagatgagattttacatttttaaaatattgcaaagaaaagaaaggaggatgggaggaaggggaggagaaggcggaggagcaagagaatatgtgacagaggctagatagggctcacaaattttagagtacttactatccagccttttccaaaaaatgcttgcttgctcctgatctaggatattaagaatgagtatggtgtaagtaacagaatactcaatggacagtggtttaaataaataagggtttattttcttcacaagaaatttgaagattggtcgttggttccataaattcagccgctgaagaatgtcatgaagaacactggtttttagatatggagttttgttagatactgccaaactgactttcagcaattttgtaccaatttatatcccctaccataagtatatgactgcccttttccccacaccattgccaacaacatatattataaaccttcagaaaattttccaatttgatgagcaaaatgtttatatgttgtcttcatttgcatttccctggttagtggtcaaattgtatattgtttcatgtttgttggctatttgtataactccctctgtgaattgcctgcttgtaaattttgtccagttttctatttggtcagtcatcttttgcttatgtatttgtaaaaggtctttatagattatggatattgacacattgttatttatctttcaaatgttttcctcacattgtcacttgtactttaactcctttatgatattttttgtccttcaaagatttttcatctttatatagtcaaaacctcctatcttttatcaatcttttcatttatatgtctctggatctttttcacttatgttttctgcctgagaatgtcttkgccacccccaagacactacaaaaatagtctatattttattctcttacttgtatagctttatttttacagtgagcaatctaattgccctggaagttacttttgaatgtagtgcataattcaaatagaaattttcccaaatggcagctgacacaaccaatccttttttcattaatttgaaaatgtcttctttatcatatactaaattgctaaaatctgggatttttaattctccttaactaatctgttaccaccctgttttaatgacttcaactttgtgatatgtttgatatctgtatgacatcttctttcattgtacttcttcaaaatttttattagctattattgtacaatttttcttcataaattttgtgtacgtattttttctatttttcattttttgaagattgtataattttattttttattcattaatttttaaaatgcataatgacacaataattttacatatttatagggtactttttgtgtattttgagttacttttactggctaatttaaaaatagataaacaagagcatgcaataaaatgtaaattttcctccctcttggacttccaaccccatagtctgacagacagtcattgctgtgggtttgtatactcccctccagaagtagtgcatacatgtacaaatgtgtgtgtgtatgtgtgtgtgtgtgtgcatttcacacaaaaacaagagcagtgtaaattggtctgtaccttgatttttaaaaggtaacaatatattttgaattagccaggcatggtggcacatgcctgtagtcccagctactctggaggctgaggcaggagaatcgctcgaatctgggaggcggaggttgcagtgagctgagatcgcaccactgcactccaccctgggcaacagagtgagactctgtctcaaaaaaaaaaaaagtaacaatatattttggatatcatttcatgtcaacatatatagatctaccccattctttgatttattcaggttatactctggataccatgctgaatcctacacttaaacattacctcaaaatggatcaaagataaaatgtaagagctaaaactacaaaattataagaaaacaacaggataaatctttgtgatcttgaattagacaatagtttattggataggacaccaaaaccaacaagcaacaaaagaaaaaccatttgacccagccatcccattactaggtatatacccaaaggaatataaatcatgctgctataaagacacatgcacacgtatgtttattgcggcactactcacaatagcaaagacttggaaccaacccaaatatccaacaatgatagactgattaagaaaatgtggcacatatacaccatggaatactatgcagccataaaaaatgtccccgtttgcagatgacatgattgtatatctagaaaacaccattgtctcagcccaaaatctccttaagctgataagcaacttcagcaaagtctcaggatacaaaatcaatgtgcaaaaatcacaaacattcttatacaccaataacagacagagagccaaatcatgagtgaactcccattcacaattgcttcaaagagaataaaatacctaggaatccaacttacaagggatatgaaggacctcttcaaggagacctacaaaccactgctcaacgaaataaaagaggacacaaacaaatggaagaacattccatgctcatggataggaagaatgactgggttttaagacaagagcagaagtggaagttgcatttttatcctcatatcacacacctcagatctggaggtgggattgatattttcagggttcttcgctgcagcttccatgttattgctcttccattctctctctctctctctctctctctctcgtctctgtctctctctctctctcttgagatagggtctcattctgtcacccaggctggagtgctgtggtgtgatcacagctcactactgcagcctcaacttcctgggctgaagtgatcctcccacctcagcctcccaagtagctggtactataggcatgcaccaccacgcctagctaatttttttattttttgtagagatgaggtctcactgtgttacccaggctggtcttgaagtcctgggctcaaacgatcctcctgcctcagcctcccaaagtgctggcatgagccactgcacctaggcctttgttttcttttaaagctggtgcaatcaggcaataccacctgctacccttgcttaatactgtaatcaactgtcctcttggtcatgcctgctcatgcactgaagattttatctcctgaaacactgtctctttctctattatcagtgaatttaatgcccaaatagtaataaaggctgagaggaagcagtgtcctcaccaggcatctaaatttcaattagtgtgagaaggtgcagagaatacttcctgaagcaattgaaacaatttttaaagaagtggaaaggggcctttagagagaaacctaagtactgtcagccctctacattgtcaactgaagaatcctaagtttgtaaatttggagtggaaagggttgcaggctgggaagtgtagcctctggcagcaaatggaagcaagcactttgaagaaggaaggatgagataagaatttatgctgaatgagttggctaagtatacatatttaacaggttccaggaggagctgtgaatatttatgatggggcacctgcaaccacacatgttacatacattccatgttcactttggggtggagacttaacatttagatgcatgaaaattaggctgtatatgtcaaaagatgaaacagaggacacagaggcagcctctgtaaactggccagagccagtccatggtcagtggtctctcatcaggaagcaatgcttctcggttgttatgataaaactgcacaaagggaggggaatccaccacgtctttagaaaggactggtttatgtttaacccttaagaaagaaagtctaacggcagattagggagggagggaatgtaacaaggcatgcccgatctcccatcccatcatggtcagaaactcagtttttaagccatctctggggtctccttggccgagaaaggggtctcttcagtcgtttggggatgcttaagattttatttttatttttcagtatcactggatttctagtctcatattcaaacaaccattgattgaaagtattcaaaaaacaaccccaaaacaataaaagataataatacaacaataaacaataatacaaagaaacaatacggtaaaacaactatttacatagcatttatgttatattatgtactgtaagaaatctagagacgagttaaagtacatgagaggatgtgcatatgttatatgcaaatactacatcattttgagtaagagacttgagcatcacagattgtggtatctgcaggggtcctggaaccaatcctccatgcatgccaaggaacaatttcatgaaaagaccaaatattttgagttttatctagcctcaaattactataatgtagatagaggccacttttatttatctggagttagaccacagttttcttgttgatcctagtcgttttaggatttgatcttagatctcgcttatactttcagattatatktamgaatcaagbaagcagaccatataacatctaccctcacrgaatcactgatgtccgtcctttgtattcaaggagattaccaaaargtaaatattccctcgatttatagctcttttttacctgtagatacagatgagataaatatcatcaataacaactaaaattatgttggtcctttctccagctgttggccggacctcaagctccagtctaaagttataaaaatcaattataggaatcctcaggtgatgtttcatgtaaattcgtgaagagtcgcctgacatgtttttcctattacctagcggtgatgttcaaatattccacagccaattagattccactgcaattggttccactgcaactactgtaaatgccctaaaatcttgaagctggttcttctggcacttaagataatttttttttctgagtacggttttcagctacattccacacttttggtatctagtgtggtattccacactttgggtaactagtttgatattttcaggattctttgctgcagcttccatgttattgctcttccttgctctctctctctctctctctcaacagggtttcactctcacttttggtatctagtttgatattttcagggttcttcgcatattcatttctaaatagttcacaactccagtttttatttactatattgtttgctgtttaaagatttattttttcttttagtagattggatgttatgtatattctttctattatttaattttggatgaatatttatcaaaataatagatgtgtatgcttaaaactacaaaagggctgcctccctagaggcatccatttttaagaatttctgtttttgatttttggtggttatctctacatctctaaaaagttacttatactgctaactctttgtttttcaactttagacattatatacttactttgttttgtgcttttttccattcaagttgtttcagttttatcagtgttttcagttggattggctatcattagaactttaaaaatatactaaacatcaacttttagtaagatattttccaatcatggattgaaaatatcttttgactccatacttcataaattaaggatattaaaaactgtacccctcacttttcctttccccaaacctttcttttctctactgctgctagccattcctttacttttacaaaactaaacttgataacatttacattttgtgctgtaatttgaaataactcttccttgctttgtctatatattttctctaaagcttaaaaaattaaaaaacagcatttgtattattttagtattttagcaagtttcttttcataaatgttaactgcagaactgggtaatatgctatgattgctctcttttctacagctcaagtgattttactattaagataaaataatatgtggaaggaaaaaagttgatctcatagaagtagagataaaatagtggttactagaggctaaagaggggaaggggagggggaaatagggagacgttggttaatggatgcaaaattccagctagataggaggcataagtcctaatgttctatagcactgtagggtgactgtagtcaacaatgacatctattttcaaatagctagatgagaggatttggaatgttcccaacacaaaggtgtatcctgaagtaagactttgttttcttttattcggaaaagaaatgtaggcttcttcaaccctatttcttaggcctttcagcttcttaatcattctatgtattgcttgctatccaaatcttttattttttttttgagacagcgtctcgctctgtcacccaggctggagtacagtggcacgatcttggctcactgcaacctctgcctcccaggctcaggctatcctcccacttcagcctcctgagtagttgggaccacagacgcacactaccatgcccagctaattttttttattatttttattttttgtagaaatggggtgttaacttgttgcccagactggtgtcgaactcctgagctcaagcgatctgcctgcctcagcctcccaaagtgctggaaccaaatctttttcttcttaaagacattcttgtagtgaatagcattaactacttttcccttgtacatttctattttttgatttcttcttttgtttttctggaagtatattctcaagtaacttctaaatatgtggtacatagagggtgaactttctgaatccttcagtatcacatgatgggcagacagactggttataaaaattttcccgctgggtgcggtggctcacgcctgtaatcccagcactttgggaggccgaggcgggcagatcacttgaggtcaggagttcaagaccagcttggccaacatggtgaaaacccatctctactaaaaatacaaaaaaaatagccgggcattgtggcgtgtgcctgtaatcccagctactcaggaggctgaggcaggagaattgcttgaaactgggaggtgaaggttgcagtgagccaagatcaccccactgcactccagcctgggcaacagagcaagactgcatctcaaaaaaaattccttcccctgttttctaatattcattattgccgataagaattctttatttgcatttctttatggaagaatggcatagtgacagagttctggggagattttgaatgtgtgtcccgaaatttggaggcatacgtggatagttactggtaacctgcttttccatggagaattttgaaggctgtaatgcccataatagtgggcaagaagagagggcaagagtggagcagtttaccttcctgctgtttgacatgagtttattctgtaacaagtgaatactgttgaaagtagctgggctttatcccttttgaagatattctacccaagaaggcagttaggcaggctgaggggatagcagaaccaatagagtcttggatatatcactggaagtaagaagagctgatggggagaggagagttgcagaaggatagctgaaagaaacatctctcatgtcatggaactatgtaatgctgaggtccccatggtaactctaaagaaaccatacatgtgtcctatgaaaagaccagcatttgggcacctcccacacagagaacattgatgaccaaatagtgttgtcaaagatagagcagcaggatctgttaaacaagagtctgtttgccctttcttctattacctaccctccctcacccccagctcctggaaaagggaagagaaggctcagaaatattgaaagaacatactacaccattccctttctttctttctttcttttttttttttttttggagacagagtctcgctctatcccccaggctggagtgcattggcatgatatcggctcaacctctgcctcccaggttcaagcaattctcatgcctcagcctcccaagtagctgggattacaagtgcctgccaccacacctggctaatttttgtatttttagtagagatggcgtttcaccatgttgaccaggctggtctcgaactcctcacctcaacaccattccctttctatggatcctctaaccataggtcaggcataacttactgaggtgaggaagagcttagaatgaatataaaattaaaattttgatttagattgtatcttcaggtatgaaacatacccagaatgagacttaattactaaaatcagttcttgtcctgaggacccattaccctgagggcagatctcagttcttgctccctttcctcacagaagtcagagactacaccttaaaactccaatgccaagctctttggcatatattcaggcctgacactttcacagtcaaccggataatcaattacagctttttactttttaaaaaaattgtttgaatcttaaaattataataggtgcgactttagcttccacttgctcagaaacttcrtatgtacatacagatttgtagaacccttgcaacaacaacatgattatcaatatgtggcttgttgtactctaattgagctatttatggttttgcttgtgggtaggtgtaaaacatttgaaggattttccaattctgccaggagaaatattcaaatataaakggacagtgactgtagaagatgggccawctaaatcaratcctyggtgcctgaccbrctattacyctdgtttcgwtaatatggagasabvtctagcttcaggactcattggccctctcctcatctgctacaaagaatytgyasmtcaaagaggaarcmrkgtgagttcttgcctttccaagtgctgggtttcattctcagtgtatgtccccttataacctgaagaaaatataatggtttgcaatataggtcagtaaaagaaatgagcttagcttttactaaatttgagtttcacgtagtaaacgtgcctgctggatggataggccatagaatgtaggccctagatttttcctatagtactcattcccagtctgggatttagctctctctagctgatcctccccatttttatatgtccaattaccacctattttcagatgacccacagatttatatctacagcctagatttcttccatggacatctcattatgggtgactcaaaagtacctcaaaattaacatgtctgcagcatgtagcactgttgcaggaagtcagggaccccgaacagagggactggctgaagccacggcagaagaacataaattgtgaagatttcgtggacatttattagttccccaaattaatacttttataatttcttacgcctgtctttactgcgatctctgaacataaattgtgaagatttcatggacatttatcacttccccaaccaatactcttataatttcctatgcctgtctttactttaatctcttaatcctgtcatcttcataagctgaggatgtatgttgcctcaagaccctgtgatgattgcgttatctgcacaaattgtttgtaaagcttgtgtgtttgaacaatatgaaatctgggcaccttgaaaagaacaggataacagcgatttccagggaacaagggagataaccataaagtctgactgcctgcagggccaggcagaacagagtcatatttctcttcttgcaaaagcgaataggagaaatatcactgaattctttttctcagcaaggaacagccctgggaaaagaatgcattcccagggggaggcctctaaaatggccgctctgggagtgtttatcttatgcagttgaagataagggataaaatatgccctggtctcctgcagtgcccccaggcttgctaggattaggaaattccagcctggtgaattctagtcagaccagttctctgctcttgaaccctgtttcctgttaagatgtttatcaatgacaatgcatgcacagcaggacatggaacctcattagtaattctaatttcgccctaccttgtgatcttgctctgtccctatttgccttgtgatattttattgcctttgaatcatgtgatctttgtgacccacaccctattcgtacactccctcccctttgaaaatcactaataaaaacttgctggttttgcggcttgggggcatcacagaacctgccgacatgtgatgtcacccctggagacccagctgtaaaatttctctcttttgtactctttctctttatttcccagaccggccgacacttaggtaaaatagaaaagaacctatgttgaaatattgggggctagttcccacaatatagcacagtgcatctcacttagtaagagcttaataggctacgtgcggtggctcacgcctgtaatctcagcactttgggaggccgagacaggaggattgcttgagctcaggatttcaagaccatcctgggcaaaatagtaagaccttgtctacaaaaaaaaaaaaaaaaaaaaaaaattagctgggcatggtggtgtgtgcctgtagtcccacctactcaggaggctgaggtgggaagatagcttgagcccaggaggtcgaggctgcagtgagcctggatgacaaagcgacaccctgtctcaaaaaaaaaaaaaaaaaaaaaaaaaaaagcttaataaatacttttgggcaaaacatagggaaagatataaaatatttcaaaatatggctagaatttggaccatttctactgctttaaaaaataaagctaaattctctgaacaagaaaagcttagttcttcacaaaaactcattgctcggccccagaataactcagtgccatattgctgaggcttgactacatgtccatttgattatatttatgatacataagatccctactagtctgaaaacatttcatatgtttagagagtaaagtatatgaactttggtgccaataaaacacatggcacataaactcagagaagtataaattttgccaagtacttgtcctgaccgatttttcctaactatagttttttcgtcacttttgggaagagaactgaaatattattctatattctccaatctcctctcttcagtattttggtttatatagctataggttataaaaaatgaggtttatacatattagtgaggtttacatatgaaatcttagcagatccaattagcaagcgactaattcataaatctggttcatatacaaaatgctcttctgaaaaaaatttgaatgttttaaacagaaaatttaaggtattagtgttgtttgacatttttgtggttcaccttatctttcttatttgatttctgtttttctatttttaattttttatagccttgtggaaggtcagttgctagatggaagtttaggaaagtcagtatctcatttgacttaactaacttaagaaaggcactgaataaccacttggttctttaaggagttaaatcttctaatctgaacatgaagagaataaggctacagactgtaccaaataaatcagctagcatatggccttgggtgcagaaaaaactaagttcagtgggatcagtcaccctcttgtcctggggacacatttgttgtaagcatatactcactgctcatagcacccaccctcaactcccaagccctggtacatgcctaagaggaaatggaattaaaccaatggattagatatatcacatgcatgccatcgctttcatcatagactgctagctcctacctgacaacatcagtagcatttctttacccstttcaatatatgtaattaacagabartgtmagrcaagaggaatgtcatcctgttttctgtatttgatkagrasbgaakstgsymcctcacagagawtatayaaygctttctccccaatccagctggagtgyagctygaggatccagagttccaagcctccaacatcatgcacagtgagtaaagcagcacttaagtccagtgggtggtgaataaagaaaaattgatgtaatcaaagtgatgtccagataatgaatgaattgtatgtgcacataaatttaacaattatgttacctataaatgtataatttttactcaaacacacgtgatcatataacccatattttaaaaatccagtcaccattttttcctttcaatatttacttgatttccctctcccttttaattccctatctccttctatattacatcttttcaccaaccattccatgcccaggtaacatattttaagacatattttctctataattatataatcatatataaacacatacatacattgtattagtcttctagtgctgccataacaaagtactgcagactgggtggcttaaccagcagatatctattgtcttacaactctggaggcttgagatcaggatgtgggcaacgttggtttcttctgaggcttctctccttgtcttgtagatggctttctcccttgtcttcacatggtttctcctttatatatctttgtcctaatctcctcttctaataaagataccagtattgttgggctagggcccaccgtaatgaccttattttaactaactacctatttaaaaacactatctccaggtatagtcacatgctgaggtactggggtttaggactgcaaggtataaatttgggatgggggaacacaattcagcccattgcatacatacacatgtgtatatatttatatataccacaaatctgaatggtcaaaaatatggtaaaaaattccaattgcactatcctacagggaaatgcgaaatagaataacaataggatagcactttatacccatcaaactgccaaaattataattactagtgggcttgtggataaaagagtgttctcatgctatattagtggataagtagtatagtcttttcaaaaccaatatatgccttttgaaattctgattattaagatgtttaagatggagtgagccacatttccctgtgtgtcccactggatgcaactaaaaatcctgaacaggccgggcacagtggctcacgcctgtaatcccagcactttgggaggccgaggcaggcggatcacgaggtcaggagatcgagaccatcctggctaacatagtgaaaccccgtctctactaaaaatacaaaaaattagccgggcatggtggcggccgcctgtagtcccagctactcaggaggctgaggcaggagaatggcgtgaacccggaaggcggagactgcagtgagccaagatcgtgccactgcactccaggccggcgacagagtgagactccgtttcaaaaaaaaaaaaaaaaaatcctgaacgaaatgcatgggaaccttgaaaagttataatgtgagttatactcacctaccagaatgtggcatatgttacaattctatgcccctcctctcaaagctttagccctttaactttgggttgagcctcatatttagcttgaatttctagtaatagtgatatattattctccagagttaaagtcctttactatccattattctaaaaattttaaggttgtttagtcctttgagttgcatttttattttttacatagttcagggtattgctttccttctgaaggattcagatttcacatttgtgcaagagtctaatgcttagtatttaattctagtggcacagagctttttcttttctccctcttctctccagcctcatggctttggtttagaattccttcagcctgatagaatattgtattttataatttccttattgtgctatttactagatatttgttcttctatttttttctattcataatttctccctttcccaccacatctttttccaagtaggatgtgcacttgccacagtatctggacagttaaactgtctcattttcttggagacggtgatgaaaactagagagatatagtgacataagcagagccagaaaacaatttcactgaagatgatatatattttttttcctctgggatttctaatatagcttttggtggagataagagtctggaattgagaaagaagagattggaattgagaaaaagagtctgagaaagcacagggagagacacaaaggcagagaccaagagacacaggggaaggatcttcagaggaagagtccagggagaaagatgctaagacagagggataagaaaagaagaaaaaaaaggaccaggaggagagagacccaaaccataaatcactcctatttccattagcagtaaaattgataatctattttcatacaatgaaataccatgtgacaatgaagattcacaaaaataaagctatacacaacaatatgaataagtatcacaaagacaatttttagtaaaatggtaagtgtcaaaagaatatatacagtattatattatttacataaagttcaaaaatgggcaaaattaacttatatagtttagggatacagaggaagaaaagtataaaggttagtaaggacatgattataataaaagacaagatagtggctacctcttagaaagagttcatttgagaataaacacatgtgttttgtggggatagcagcaatattgtatttcatgacctagatgtttgttttataattttgtgttttaaaaaattgtaggatttatgatttatttcgtagatggatcctacaaatgatagggaaattgcagtaggaatgaagaggaaggaacatgtacaggatttgtttagaagatagaaggcacatgattttgtaaataattagctatgtttggtaaaggactaagaggattcaaagatgattaccaaatttctgatatgggtaactagaagaagagtgagacaaaatggaagaaagtgtatttaaagaaatgatagcaaaaactttccaaatctggagaaagatgtaaatatccacgtacaagaagctcaaagatctctagtcagattagattcaaacaagactatatgaagacacgttacaatcaaactgtcaaatatcaaagacaaagagagaatcctgaaagcaacaacaaaaaagaagcaaaccacatacaaggaaattccaataaggcagaaactttacaggtcagaagagggtgggatgatatattccgagtactgggaaaactttacctagaaaatgtttccttcagaaatgcagagagataaagactttgccacacaattccagttagacaagagaaataaattaaagacatctattgtacactatggtgactacagttaataaattacccattccaatatatacatatataaacattgtgatgtacatcataatatattctatttttccctgtcaattaaaaaataaatttaaaaagattggatagagaagaatcagccattctagtaattaagcctgaggaagcttacattccagtgatttcagataaccattatgcaagttaaggaataaactggataggatgatattaaaaaaacaaaaccaccaatgagatacaccagaatggctaaaattaaaaaggctgtccataccaagtattggtaaagatgtagagtaatgagaactctcataaatttctggtcaggaaatccaaacatcgaaagccaaacatcggcataccctattgactcaggaaatccactcctagtatacacctgttatgtcctgaatcatgtcccctagaattaatatgctgaagccctaacactagtatttcagaatgtgactgtatttggagatagggtctttaaggggtttattaagttaaaatgaggttgttacaatgggccctaatccaatatgactagtgtccttataagaagaggaaatgtgggccaggcacagtggctcacgcctgtaatcccagcattttgggaggccaaggcgggcggatcacgaggtcaagagatcgagaccatcctggccaacatggtgaaaccccatctctactgaaaatacaaaaattagctggacatggtggcgagctcctgtagtcccagctactcgggagactgaggcagaagattgcttgaacccaggaggtggaggttgcagtgagcagagatcacgccactgcactccagactggcagacagaccgagactccatttgaaaaaaaaaaagaagaggaaatgtgtacacacagagacaccagggatgcatattcacagaggaaagaccaagccaaggagaggtgtcagtaaaaaccaaacctgccaataccttgatcttggaattttagtgttcaaaactgtgagaaaacacattcctgttatttacacctcccagtctgtggtatattgttatggcaaccctagccactagtacagcacccaaaagtagtgtgtacatatttcacaaaagacatgtaactatttaatccatgtggagtgtcaaaaggcaaaaatacaacaaatgtattttaaagattgtaattggcttttatacatgattctagaatcagatagccctcagaaccaaatacagaacagcagccagcaacatagtatggatagaaattggaagtgaggtttagagacagcttaattgattacagttgggcatttttgccttatttgaagctgttagtcgcctgcaattgatggaagttcagctgctataatcggctgagactgagctgtttgttataaaagcatattcctaaattaggctttcagttagttcatcaactaagccaggctgcaactttgttgtgcaaggactcaagtgcaaaggtacccttaggcaaaattcagattaatttaaaaggactttacttttgttagttatgtgaaatgaagtggaatctattttttccaagtggatagtcatattttctattatcatttaccaactagctgatttttttcctgtactggttggagatgctgcctttattatatattaagtttcaacttattatatattaagtttccgcttacatcttgtcagtttctggactccatattttgtttgatatatttatctattctgcattaagactgcatttttaattataatagctttataatatctcaatgttgtataggaaaaaaacttcaattattaattagttatactaagccaatgtctaagtattgcttagtggtttgtgggcaaccatcttacacagtacctagtaacagagtagacaagtgtttattgaatggatggatgaatggatgtgtggaagaggctttcagaaacaattcccttcatagactaaggccaatgttacttttgcttagctctttagtttgaaataatttaaaatgtacagaaaagttacaagaataatacatggaacttgcacacaccctttacccagattcacaaatgtttaacattttgcaattttgtttttcattttcttttctttatatacacacttctgttacttattttctatttgaaaattagttgcagacatcacatccctttacctctcaatactttagtacacatttcctgtgaataaagatatcttttacataacagacacttcaaattgataaagcacatttccataatttacaactggtattccagttgtatcaaccaatgctgtcatttatagcattttcttctttgaagtacagggatctagtacaagtaactacttgtcctgcttctttcatttccttgaatctggaccttcatcagatggtaactttaagcacccaaaggtttttttctggtttctcctctgtgtagtttaagaccatgcaaacatcttgctactcatcaaaatgccccccatataacatccaaattaatctttatcatgatggtttatgactgtctcctcacattgggattggggcccaactgattattaacaatctacttttttggaagatataatatctcttcctgggaataagataatgggcataacatataataattcctaattgtatcatgacaatcacaatccaaaatactaaatctgtgatgtgtctaaatctcttttccccattgtttttgcaggcatcaatggctatgtttttgatagtttgcagttgtcagtttgtttscatgagryggcatastggtacattcyaagcattggagyacmgactgacttcctttctgtcttcttctctggatataccytcaaacacaaaatsktcwrtgaagacasactcaccckattcccattctcaggagaaactgtcttcatgtcgatggaaaacccaggttagttattatatttttcttgtaccaacagctgtgaatgcttcactagccattcgtatgctcttttgcccactagctcacatgctgtcatttatagcattttcttccttgaggtacagggatctagtttctcctctgagtagttattattttcacccttgcaactaataaacagtttgaaggatcacgtagtagttctatttttagttttttgaggaacctccttactcttttccacagtatttgtacttatttacactcccaccaacagtgtacaagcattccccttttgccacatcctcaccagcattttttaattattttgtctttttgataaaagccatttaactggagtgaaatatctcattgtgcttttggtttgcatttctctggtaattagtgatgttgagcagtttttcatatacttgttggccatttgtatgtcttctttttttttttttttttttttttttcagacggagtctcgctctgtagcccaggctggagtgcggtggcacgatctcggctcactgcaagctccgccacccgggttcacgccattctcctgcctcagcctcccgagtagctgggactacaggtgcccgccaccacacccagctaattttttgtatttttagtagagacagggtttcaccgtgttagccaggatggtctcgatttcctgacctcgtgatccacccgcctcggcctcccaaagtgctgggattacaggcgtgagccaccgtgcccagcctgaatgtcttcttttgagaaatgtctattcagatctttgtccatttttaatagggttctttgttttttttgctattgactagagtttcttatatattctggttattaatgccctctcagttgtatagtttgcaaatatttcatcccatcctataaattgtctcttcactttgttaattgtttcctttgctgtccagaagctttatggcttgatataatcccatttgtctacttttgctttagtcccctgtgcttttgaggtcttacctgcaaaatctttcccagaccaatgtcctggcgcattcccccaatgttttcttccagtagtttcatactttcaggttgtatattttagtctctaatccattttgatttgatttttgtatatagtgagagataggggtatagtttcattcttctgcatgtggatatccagttttcccacaccatttattgaagagactattctttcaccagtgcgtgttcttggcactttgtcaaaggtgagttggctataaatgtgtggatttatttctgggttttctgtcgtgttccactggcatatatttctggttttatgccagtaccrtgctgtttttgttactacagctttgtagtatagtttcaagtcaagtagtgtcatgcctccagctttgttcattttgctccagattatttagctgtttggagtcttttgtggttccacacaaattttaagattcttttttctatttctgtgaaaaacttcactggcatttggataggtattacattaaatctggtagcattgatattttaacaatattagtttttccagcccattaaaatgggatagataccttttcagttttttgtgtgttcttcaattccctttatcagtattttagttttcattatagagatatctcagctctttggtttaatttattccaatatatttatttttattatagctattgtaaatgatttttaaaaaatttctttttaggttgttagctcttggtatatagaaatgctactgatttttgcatgttggttttgtatcctgcaactttactgaatttgtttatcagttctaatagttttttgatggagtctttagttttttgtgaaatataagattatgtcatctataaacaaggagaatttgacttcttcctttccaatttgggtaccctttatttctttctcttgcttacttgttctggcttggacttccaggactacattttatagaattggtgaaagtgggcatccttatcttgtttcagatcttaaaggaaaggcttttggttttccacatttggtatgatattagccgtagtttgtcatatatggcatttattgttttgaggtaagctttctatacccggtttgttgagagttttctcatgaagggatgttgaatttaatctttttggcatcaattgaaatgatcatttgtttttgtccttcattctgttgatatgatgtatcacattgattcatttccatatgttgaaccatccttgcatccctgggatgaatcccccttgatcatgatgaatgatcttttactgtgttgttgaatttggtttgctagtagttcgttgaggatttttgcatcaatgttcatcagagatattggcctgtagtttctttttgtgtatgtgtgtgtctttgtctggtttggtttcagggtaatactggccttgtggaatcagtttggaagtatttttcccccttgatttttgggatagtttgtgaagagctggtattagttctttttttttattattatacattaagttttagggtacatgtgcacaatgtgcaggttagttacatatgtatacatgtgccatgctggtgtgctgtacccattaactcgtcatttagcattaggtatatcgcctaatgctatccctctccccttcccccaccccacaacagtccccagagtgtgatgttccccttcctgtgtccatgtgttctcattgttcaattcccacctatgagtgagaatatgcagtgtttggttttttgttcttgcgatcgtttactgagaatgatgatttccaatttcatccatgtccctacaaaggacatgaactcatcatttttatggcggcatagtattccatggtgtatatgtgccacattttcttactccagtctatcattgttggacatttgggttggttccaagtctttgctattgtgaatactgccgctataaacatacgtgtgcatgtgtctctatagcagcatgatttatagtcctttgggtatatacccagtaatgggatggctgggtcaaatggtatttctagttctagatccctgaggaatcgccacactgacttccacaatggttgaactagtttacagtcccaccaacattgtaaaagtgttcctatttctccacatcctctccagcacctgttgtttcctgactttttaatgatcgccattctaactggtgtgagatggtatctcactgtggttttgatttgcatttctctgatggccagtgatggtgagcattttttcatgtgttttttggctgcataaatgtcttcttttgtgaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagttcccatttgtcaattttggcttttgttgccattgcttttggtgttttagacatgaagtccttgcacatgcctatgtcctgaatggtattgcctaggttttcttctagggtttttatggttttaggtctaacgtttaagtctttaatccatcttgaattaattttagtataaggtgtaaggaagggttccagtttcagctttctacatatggctagccagttttcccagcaccatttattaaatagggaatcctttccccactgcttatttttctcaggcttgtcaaagatcaggtagttgtagatgcgtggcgttatttctgagggctctgttctgttccattggtctatatctctgttttggtaccagtaccatgctgttttggttactgtagccttgtagcatagtttgaagtcagggagcgtgatgcctccagctttgttcattaggcttaggattgacttggcgatgcgggctcttttttggtttcatatgaactttaaagtagttttttccaattctgtgaagaaagtcattggtagcttgatggggatggcattgaatctataaattacattgggcagtatggccattttcatgatattgattcttcctacccatgagcatggaatagtcttccatttgtttgtatcctcttttatttccttgagcagtggtttgtagttctccttgaagaggtccttcacatccgttgtaagttgtattcctaggtattttattctctttgaagcaattgtgaatgggagttcgcttatgatttggctctctgtttgcctgttattggtgtataagaatgcttgtgatttttgtacattgattttgtatcctgaggctttgctgaagttgcttatcagcttaaggagattttgggctgagacaatggggttttctagatatacaatcctgacatctgcaaacagggacaatttgacttcctcttttcctaattgaatacactttatttccttctcctgcctaattgccctggccagaacttccaacactatgttgaataggaaaggtgagagaaggcatccctgtcttgtgccagttttcaaagggaatgcttccagtttttgcccattcagtatgatattggctgtgggtttgccatagatagctcttattattttgagatacgtcccatcaataccaaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttttgtctctgcccggctttggtatcaggatgatgctggcctcataaaatgagttcaggaggattccctctttttctattgattggaatagtttcagaaggaatggtaccaattcctccttctacctctggtagaatttggctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagcggtctatcaattctgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccatctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttgttttacatttgctgaggagagctttacttccaactatgtggtcaattttggaataggtgtggtgtggtgctgaaaaaaatgtatattctgttgatttggggtggagagttctgtggatgtctattaggtccgcttggtgcagagctgagttcaattcctgagtatccttgttaactttctgtctcgttgatctgtctaatgttgacagtggggtgttaaagtctcccattattattgtgtgggagtctaagtctctttgtaggtcactcaggacttgctttatgaaactgggtgctcctgtattgggtgcatatatatttaggatagttagctcttcttgttgaattgatccctttaccattatgtaatggccttctttgtctcttttgatctttgttggtttaaagtctgttctatcagagactaggattgcaacccctgcctttttttgttttccacttgcttggtagatcttcctccatccttttattttgaggctatgtgtgtttctgcacgtgagatgggtttcctgaatacagcacactgatgggtcttgactctttatccaatttgccagtctgtgtcttttaattggagcatttagtccatttacatttaaagttaatattgttatgtgtgaatttgatcttgtcattttgatgttagctggttattttgctcgttagttgattcagtttcttcctagcattgatggtctttacaatttggcatgattttgcagtggctggtactggttgctcctttccatgtttagtgcttccttcagaagctctcttaggtcaggcctggtggtgacaaaatctctcagcatttgcttgtctgtaaaggattttatttctccttcacttatgaagcttagtttggctggatatgaaattctgggttgaaaattcttttctttaagaatgttgaatgttggcccccactctcttctggcttgtagagtttctgccgaaagatcagctgttagtttgatgggcttccctttgtgggtaacccgacctttctgtctggctgtccttaacattttttccttcatttcaactttggtgaatctgacaattatatgtcttggagttgctcttctcaaggagtatctttgtggcattctctgtatttcctgaatttgaatgttggcctgccttgctagatttggcaagttctcttggataataccctgcagagtgttttccaacttggttccattctccccatcactttcaggtacaccaatcagttgtagatttggtcttttcacatagtcccgtatttcttggaggcttcgtttgtttctttttattcttttttctctaaacttatcttcacacttcattttattcatttcatcttccattgctgataccctttcttccagttgatcgcattggttactgaggcttgtgcattcatcacatagttctcgtgccgtggttttcagctccatcaggtcctttaaccacttctctgcattggttattctagttgtccattcgtctaattttttttcaaagtttataacttctttgccattggttcgaacttcttcctttagctcggagtagtttgatcttctgaagccttcctctctcaactcatcaaagtcattctccatccagctttgttccattgctggtgaggagctgcattcctttggaggaggggaggtgctctgattcttagagtttttggtttttctgctctgttttttccccatctttgtggttttatctacctttggtctttgatgatggtgacgtacagatgggttttcggtgtggatgtcctttctgtttgttagttttccttctaacagtcaggaccctcagctgcaggtctgttggagtttgctggaggtccactccagaccctgtttgcctgggtatcagcagcagaggctgcagaacagcagatattggtgaactgcaaatgctgctgcctgatcattcctctggaagttttgtctcagaggagtagctggccatgtgaggtgtcagtctgcccctactggggggtgcctcccagttaggctactcaggattcagggacccacttgaggaggcagtctgcccgttctcagatctcaagctgcgtgctgggagaaccactactctcttcaaagctgtcagacagggacatttaagtctgcagaggttattgctgtcttttgtttgtctgtgccctgcccgcagaggtggagcctacagaggcaggcaggcctccttgagctgtggggggctccacccagttcgagcttcccggccgctttgtttacctactcaagcctgagcaatggcgggcacccatcccccagccttgctgccaccttgcagtttgatctcagactgctgtgctagcaatgagcaaggctccatgggcgtaggaccctctgagccaggtgcaggatataatctcctggtgtgccgtttgttaagcccgttggaagagcgcagtattagggtgggagtgacccgattttccaggtgccatctgtcacccctttctttgactaggaaagggaattccctgaccccttgtgcttcctgggtgaggcgatgcctcgccctgcttcggctcacgcacagtgcactgcacccactgtcctgcacccactgtccggcactccccagtaagatgaacccggtacctcagttggaaatgcagaaatcacccgtcttctgcatcacttatgctgggagctgtagactggagctgttcctattcggccatcttggctcccaatgcaaagaccttcaaacaacgtgacttcattttctcactcctaccttttgtgctcttgtcatttatttgaattctacatatattttaaaccccataagacattattattgttttatataatcaatatcatttatatatatatatatatatttacacctttcatttctttcattcttttctgcatttcttgcttccatctatgatcattttctttttgtctgaagaaacttctttggaacttccttcagtgtgtgttggctagtaaaaagttctctgtcagtttttggtcagaatgggtctttattttgcctagataccaagtccttggttggatttacatattgtgaatgttttctcccagtctgtggtttgtcttttcactcctttaagggtgcattatggttaatagaagttcttacatttaattaattcttatttttcagttttttatggttaatgccttttgtattctgtttcagaaatttttgcctatcctaagaacatgatgccatccttctatattttctttctacatattttaaatattttcttctagaagtctgattgctgtgttgttcacaattaagtttatgattcatttttaattaattttgatggagtgatgcagataaaagttcatttttccatatggatatttaattgctctagcaccaattgttggaaaaaaataatttcctcactgaattgcactgttgtctttgccatgaatctgatgactgtatcactgtagctttgtttctgtactctatttcaggggtaggttatgatccacaagccaaatttgcagcttgtttttatatggcattgagctaagaatttttttacatttttaaagaattgtcacacaaaacaaaaaaaaagcaaaaaaacaaataaggatatgtatcatggaccatatgtgtctacaaacctaaaatatttactatgttgctttttacagaaaaagtttgccaacccctgatctcttatattccattgacttattggtctatctttgtaccagtaacatactatcttatagtaagttttaatatttgttagtataattcctccaactttgctctctttgatttttatataaattttagaatcatcttgtcaattttatcaataaaaatatcttctgaggttttgatagggattacattgattctgcagatcaatttgggggagcatacctcttgacaatattgagtattcctgtccatgagcatggtttagttatttatttacatcttttaaattttctcttggcaatgtttttgtaaaattttagtgtacaggtcttgcacatttttgtaaagtgtattctttggtatttaatgctattataatattttttatggtatcagtttttgtcaattgtgtttttctagaaatatgtccctttcatctaagttgtttaatttacttgaagtaagttatttgtaatgttcttttatcatccttataatgtctgtactgatgtctccgttttcatacctgatattgttatttatattttatctattttaagtttatcgcctgcacccactaactcgtcatctagcattaggtatatctcccaatgatatccctcgcccctccccctagtgcacatgtaccctaaaacttaaagtataataaaaaaaaaaagtttgtcgcctttgttataggttcatcaaatttactaatcctaccataggatcaaatttttgctttgttcatcaggtcatggaattaaaaaaatttttttgttttgtttattttctatgttgaatttttatttttattttgctttgcatttcatttatttctggtcttttgttattattccaatactttctctggattcagttttctttttcttcttgacttcttgagattaaaacttggttcattgattttcaacatttcttactttttaaaagttcatacaaagcataaatttccctttatatactgctttaaccccatatcacaaattttgatgagtcatatttttattatcattgagtttaaaatattttataaattttacgttatttcttgttttattcatagttattttacagtgttttacttaatttcccaatatatggcgattttctggctctctctctgttgctgatttatttgttttactgtgatcacataacatactctatattatttcaatcatttgaaatttgttgagacttgctatatgcccagtgaataatttaatttgattaatggcccactgcatttgaaacaaatatgtctttgctgttattgggtagagtgtcatatatttgcctattatgtcaagttgctttatcatgtttttaaaatccttataaacttcctgatattttatctgtttcttacagacatggaggaaactgtgacatctctgtgattgttgagtttgttattttgatttttgtatttgttagtaagaatgtttcaaaataaatgaggcaatataaaatcaggtgcttacaactttaaggttgtattcttattaaatcaattctttcatctttgtgaaatgtcctttttgtctgaagtagtacttgttgccttaaacgtctgcattgtctaaaatttatacacctgcactatcatatttattttgcttaatgtttgtgtggtatatatttcccattcttttcttttcaacctatctctatccttatatttacagtgtgtcttttttaacattttctgtagtgcaagtctgttggttaattaattttgtcagtttttgcttctctgaaaagtctttatttctgtttttgaattatatcttcactgtgtatagaattctgggtttgtggttgttgtttttgttttattacattttgttttattggtttttccctcagcactttaaaaatgccgctccattgtttctacttgcatagtttttcacaataagtttgttgtaattcccatttgcattcaactgtacataatgtatctttttaaaaaaatctggatggcttcaagctctttactttgatttttgtgtgtgtgtgtgtgtgtgtgtgtgtgtgtgtgtgtgtgttactttggcattctctaggcttattcaatctgtaatttggtatcattaattttgaaaaatatttatcatctgtgtcttcaaatattgcttctaattctttctcttcttctggtattgcatttacatatattatactgttcaattttgtcacacagctcttgaatatgctgttctagtttgttttctaactatttttccttctagttgttcagttttgttgacatttattgacctatttttacttcagtaattgtttcctgggttgttgagttaattgatgaactcatagatgacatacaatttatctttttattcttgtgtcacttgtgcttttgatgtcacatctaggaaggctttgtctagcccaaggccacatttacttccatattttcttctaagagtttgatagttgtagctgttacatatatgtctatgatctagtttgaataaatttttgtgtatggtgtgaagaagaggtctaacctcttttttattttttgcatgtaaacatccagttgtcccggcaccatttgttgaaaatatgattcttttcccattaagtcatcttgacacccttgttgaaaatcaattgaccataaatgtgagagtttatttctgaactctccattctgttccattgacccatacgtcttctataaattcttatagctaattctacattagactttggtttttcagatgtggtcatctcattagattatggtgatatgtttggttacaagttttatcttctccttggcaacattttttttattactgctcttcttttattcgtttttgttgttcctttctctttttgtgagacagggtctcactctgttgcccagggtggagtaagtggtgtgatcatggctcactgcagcctcaacctcctgggctcaagcaatcctcccacctcagcctcccaagtagtgggactacaggcatgcaccatcatgccaggctaacttttttattttttgtagagacagggtcttgctttgttgcccaggctggtcttgaactccaagctcaagcaatcctccaacctcagcttcccaaagtgctgggattaccagtatgagccactgcacctggccttgttgttcctttcttccttttatcttgtagtatcttgatcctttttgcttattatttatcattgaggtgagtttgttctaaataaacttttcgcagaaagtttatgtagatatattaatatcaatgaggcattaggagtgagttttagattagcaggaattctcttatgaaaggtattgattgtatgtgtgagttttcagcctttacttctctccagcccatcaagatcaaagctgcagagttgtttacatttcagaatttctttcctcccctccccaccttgcaaaacagacttacagtgcaaaaatgacttgtcaatgtgattctttcttctggtcccatctttcctaccttttgagacttgtgttgaaaggagtccagtaaaaccaccgatgctagcttgtataccctgatcccattgttataatgaatgactgactgtttttcatatcaaagtataatacttgcaccttgatagaagaaagaaacaaggccaggcacagtggttcatgcctgtaatcccagcactttgggaggctgaagtaggaggaataattagactttgatattaaaaatggggaagatatggcggtataagatatgaggaagtatgtcttcttggacttttctgaaatctgccagccatgagcatccactctttttatcttttgatacctgttttatattaactatacttctattttgtggtttcatggcttcagatatcttccagcttaattgtactctgtctttaattatttgcagcaatttctgaaaggagcaagaagaaaggccagccctttcttcactaccttaaaaactggtcatcttttgaaaccccatgaaaggcacagtgggtgaccatctacatcaggagtgggcaaactatggcccttgggtagtctggtctctgtccgtttttgtaaggttttattggaacccatacacacacaaactgatcatctcttgttatgtgttaagttttcttataattattcttttctatttcatccagctgaattaccatttcaccttgtgtatgccctttccagtcttaaattatagaagctatgtctttgtggttttaaattatggaagctgtgccttcttgtgttttagtatggcaagatatttgttcttacttttcctctagaatctgcagtggattactttcagaagtaggtattgcctctaagtttcctgacttctgtttccttctccctgttctgtagtatatttatagattgcatgttttctcgtccttaaacaaggtacaaatatgttctgatcaaggtttgctagccgagaggataagtggcttgctcttagcctaactctctgtctacttaatggatgtcgaattcccttctcaactcaacagctagtaactagttccaagatcggataatagcttacagaattaattagttcagtgaaagccctggtttgatcacagaggcaggagactgatctatatatttgtagtgctgactagaccccaacttggccagatagcttatacctatgtcagaagttggaggaggagattgacagctgaggtgtctccaagggaattacaattattttcattttctttgtgtctgtaattatgtctcttttcttacttcaaattttgtatatgtgaaatttcttaatttttatttggttatttattttattgactttttcatcaaacaaccaactctaagttcttggattgaaatttatgaattaattataatgttttaaatttaccattagtcacacatacaatacaaaaagatattttcattacaaaattttaacccaagccattaaaactaaactccagcttggtcaccattcctaataccaggcccctctcagaggggagggtaaataaaagtccattttggtaactagtttgacgagaatctctaattgtttccctgtttttcttataatgtctgcctttgaattatcctctttttttcaagagttccatcatataatgtattcctttttgcttacagattgacctcctagaggcatgcatccccctgctccagtctgagctggttctctctaggcctgaggctcagttatcaacttgggacttttatttaccctccctcaggataggtacctggttcttggataccaggtcttactcttgtttgagatactcctttattttggtggcaaacattccataatcacttcctgataatggtgacatttgaggtagattttctgagtctttatatgttagaatatgtttttattctcctttgccacttgattgataatttggctgcacatagaatgtaagcattcacagggcttttgggagcagcttcccttgagaagaaggtggatgcagttaagatcttccctgaaaagactgtgtgaaatgacaaggctattgaggtacccaacgggtagcttggtaaaggtgtatcttgtctcttatgtttatgcatctactttaccaccatgtaattagcctattataacttgttgcattccttcactcagctaatcttgttcatggtagaaattaatattgctagtaccatggtagaattttatattagctggatcctagacctaaatgmtccttccttgtgcttacatattctgcaagtgggtgacagtggatgctaggtattgtgttatgtgatttcaatgtattatatgatggggtagatactattagcctcatttgaaaattagaaacctattgttcagaaagtttaagtgactttctcaaagtcacacagctggtaaatggtagaactgggatttgaatccaggcaatctgatggatttaagaggaacctgtgccactatgtgatatagcaataacatctagccaatataaatactttcctgaattaaatcactgtcatattcagagagttctgtgtcactattaagaccctccattattgtgtatattaattacatttccctattttaatcccaatatctattcatttttatcacagtcctttcttatggtcacaaacaggcatagtacaacagcagcaatgcaaaaaccacttttatattacatgttccagggatttaacccaatgacctgtgatataatgatactgactagtattttttcatttatctgggaatgggagagaacctctaacagaacgttttagaatctgtgttatgagtaaccagagtcttattcttcctcatctccaggtctatggattctggggtgccacaactcagactttckgaacagagrcmtsaccrccttacwgaagktttctagttgtgacaagaacactggtgattattasraggacagttrtgaagatatttcagcatamtwgctgagtaaaaacaatgccattgaaccaagaagcttctcccagaattcaagacaccctagcactaggcaaaagyaatttaatgccaccacaattccagaaaatgacatagagaagactgacccttggtttgcacacrgaacacctatgcctaaaatacaaaatgtctcctctagtgatttgttgatgctcttgygayagagtcctactccacatgggctatccttatctgatctccaagaagccaaatakgagactttttctgatgatccatcacctggagcaatagamagtaataacagcctgtctgaaatgacacacttcaggccacagctccatcacagtggggacatggtatttacccctgagtsaggcctccaattaagattaaatkagaaactggggacaactgcagcaacagagttgaagaaacttgatttcaaagtttctagtacatcaaataatctgatttcaacaattccatcagacaatttggcagcaggtactgataatacaagttccttakgacccccaagtatgccagttcattatgatagtcaattagataccactctatttggcaaaaagtcatctcsccttactgagtctggtggacctctgagcttgagtgaagaaaataatgattcawagttgttagaatcaggtttaatgaatagccaagaaagttcatrgggaaaaaatrtatcgtcaacagagagtggtaggttatttaaagggaaaagagctcatggacctgctttgttgactaaagataatgccttattcaaasttagcatctctttgttaaagacaaacaaaacttccaataattcagcaactaatagaaagactcacattgatggcccatcattattaattgagaatagtccatcagtctrgcaaaatatattagaaagtgacactragtttaaaaaagtgacacctttgattcatgacagaatgcttatggacaaaaatgctacagctttgaggctaaatcatatgtcaaataaaactacttcatcaaaaaacatggaaatggtccaayagaaaaaagagggccccattccaccagatgcacaaaatccagatatgtcgttctttaagatgctattcttgccagaatcagcaaggtgratacaaaggactcatggaaagaactctctgaactctgggyaaggccccagtccaaagcaattagtatccttaggaccagaaaaatctgtggaaggtcagaatttcttgtctkagaaaaacaaagtggtagtaggaaagggtgaatttacaaaggacgtaggactcaaagagatggtttttccaagcagcagaaacctatttcttactaacttggataatttacatkaaaataatacacayaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtakaaggttcatatgasggggcatatgctccagtacttcaagattttaggtcattaaatgattsaacaaatagaacaaagaaacacacagctcatttctcmaaaaaaggggaggaagaaaacttggaaggcttgggaaatcaaaccaagcaaattgtmkagaaatatgcatgcaccacaaggatatctcctaatacaagccagcagaattttgtcacgcaacgtagtaagagagctttgaaamaattcagactcccactagaagaaacagaacttgaaaaaaggataattgtggatgacacctcaaccyagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaawaacctttctttagccattctaaccttggagatgactggtgatyaaagagaggttggctcccyggggacaagtgccacaaattcagtcacatacaagaaagttgagaacactgttctcccraaaccagacttgcccaaaacmtctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttrrgataaccactatggtactcagataccaaaagaagaktrgaaatcccaagagaagtcaccagaaaaaacakcttttaagaaaaaggataccattttgtccctgaacgcttgtgaaagcaatcatgcaatagcagcaataaatkagggacaaaataagccckaaatagaagtcacctgrgcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacayttdtgatgaggatgaaaatyagagccccyrcagmtttcaaaagaaawcabgacactattttattgctgcagtgragaggctctrggwttatgggatgagtagctccccacatgttctaagaaacaggtatgaatgcattggttattcctttgctctgctcttgtgacatttgactttaccagatgatgacaccaacaatgagagttagaggatgaaaaatcaaggtgtcttgaaactcttactctggtgagatagagagaagagaggtttacaagagggtagaggaatcagggacaagaaggagcaatggggagcaggaagaaagtcaacctcacctatcaaccttatgagctgcaggggaaatcttagtctcatcagagaactttaagcaaggcagaaggaagaagcaagttcgtgttaaagaggttaaggacttggggaggattggttttcatgatactggggatccagagggcaaagtaggatgattttatttttaggtgagtagagggaggttgagcagtcaagtagtacagagaaatgtggaatataaacataaggagagtcagtcagtcacaaatatttatggaacacctactacatgccagacacttttgtacacattggagtgcagcacagcaggagcttatattctattggaaagagcaagagacaagttagtacaaaactaaataaggcaatctcaattgtgttgttcagaagatagaatagaataatatggtagagagaataatatgatagagtaatacggtagagtgttacattagctgtggtggtcatagaaatcatctttgaggagttgagacctaaatgatgataacaggccagctgatggagctctgagagaagatgtttccagacagagggaagagaaaatgcaaaggccctgagaatggaaaaagtttaccatgtttgaggaacaagaagggacaagcatgacttgtcactttcccaccttgctttctagctcaagtaagcccttattgctgcattgcaaccatagactatttccctagtccactgactttctcattctcctggacctctatcttagattttctgtgttttccttaaatctcgagcaccttttttccattctccaatgcccattttcactcttagctgatgctgtgcaatgaacctccacagactcccaacatcacatttactggcatttgtacccatatactctgcctgcacacttattacaataaatagagtgtctgtgctcctaaggccaacctctccagttttgtacttgattcccatctcttctcccttcataaaaaatgttgctccagcaatttctccttttctcccttacatcatcaatttatctctccactagattaatctcatcaacatcaatcatgctattatttcctcccctatctttacagaaaccgtcttaaaataattgtccctgcttgcagcctttgcatcttttcctgccattctctcctctttaacccactccaaagaagcttttatctctattatttcataagaactacattttcaaggtcattattgatctttacattactgattactagccctcatcttatttgaattctcagtagtatttgagaggtgattactccatcgttgatacaggttctcacttggtttctctaacaccacttttcttcacttttctactaaacttactgccaatctttgtcaactttgcgagtccttcttcatccccctaatctttaaaggttagagtgctccagggattagttctccaacttcttctttattctatttatactcactctgtgacgacattgtttagcctcatgattttaagtactatctatctgcagataattccagttgaatatctggagatattctcagatctctctcctgaagtcaaaatttacatatcaactccctaccttaacatgcacacaattagactcttaattcctgccccttcccaaaacctgctgattgctcagccttctccatggcaatcaaaaaccattcctggccgggcatggtggctcactcctgtaaccccagcacttggggaagctgaggcaggtggattggttgagccccagagttcaagatcagcctgggcaacatggcaaaacctcatctctattaaaaatacaaaaattagccaggcgtggtggtgcacacctgcagtcccagctactcaggaggctgaggcacgagaatcgcttgaactggggagacggaggttgcagtgagctgagatggcctcactgcactccagcctgggcaacagagtcagacttgatctcaaaaaaataaataagtaaaaccattccctatttcagttattcagtcacagatcttgaagttttccaactctttttttcttacattaacatctaatctgtaaaggatcctgtattagtccattttcacactgctaataaagacatacctgagactgggcaatttacaaaagaaagaagtttaatggactcacagttccacatggctggggaggcctcacaatcatggcagaaggcagggaggagcaagttatatctcacatggatggcacaggcaaagagagagagcttgtgcagggaaactcctctttttaaaaccatcagatcttgtgagacttattcactatcatgagaacagcaagggaaggacctactgccatgattcagttacctcctatcaggtccctcccacagaacatgggaattcaagatgagatttgggtagggacacagccaaaccatatcattccaccccatcccctcccaaatctcgtgtcctcacatttcaaaaccaatcatgccttcccaacagtcccccaaagtcataacacatttcagcattaactcaaaagtccacagtccaatgtctcatctaagacaaggcaagtcccttccacctatgagcatgtaaagtcaaaagcaagttagttacttcctagatacaatggggtataggcattgggtaaatacagccattccaaatgggagaaattggccaaaacaaagggcctacaggccccatgcaagtctgaaattctacggggcagtcaaatcttaaatctctaaagtgatctcctttgactccatgtcttgcatctgagtcatgctgatgcaagaggtgggtgcccatggtcttgggcagctccacccctgtggctttgcagggtacagcctcccttgtgtctgccttcatgggctggcattttctgtagcttttccagatgctggtgcaagtttctgatggatctaccattccggggtctggaggacggtggccctcttctcacagctccactaggtggtaccccagtagggactctgtgtgggtgccctgagcccacatttcccttctgcactgccctagcagagtttctacatgaaggcccacccccgcagcaaacttctgcctgggcatccaggcacttccattaatttctaaacaacaaagcattcaagaggcgacttgggtgctattaagggcattcagtttcataagggaagcagagcataaaagtttggaaaatttgcagcctgataatgttagagaaaagcaaatcccattttctgaggagaaattcaagcaggctgcagaaatttgcataagtaatgaggagccgaatgttaatccccaagacaatggggaaaatgtctccagggcatgtcagaggtcttcacaccagcccctcccatcaccggcccagaggcctaagaggaaaaagttgtttcatgggctgggcccaggatccccatgctgtgtgcagcctagggagtcggtgccttgtgtcccagccgctacagccatggctgaaaggggtcaatgtagagctcaggctgtggcttcatagggtacaagtcccaagccttggcagcttccacatgatgttgagcctgcgagtgcacagaagtcaagaactggggtttgggaacttccgcctagatttcagaagatgtatgaaaacacctggatgcctaggcagaagtttgctgcgggggtgggccctcatggagaacctctgctagggcagtgcagaagggaaatgtgggctcagagcacacacacagagtccctgctggggtaccacctagtggagctgtgagaagaggaccaccgtcctccaggccccagaatggtagataccctaaatcatctctttcaaattcgaagttccacaaatctctaggacaggagcaaaatgccaccagtatctttgctaaaacataacaagagttacctttgctccagttcccaacaagttcctcatctctatctgagaccacctcagcctggatttcattgtccatatcattatcagccttttggtcaaagccattcaacaagtctctagagagttccaaactttccacattttcctgtcgtcttctgagccctccaaactgttccaacctctgcctgttacccagttccaaagtcgcttccacatttttgggtatcttttcagcagcaccccactctactggtaccaacttactgtattagtctgttctcacactgctgataaagatatacctgagactgggaaatttacaaaggaaagaggttttatggacttactgttccacatggctggggaggcctcaaaatcatggcagaaggcaaggaggagcaagtcttgtcttacatggatggcagcaggcaaagaaagaaagcttgtgcaggaaaactcttttttttcttttcttctttttagacagagtcttgctctgtcatgcaggctggagtcagtggcgtgatcttggctcactgcaacctccacctcccgggttcaagtgattctcctgcctcagccttccaagtagctggtactacaggcatgtgccaccacatgagatgagattttggtagggacacagccaaaccatatcattccccctgtcccctcccaaatctcatgtcctcacatttcaaaaccaatcatgccttcccaacagtcccccaaagtcataactcatttcagcattaactcaaaagtccacagtatttttagtagagatggggtttcaccatattggccagactggtctctaactcctgaccttatgatccgcccgccttggcctcccaaagcactgggattacaggtgtgagccaccatgcccagccaaaaactcttctttttaaaaccatcagttctcatgagacttattcactatcacaagaacagcataggaaagatctgcccccatgattcaattacctcccaccaggtccctcccacaacacatgggaattcacgatgagatttgggtggggatcctcttggctatcatttcaaaaaatagtcagggttgattatggacttagtattgaataagatgaaaatgtactgaaatggaacgatgaagataattgaccagggaaagcaggttacaagccaagagaggatacagtgtcacttcagatgctataaaagtgatgtttttattttttgaatgttatttggctatattttcaaattatctgcactgcatatgcactgcttctgtaataataaaagggtattaaaataataaaatcaagtctataaatcacacacacacaccccagcctcttctctacacctcagtgactaccaaccacatctaaattatcatcatttctcatctgaattattgcaagaagccattgcaataattcagatgagagttgatacaaagccttcctgtttccaaccttaccctcatatagtcttttcccaacattgcatctaaagtaatttttcaaattgcaattctgatcactgttctctgcttcagatcctccagtggattttcatctcactcagtaaattccaaagccttcaccatggccttcaagaccctacgaaatttgaccctctgcaacctctctgccttcatctgttaccattgtctcctgttaatcctgcctcagccacactgacctccttgttcttctcaaatggactagatgtgtgcctatctctagaccattacagtttctgttctctctacttaaaattatgtccctgatactctaatgcaagttctcttacttccttcaggacgctgctcaaatttcattttatcagtgaggctttccctgaacactgtatgtaaatattgctcccaccattttttttcaatgcacttaacagtgcctgaaatattatatatttatttctttattgtctatcttctctgactataagttaagctcattaagaacacaaactttggaggtattgttcaatgttgtgtccccagaactttgaacagtgcctggcacgtggcagatgttcaaataaatgtatgttgaatgaattagaaaatgataaatgtagggagacaaaagcaggtctcccatttatatccaaactctaggactctaggaaagactgattatatggaatcgtgtcacacagcatccatgggcaagagtggaggcagagataccagttaagatgctattgcagtcatacagataaaagaagacagttatttagaccagtgtggtggtgacagaaatggaaagaaatggaaggatgttgggtataattaaagataagcatataagactggctgttaattgagtatgggaagaatgaggagagaggatgtaaagaacatttctttttgtttgtttgttttgttttgtttttgtttctttttattatactttaagttctagggtacgtgtgcacaacctgcaggtttgttacatatgtatacatgtgccatgttggtgtgctgcgcccattaactcatcatttacattaggtatatctcctaatgctatccctccctcttccccccaccccccaacaggccccggtgtgtgatgttcccctacctgtgtccaagtgttctcattgttcaattcccacctatgagtgagaacatacagtgtttggttttttgtccttgcgatagtttgctgagaatgatggtttccagcttcatccatgtccctacaaaggacatgaactcatccttttttagggctgcatagtattccatggtgtatatgtgccacattttcttaatccagtctatcattgatggacatttgggttggttccaagtctttgctattgtgaatagtgccgcaataaatatacgtgtgcatgtgtctttatagcagcatgatttatagtcctttgggtatatacccagtaatgggatggctgggtcaaatggcatttctagttctagatccctgaggaattgccacactgacttccacaatggttgaactagtttacagtcccaccaacagtgtaaaagtgttcctatttctccacatcctctccagcacgtgttgtttcctgactttttaatgatcgccattctaactggtgtgagatggtatctcactgtggttttgatttgcatttctctgatggccagtgatgatgagcatattttcatgtgtctgttggctgcataaatgtcttcttttgagaagtgtctgttcatatcctttgtataagattattagtggatttctcagaagaaatattgtaggccagaagggagtgaaaatatagatttaaaatcctgaaaggaaataaaaactagcaatgaaaaatactatatccagtaattttatctttcagaaatgaaggggtgataaagattttctcagaaagacaaaagctagatctgctttataagaaatgctagtaggagttcttcaagctgaagaaagaggatgcttattagtaatatgaaaacatatgaaaggataaaactcactagtaaaaataagtacattgtcaaatccaaaacactctagtagtgtaatggcagtgggtaaattaattatatctttagtrtaaaagataaaagacaaagaaagctattttaaaaactaaagctataataatgtgttaaggaatgcaaattattaaaatatgtaaactgtcacatcaaaaacataaaataggctgggcacagtggctcatggctgtaatcccaacactttgtgggggccaaggtgggaggatcacttgagcccaggcatttgagactaacttgggcaggatagtgagatctcatctctataaaaaatttaaaaattagtaaagcatggtggtgcatgcctgtagtcccagctactcargaggtggaggtgggaggactgcttgagcctgggggggtcaaggctacagtaagcaatgatcacaccactacactccagcctgggcaacagagcaagaccctgtctcaaaaaaaataataatatgtaggaggaagggaataaaagtgtagagtttgtggatgcaataaaaattaagttgttatcagtttaaaatagcctgctaattttgtgtaagcctcatagtaaccacagagcaaaagcctatagtagatacacaaaacattttaaaaaggtccaaagcataccactacagaaagccatcaaactataaaggaagaatgcaacagaagaagaaaggatcaaaggatctaaaaaaaaaaaaagaaagmaagcaattaacaaaatgacacaagtatgaccaaagtccactgcttctttattactgatatagaatatctttcagatcttaagggactgattaattacttgggagagaaagtttgtgttgagaagatttgcttgtgttgcaatgagaaggggaagttctactcaacagaagctgtacaggcacatatgacaaaagctggtgtaagctttttacagatggtgatgctgctttggaatttgcagacttgtatgagtttaggagtagctacccagatcacaaggaaggggaggaccctaatgaggctgaggagtcgcccttaggaaaggacttagaatatgatgatgaaagcatggaactgattctgccttctgatgccagagtgggtcatcactccttgatgagatactacaaacagtgatttggcttgtcaagagctgtggtagttgctaaatattgtgaggccatgggccgagtgcttcagtaatagagagccctgggatagactggcaacacaggagcagctgttacatgaaagtgagacatgcattatatccaaaggatgaagtcaaaatggatgctgaagacagaaatgaagaacaatgccaccaagcagatgcactttagggtccaagtgagattctgagagtctgccaggattgagtgattgtctgctgcccaagtttcctccttgccctgaggaccagggaaagccagattgtatgatggacacttttgctgctacttcacttgctctaacataataataaaaatgaaaatctaaaaaatattttattgaagaatgaaggtgaaagaaatacattttcagacaagcataaacagagaaacttcaccattagcaaaagtccactaaaatattctaatgttatacttgagacaataaaaaagtgatacagaatggaaggcatgagagacaagatgggataaagagcaaacaaagttaaatatgtggataaatagagataagtatcataaaacatggtcaaatgttttatgagcgttaagatatatagaattgctttattcacagttggtttgctgtcataacacaagtatcatgaaaatcactgctaaatctaagccaaaattgggaaaggaaaaggttcatgtcactatcatcaacgttggacatgtagactcaggaaagttcaacactactggtcatctgatctataaatgtgatgtgatcaacaaaggaaccattgaaaaatttgagaaagaacctgctgagatgggaaagggctcatttgagtatgcttgggtcttggataactataaactgaacatgaatggaatatcaccattgatatctcctaaagaaacctgaggccaaaaatatcctgtgaccatcattgatgccccagcacacaggggctttattaaaaaaaaaaaaaaaaaaaaaaaacatgattagagtgatatcaccaaaatggtggatagaagcaatctggcttcactctcctccagaaaaaccaaaaacaactattcagtgtctagcttatcaccaggaatatcccataactcaaaacagaggctgtgaggatctgagtggccacatagaagagaaaaactgcaagcagaagataacaaaaatgggcctgtttaactgcagcatccccttcccaagctgccaggcaccatgcagaaaagttcccccagactgacagtatgtacatcagaaaaagtgacatctagatgaagagccagctttcccaccatcttgggttcctttgcagaaaaatcattcctgcctcaatccgtgggaagcagcctgattgcctctagggtaaaaaaatcctgagggcagctagagacaaaggatggaggcggggctagcaaccccagcatgcaaaacacattggctgctcttcatctaagccaaagaagacaccaaatgagagagaatgttcagcccgtggttcctctggacacaaaatcctaaccagatgtctcacccaaccaggatatccagtttgggacctcccccaaatcgggaataggcagtaatccaagccgttgcaagagctgcagcaaatctgggcttacagcaccatctagtgccaaaaaagaggcagtaatctcagagtaaggaagctctaattcatacataacctttagacaggcatactcctgaaaaaccaaactaagccagacacaaagactggaataaataacttagcattcatacaaagacatagatatatgtgcataaaaaacaagagcaaatagggagctatgacctctccaaatggaaacagcatggagccagtgaccaaccctaatgagatggcaaattgtagctctcaaatcaataattcaaaataaaagttctgaggaaactcaaagaacacaaaaaagcaactgagaaatttatgagataaatttaacagagaaatcaaaataataatttaaaaaaccagaaatgctggagctgagaaatacaactgaacggaaaaaaaaaatgcactggaaagtctaaacagcggaactgatcaagcaaaacgaacaatcaatgagctcaaagacaggctatttgaaaatacacagtcaaaggacaaaaaataattaaaaggaatgaagaacacttgcaagatctagaggactgcctcagtagaacaaatctaagagtcatgggccttcaagagagaaagagcaatgaataaaaagctcaaagaaataacagaaaatatttccaaacctacagagagatgtaagtatccagttataggaaggctgaagatcaccaaacagattcaacccaaataagactaccccaaggcatacaataattaaactctcaaaggtcaaagacaaagaggggatcctaaaaagagcaagaaaaaagaagcaaataacatataaaggagctccagttcatccgggaatatactctggaccagatgaacctacctgacattttacagaacattttatccaactactacagaatatacattcttcttatcagcacatggaacattctccaggatagactatatattaggccagaaaacaagtctcaacatttaaaaaaataaaattatattaagtatcttttctgactacagtagaataaaactagaaatcaatgacaagaggaacgtttgaaactatacaaatacatggaaattaaacaacatgctcctgaacaaccaataagtcaatgaagaaattaagaaggaaatttattgaaacaaatgaaaatggaaacaacataccaaaatgaatgggatacaacaaaagcggtactaagagagaagtttatagctataaatgcctacatcaaaaaagaaagactcaaataaacctggtaatgatgtaactcaaggacatagaaaaacaagagcaaaccaaacccaaaattagtagaaggaaaataataataataatcatagaaataaataatattgagaaaaagaaaacaatatgaaagaccaatgaaatttttaaaatggctttttgaaagataaaatttaaaatctttagctagactaaggaaaaaaaatgagagaagacccaaataattgaaatcaaagatgaaaagagtcattaaaactgataacacaaaaatacaaagtttcactagaaactattatgatcaactatatgccaacaaactggaaaaactagaagaaatggataaatttctggacacatacaacttaccaagattgaactatgaggaaatagaaaacttgagcagaccaataactagtaatgagattgaagcagtagtaaaaagtctggcattaaataaaagtccaggacytgatgacttcactgctgaagaaaaacttacaccaattatactgaaactatttaatattgcaaaaaattgaagagaaaagaatgtttccaaactcattctacaagaccagcattatcccaatacccaaaccagacaaagacacaacaacagcaaaaagaaaactacaggccaacttcgctgatgaatatagatgcaaaaatcytcaacaaagtactagcaaactaaattcaacaacacattaaaatgagtatttgtcatgcccaagggggattcatcctaggaacacaaagatagttcaacatatggaaatcaataaatgtgatacaccacattaacagaaggaaagacaaaaaccatatatttatttcaataaatgtcaagaaagcattgaataaaattcaacatcccttcatgataaaaactctcaacaaatttggtttaaaggagcatacctcaaaacagtaaatgttatatatgacaagcccacagctaacattacaccaaatgggaaaaaattgaaagcctttcctctaagatctggaacaagacaagcatgcccactttcatcaattctattaaatgcagtcctggaagtccaagatggagcaattaagcaaagggccttcaaattagaaaaaaagaaatcaaattccccttgtttgtagacgatataatgttatatttagaaaaacctaaacactccaccaaaaaactgttagaactgatcaacaaattcagtagagttgcaagaagcaaaaccaacatacaaaaatcagtagcatttctatataccaagagctaacaatccgagagagaaatcataaaagcattttcattttcaatagctataataaaaataaatatctaggaacaaatttaaccaaagaggtgaaagatctctatactgacaactgtaaaaccctgatgaaaggaattgaagaagacacacaaaaaatgaaaaggtatctatcccatgttcatagaatggaagaattcatattgttaaaatatcaatactactagatttcatgtattacctatcaaaataccaataacatttttcacagaaatagaaaaagcagtcttaaaatttgtacagaaccacaaaagacccagatatggtttggctgtgtccccacccaaatctcatcttgaattgtagttcccataatccccacatgtcgtgggagggacccagtgggaagtgattgggtcatgggggcagttttcccccatgctgttctcgtgatagtgagtgagttctcatgaaatctgatggttttctaagtgtttggcatttcccctgctggcacttattcccactgccaccttgtgaagaagatgccttgcttcccctacgccttccaccatgattgcaagtttcctgagacctccccagcaatgcggaactgtgagtcaattatacctctttcctttatagattacccagtctccagcagttctttatagcagtatgagaacagactaatacagtaaattggtaccgaggtagggggggcactgctataaggatacctgaaaatgtggaagcaactttggaactgtgtaacaggcagaggatggaacagtttggagggctcagaagaagacaggaaaatgtggcaatgtttggaacttcctagagacctggagggctcagaagaagacaggaaaatctgggaaagtttggaacttcctagagaatcattgaatagctttcaccaaaatgctgatagtgatatggacaatgaagttcagactgaggtggtatcagatggagatgacgaacttgttaggaataggaataaaggtggctcttgctatgctttagcaaagagattggcagcattttgcccctgccctagagatctgtggaactttgaacttgagagagatgatttggggtatctggcagaagaaatttctaagcaacaaagcattccagagtgacagagcataaaagtttgaaaagtttgcagcctgatgatgcagtagaaaagacaaacccattttctggggagaaattcaacccagctacagaaatttatataattaacaaggagccaaatgttaatcaccaagataatggggaaaatgtgtccagggcatgttagagaccttcgcagcagcccctcccatcacaggcctggaggcctaggagggaaaaatgctttcgtggcctgggtccagggctcccctgcagtgttcagcctgggacttggtgccctgtgtcccagccactccagctataagaggccaaagtacagcttgggctatagcttcagagggtgcaagcccccagcctttgttctgtgggtgcacagaagacaaaaattgaggtttgggaatgtccacctagatttcagaggatgtatggaaatgcctggatgtccaggcggaggtgtgctgcagaggcagagccctcgtggagaacctctgctagggcagtgaggaaaagaaatgtggggtgggagcccccacacagtcaccactggggcactgcctagtggagctgtgagaagagggccactgtcctccagaccccagaatggtagatccactgagagcttgcaccgtgggcctggaaaagccacaggcactcaatgccagcccatgaaagcagccaggagcagggctgtaccctgcaaagctaygggggtggagcttcccaaggctgtgggagcctgccttttgtatcagggtgacctaaatgtgagacacggagtcaaaggagaacattttggaactttcaggtttaatgactgccctattggatttcagacttgcatggggcctgtagcccctttgttttggccaatttctcccatttggaatgagtgtatttacccaatgcctgtacccctattgtatctaggaaggaactaacttgcttttgattttacaggctcataaacagaagggattttccttgtctcagatgagactttggacttggacttttgggttaaggctggaatgagctaacactttgggggactgttggaaaggcatgattctgtttttaaatgtgaggacatgagatttgggaggggccatgggtggaaacatatggtttggctctgtgtccccacccaaatctcatcttgaattgtagtatattgtttgtaaaaattcctgcctatccagagattttttwaaaaaaaacaatactttcttcaattttctcttacaatttaattttttacatttaactttttaatacttcctgtagactaaaagttattttggtgcattgtgtgaaccaaagatcaaagtagttttatttttttctgaaaacatctattcattttttcaattaattgattgtttatattaaggatctaggaggatctaaaattatggaattgtgggcaagggcaatttttgccttacatttcatgtaaggcaaaataatccccatgtgtcatgggagggacccagtaggaagtgattggatcatgggggcaggttcccccatgctgttctcatgacagtgagtaagttttcatgagatctgatggttttataagcatctggcatttccccttctgtcacctctccctcctgccaccttgtgaaaaaggtgccttgcttccccttcaccttccaccatgattgtaagtttcctgaggcctctccagccatgtggaactgtaagtcaattaaacctctttcctttataaattatgcagtctcaggcagttctttataccagcaggaaaacagactaatacagaccctaaatatccaaagcagtcctgagcaaagagaacaaagctggaggcatgatgctactttatttcaaactatactacaaagctgtagtaaccaaaacagcatggtactggcataaagacagaaacatatgccagtggaacacaacagagaacccagaaatgaatccacacatttagagccaactcatttttgacaaagtgccaagaatatgcattggtgaaagaatagtctcttcaataaatgatgttgggaaaactggatatccacatgcagaagaattaaactaaacccctatctctcactgtatacaaaaattaaatcaaaatggattagagacttaaatatacaacctgaaagtatgaagctactggaagaaaacattggggaaatgctccaggacattggtctgggaaatattttatggcctgggaaatatcaaaagcacagacaactaaagcaaaagtagacaaacgggattatatcaagctataaagcttccgcacaacaaaggaatcaattaacaaagtgaagggacaacctacaggatgggatgaaatatttgcaaactatacaactgagagggtattaataaccagaatatataaggaactcaaacaagtcaatggcaaaaaagcaaaggatcctattaaaaatgaacaaagatctgaataaacatttctcaaaagaaaacatacaaatggccaacaggtatatgaaaaactgctcaacatcactaattaccagataaatgcaaaccaaaagcacaatggatatttcactccagttaaatgacttttatcaaaaagacaaaaaataatgaatgctgatgaggatgtggcaaaaggggaatgcttgtacactattggtgggagtgtgaattagtacagatactatggaaaagagtatgtatgttcctcaagaaactaaaaatagaacgaccatgtgatccagcaatcccactgctggatatatatccaaagacaggaaatcagtgtatcaaagagatagttgcacaccaacatttattacagcaccattcacaatagctaggatataaaatcaacctaagtatacatcaacagatgaatggataaagactgtgtggtatatatacacaatagactattactcagccattaaaaagaatgaaatcctgtcatttgtggcaacatcgatgagcctggatgtcactgtgttaagtgaaataagccaggcatagaaagacaaatatcacgttttcacttacatgtgagagcttaaaaagtggatctcacggagatagagagtagaatggtgcttaaaggagtttgggaatggtatgggggggtgggatggaatgaagagaggttgattaataggtgtaaaatgaaggggtggcctgcccctcgtcacccacagtgacgagaaacactgtgggtgtttctcgtcaggtgggacgagagactgagaaaagaaataagacacagagacaaagcacaggaaagaaaagtgggcccaggggaccggcgctcagcatacggaggacccgcgccggcactggtctctcagttccctcagtatttattgatcattatctctaccatctcggagagggggatgtggcagaacaatagggtaatagtggagagagggtcagcaggaaaacatgtgaacaaaggtctctgtgtcataaataagtttaaggaaatgtgctgtgccctgatgtgcacgtatacaaacatcttggtgcattaaagagcagtattgccactagcctgtctcacctccagccttaaggcggttttctcttttctcagtaaatagaacatacaatcgggttttacaccgagacactccattgcccagggacgagcaggagacagatgccttcctcttatctcaactgcaaagaggacttcctctttcactaatcctcctcagcacagaccctttacgggtgtcgggctgggggacggtcaggtctttcccttcccacgaggccatatctcaggctatcacatggggagaaaccttggacaatacctggctttccagggcagaggtccctgcggccttccgcagtgtattgtgtccctgggtacttgagattagagaatggtgatgactttttttattattattattatactttaagttctagggtacatgtgcacaacgtgcaggtttgttacacgtgtatacatgcaccatgttggtgtgctgcacccactaactcgtcatttacattaggtatatctcccaatgctatccctccccccaccccatgacaggccccggtgtgtgatgttccccctcctgtgtccaagtgttctcattgttcaattcccacctatgactaagaacatgcggtgtttggttttttgtccttgtgatagtttgctgagaatgatggtttccagattcatccatgtccctgcaaaggacatgaactcatccttttttatggctgcatagtattccatggacaagcatactgccttcaagcacttttttaacaaagcacatcctgcatagccctaaatccattaaaccttgactcaacaccgcacatgtctctgcgagcacagggttggggctagggttacagattaacagcatctcaaggcagaagaatttttcttagtacagaccaaaatggagtctcttatgtctacttctttctacatagacacagtaacagtctgatctctctttcttttccccacagtaaaattacacttaaatagaagggataagttgtagtgttcgatattacagtagggtgactatagttaacaatgatttattgtatgtttcaaaatagctagaagagaagactgggaatgttcccaacacaaataaatgacaaatggttgaagtgattgatattccaattaccatcatttgattattacacattgtattcatgtatcaaaatatcacatgtatccccaaaacatgtacaattatcgtgtatcaatttaaaaatacatcatgataggcacctctcaggttgactgtactgtcctgattattgctagtggtgttaacaaatttgaagctagtatctttaagaacgggcagacccatgagcatgcccttctggtttacacactggaagtgaaacaactaattgttggtgttaaaaaatggatttcactgaactatgccatcgccaacagagctatgtggaaatcaataaggaagtcagccctacattaagaatactggctacaaccgcaacacagtagtatttatgccaatttctggttggaatgctgacaacttgctaacatgccttggttaaagggtggagagtcacctgcagagatggcaataccagtgtagcacaccgcttgaagctctggattatatcataccaccagctcatccaactgacaaggcttgtgcctacctctccaggaagtctacaaaattggtagtattggtaatgtctttgtgggcctagtggtgactggtgccctcaaacccagcatgattggtcagctttgctccagttaacattacaactgaaataaagtcttttgaattgcaccatgaagctttaaatgaagctcttcttggggacaatgtgggcttcagtgtcaagaatgtgtctgtcaaagatgtttatcatggcaatatggcttgtgacagcgaaaatgactcgccaacggaagcagctggcttcctgaaccatccagcccaaatcagtgctggctctccacctctgttggattgtcacacagctcacattgcttgcaggtttgctgagctgaaggtggttgatttccttctggttagaagctggaagatgacccccattgtgatttttattgctatggtttctttctaatttagtcttgaggtctctcccttgagaatggtcataagccaagagagccactttctaggagagtcctgaccagggggaaagttaagtttgagtgtgtcagcttggtgagacacaatgaggaagtaaaaacaaaataaatagtggaatagaatactaacaagtacctagaaataagtctagctaaaaatttgcaaaatgtctatggaaaaaaaaactatggaaatttactgagaaactttaaagagtacctaaataactttcaagatataccacgtacatgaattggaaaacatgatatttgaaaatgtcggttattcccaaactgatttatagattcagtgcaacctgaatgaaaatcccaagacgttccttttgtagagctcaacaagctgattctaaaattaatatgaaaatgtaaaggtttatgaatagccaagtccttcttgaagaggaagaataagatgagagtaattgctgtctaatatattgagacttattttaaagctataataattaaaacaatgtagcagttggtatagggataatcaaacaggtaaatgaaatagaatagaaaatccaaaactagtctaacacatatagaaacttgatttatgacaaaggtgtcacagaagtagagtttcaataaaatgctggaaaatgttggtatctatatagataaaacattacattggattcctaactcacaccatacacaaaaatccattcacattgcattacaagtctaaaagtgaaatataaaatcataaacattttagaaagaaaatgtaaaagaatatatcaataaccacagggtagggaaagaaagagaattgacatcaagatacaaaaagccctagccaataaggtttttttttataaattccacacattaaaattacaaacttatgctcatcaaaagataacataaaaacaatgaaaagattagccacggaatggtaaatgtttgcaatacataacacaaaggacacacaaaggaaacttatataatagattttaacaggcttctctgtgtccttcttctccagcaatcaaggaatatataaaaaagcatatcaaggatatatagggtactcttttgattcaacaagaaaaaagcagattatccaagagaaaacttggcagaaaaaagcttggataggtgctccacaaaagaggacatccaaatgactgctactcataagaaaagatgctcaacctcatagaacatccaaaaatgtaaaaacacagtcaataccagatatttgtaataatttggagcaaatggaactctcatacattgctaatgaaaatggaaaatggtccagctgctttggaaaacagtgtggcaatacctaccaaagccaaacacatgcatacctagtaattccgcccaacagaaatgcacatatatgttcaccaaaagatatgcaccagaaggttatagcaggtccatatgaaagtgccaaagattataacaactcaaatgtccgtgattagggtatattcatataatactatacaacaatgggaatgaacaaactatagctacatatgataatatagatgaatctcacaaccagaatgctaagtgaaagaagaaacaaaagaatatatgtagtatgttttatttacacacttcaaaacaggcaaaactaaactatatttttaaaggatgtatacgtaactggtaaaattataaagaaaagcaaagaaatgattatcataaagatcagaatggtggttaccttcagtgggaagggagaaagtatgattgaaaagggacatccagtgagtcttgtgggttgttggcaatgttactgatctgggtgatgattgcatttatgtaccaaaggcatttgtgttttatgcactttattgtatatgttttagttcacaatttttttagttcacaattttaatagggctttaaaaagtaaaaagaaaagagatccaagggcttgaccatgggactctcttatatttggagtatgtttataaactttacattcattcaacattcgacaaatattttttgagcacctactttgtgccaagcaccgttacaggtgctgggaatacaacagggaacaaaacagacaaaaccccagctttcatggaacttacatgctaataaagcttggcaagagtatttcaaggaagatgaagtggttaactatgcaaaatgcttctcaggcacctaggaaaatgaggatgtgaggcatttctacccacttggtacataaaattattgcttttcctctgctttttttctccagggctcagagtggcagtgtccctcagttcaagaaagttgttttccaggaatttactgatggctcctttactcagcccttataccrtrgagaacyaaatgaacatktsggacycctggggccatatataagagcagaagttgaagataatatcayggtgagttaaggacagtggaattacaagaaaattaattttatatatttattttcttgctgactataatgtattcccacttttggaaatttttaaagtatagaaaaataattccataattatctttgtgtacgttctatttttcctatgtatttttctccttatgtattcaaattataccatgcagaattctgattcttgtttttttactaaatatcacatcataaacatttcttacgtcattaaaaacacttcctatgtatgtttttaaaatactgcataatagtctattatatgaatttatggaaccatagtttatgtaaccatttattttgaacaagcttttagacagtttcttttttcactatataaataaygctgtaatcacaacagtttttctaagataaaattccagaagtgcaatgtatttgagcatcttaagagtttttcttattaattatttggtaatgtcccttgcacatttgtctttcatggaggaagtgcttttcttattgattatgttaccttatatattagatagtaaaccactgaacattttaatgagaggtactttttcaagtttttgttttctcttaattttataaatgatggtttttgaaataaaacaggttttaatttttaggtagtaacccatcaatctttactttttgacactttcattgcttttatgtttataaaaattcctgcctatccagagattttttaaaaaacacctatactttcctcagtttttctcttacagtttaattttttacatttaactttttaatacttcctgtagactaaaagttattttggtgcattgtgtgaaccaaagatcaaagtagttttatttttttctgaaaatatctattcgttgtttcaattaattgatggtgtatattaaggatgtagaaggatctaaaattatggaattgtgggcaatttttgccttacattttattttactttccattatattctatgataaatatgtataatttttaatctggaaagtaagccttttttaaaagataatatgcattcattctagaatttgtcatgaagaaccttaacttacatatcaactcctggcgttatggtctcttataacccctgcagtaacattttcccttttactctggaatggcttttatgtgtttaggaattttctcctttgcaactttgagttcataccttaaatttagaatacaaaacctcctcaggattaggtttgagttctaacagcatccatcttctgtaccacttcttccagggtattaaaaactttgataaagaccaaaagacaggtatttcttttagggatgtaaaccctaaggaccttaagatcctagaagattattcttgcttttttttttttgtcgttattgttctacaggtaactttcagaaatyagscctctcgtccctattccttctattctagcyttatttcttatgaggaagatyagaggcaakgagcagaacctagaaaaaactttgtcaagcctaatgaaaccaaaacttacttttggaaagtgcaacatcatatrgcayccmctwaagatgrgtttgactgcaaagcctgggcttakttctstgatgttgacctggtaagcaggtgtctattgtgctgaccactttttggtttaaaagaaatggtctttgtgtactaagaattttgatatttatcctacgtgcaataagaagctttaaataggagagttgatcattatatttgtgttttagaaatgtcattctggaatctactgaagaggatggattatatttttggaaggtgggaggcaggttggactggcataaaaattgatgagaaatccactctggttcataggtgagagagcttatactcataggattgatgtcttccctccctaggaaraadatgtgcvctcagdcctgattggaccccttctggtcygccacactaacacacygaaccctgctcatgggakayaagtgacagtayaggratttgctctgtttttcaccwtctttgatragaccaaawgstkgtrcttcactgaaaatatggaaagaaactgcagggctccctgmaatatccagatggaagatcccacttttaaagagaattatcgcttccatrgtaatatattccacatccaaacattatcactgtgaaatgcagattgcactttgacaaatgagacttgatccagggacttgaacattgtatttatttagagtatatctgtgggagtggaatcctcatagatgtcagtttttttggtggagtggagagaaagaaacttatataatagattttaacaggcttctctgtgtccttctccagcaatcrrtgsctacatartggatacactacctggcttwgtaatggctcaggatcaaaggattydatrgtatcygctcakcatrgrcagmaatgaaamcatccwttctattcatttcagtgdabatgtgwtcactgtayvaaaaaaagaggagtataaaatggcactgtacaatctctrtccaggtatgagcttgtttgtgctctttcttctacctactctatttgttgagtacttactttaaatggtctaggcactgggaacacaatcagtgawcaaagcagacaagctccatgctcttaagtaatactttttcaaatgctttttaaaccatttgttcaaagcaaatgaacaagataatttcagatatagaaaaattgctaaaaaggaaatagaacagaataaatggataattaatgtcacagtactttcctagggaaaaggaatttattcctttatcatttaccatctcaaatcccatagggcaccagtagtcatccaaagagtcatttgtttatgtatgtaaccagtatattgattaagcactactcataatgttgatcacaacacaattttattttggttcttcactgtccctttaaaatagatttggccaggtgcgatggctcacacttgtaatcccagcactttgggaggccaaggttggaggattgcttgaggccaggagttcaagaccagcctgggtgacaaagcaagacccccatctctacaaaaaataattagccagacatgtggtatatacctgtagtcccagctacttcacctacttgggtggctgaagtggaaggattgcttgagcccaggaggttgatgctgcagtgagctatgaaagtgccactgcactcaaacttggacaacagagcaagaccctgtctctaaaaaaaaaaaaccatccagtttaatagcgggggtaaactttccttatttcttcgtaaaaattctgataagccctgtaacttttctgctcacccttaagtaataaacaggactaaagtcactttatgtcacaaatacagttcaaatcagaaattacaatgtccatcccaagatattaatcaaaattgtaaacttgatttaacttcaatctcccctcctccaacttgagcctgcatcaggctggaagtctgcattggaaaagggagacatggttgagtcctctgtttctgtaccttgtgatgatcgtgcttccccacaacccctttatagctgctgttttgaactccaacatggataggttaaaggtaaggggataagatagttcttacctatttacagctggcaccattgttgtaaactagcttaacactgtttgtgcctggcaatacttgttgactctttctcctgcagggcactttcagggaactctttagagactcccttacgtgactgtcatgaaatccccttgacatgatttcttccacctttactctgggtggtcacttgtgactcatttctcagccctcagtgttcacctgcagcttcttgttgctggggtaactttacccttgtaggcagctctagtggactggatccagagggaactcaccctgacttatctgtttcacagagtccacatctggccaatgggaaacacaccttttgctcagaaagaccctgggaatgtaggtcaatcataatgcagtagcattctcctgtcccaaccatcaaagaattcastcaccctgtttctcatctsctggggggaggggagtggtcagaactcaatctccacaacccccaactgtaagggtcacgtagcaagcactttgcatttgaggggtccaaaagtagtggaactaccaaatttggtaggtctactctgatatttcgcataaaccaatgtatctcatgctcattttttagtgaaaagaaataatttctgttcctgttggtttttataagstgtttttgagasagtgkaaatrttaccatccaaagctggaatttgkysggtggratgccttattgrcgagcatctacatgctgggatgagcacactttttctggygtrcagcartagtgagtagcaatgtgggcagaggttccctacctactcagcctacttctttacagctttcttcctttctggaatggttgcttgtgtcaggaaataaatacaagyttacatcattatcaaatttaaaatgaatattgctggtagaaatcatcagagttctcagagtagggcagatatacttgaagctttgaacactttgtacctgaagctctaaataattgacaaaaaaaaaataccacctcattttcacaacttggtaaagctcgaagatctccagtagcagattttggaatttaatgttgatttagttaccagataacttagaaatactacttggaagagtttggagatttaaccctaaacaagtaagagagccactggtctattatgtatggaccccagtttcttcagctgtaaaatgtgaatcattctagcacctgttaggattaattaaatgaactaatacagtaaaacgttgagtacagttcttggcacatttaaacactaaaaatagcatttgttgacgttctcccattttcattgacttacatttgagaagctgaattttgtgcactctagttactgtgttccacccgtttcatttcagagtrwcagactcccctggdaatggcttctggacacattagagattttcagattacagcttcaggacaatatggtaaatactattatttttgctccaagaacctgggctgattatatctttttttaataatctggtggagaatctcagataatgaatccatctccatgcttctattagttctattccataagtgcctctcaaatacatctcctcctctccacttcccactgtggccatcttaactcaggtcaccatcatttcttacctgggcaatgacactgcctccttaaatatcctccctaccttcagtatttcttccttgagtcaattcttttcagtgcagcaggaagctatactttcctatgagcagtaatggtaaagtttgactagggtctatagagaattctcagaaattgttttagagcactactgcccacaggctaaatgcagcacactgcctgtttttgtatggcatgtgagctatgaacagattttccatttttaaataattgtcaaaaagatgaagactatttcatgacatgtgaaattataaaattcaaatttcagcatccgtaataaagccttattttggaacacagccacgtccattaatttacatatcatctatggctacagcagcagtaacatagttgcaacagagaccatataatatgcaaagcctaaatgatttactatctggccctttacagaaaaagtttgccaacctatgttgttgtgaggtaaaaaaaaatcctcttgaaaaggaggcgtgagagttttacaccaaaatagtaacatttttcactaggtggaagggttacattttaaaatgtcttttatttgtatttttactwatttttacttttcattttctgatttttctacaatgaacatacattgcgtaataaataataggcggggcacgttggctcatgcctcccagcactttgcaaggctgaggcaagcagatcacctgaggtcaggagttcaagaccagcctggccaacatggtgaaactccgtctctactaaaaatacaaaaattagtcgggcatggtggtacgcgattgtagtcccagctacctaggagactgaggcaggagaattgcttgaactcaggaggtggaggttgcagtgagccaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgccataaagcctttatgtttttctctattttcaccacagtttagattaacctttctcaagacaataattttattctcaagtgtctaggactaacccagctgaatttaatctctgtttctttacttgggcaaaggacagtgggccccaaagctggccagacttcattattccggatcaatcaatgcctggagcaccaaggagcccttttcttggatcaaggttagaaaatgtaatcaatgatgggaaatgtatcacattcaatcaattgcattacttattcctcttgcaagctcaaaggattctatgaatatgagaaaactaaagaacagaatgccttaatgatttgtacaaaagcagtcatgaacaaagagatatggggatagaattgagtatattgatatgtcctgtttctgtattttagtccttctactgggattagaacatctgaatattttctataatattgaactcgtcatctctcaagacagtatatgttattattagatgcttccaactgcccacgtgtccttaagtactccaatcccctttattttaacataaaacaaatggttcacaaatgcaaaccacatgtgtacttttacattttctgtagccacgttttcaaaaatgtgaaattcactttaataatacattttatttaactcaacatatctgaaaatactatcatttcaacatatgatcaatgaggccccttcaaagacagacagatggaaactcttgggtctcttccatgcctcacaaaagctgagggcagcttggaagtgcctgctcagcctctccacctaaacataaggctagatgccttctagaagcccaaacaggaaatggagaaaacattttggtttccatctttgcaaatagcatgtctattaatgccacagcattgttttgtagacactgccaattttgactcaatctgagctgctgttcactaatccctaagtattttttgttggtttgtgcttctgccaaacaacatgttatgttcttcaccttgtatttctatggttattttcaaccttaagtgtatccctatatagagaacatgtttatctatttggccaccctgtgtctgtctgtgctatttaattttttgtaataacattcttatttgggagggcggaattatatcttcctcactagatacaacctgataagactagtaaatagagtgtcctgtctgtgcctagccaatgaaccctgaatgatatactctgttgtttccacttactagatttggcccattgtttcagcttgccgatcttcagtgtcccaaagtatttcctagtttttccagttactgatttgatcagtaaactttctaatactgcagcaaagtcatgatcaaaatattgaagtagacaagacttccttagtatgtgcacaatacaaatcaagctgttaagtccttactacaaccttgtgaggtagatgttactatcatcttcatttcagataatgaaattgaagcatagagaggttattgtggcccaagtcacatggctaataagtgactgagccaaaattcaaattctgatagttgggctccagaaccctaactggtaatcgttgtactacactgtttccggaatgctccctttaagttgataaccatctattaactgtcactgttcacttgtggtaattaaaccagttacaaatccacctagttatgttatcatctaccactattgaatcgccttatcttcaaggtggttttgccatctgtcctactaaggtccagctagactttttatagatctcgtaactttataaaataaaccatggagatggagttgaaagggggtgctgacaaggaagggagttggagaaggcatctattctcgtgagaaggcctgaagagtgcacaacagcctggccccaagacacaagagcactgggctggcttgaggagcaccaggtgaccaagaccaggcaatgcacagggggaagtcagcaggccccatggagatacgcagctgcagtgtttgtacttttatacagtgaaactcattaccaccttgcttacttcctagtagagagatgtgtcttgtagttacactgaaacacctggctgggcacataggtgaagctgttgagtctgtaattgtcaaactgctcccaggtgccaattataatgtagaagaggcacaagaagatgaagtggataagcctggcagtttgtcaagcattcatcagttgtcaagcatttgtcagttgcagaatgtaggtaggctgccaaggctttattgtagcctggttctattgcagctttattctagcaaggctgctggaaaatacaataatcactggtccaagaaagaactcttatactctatctatatgaagaaacagtaaaagtcaattcagtagaaatcatgatttttgtgcctggtgctttcacttttttatgccacaataccaagaggttaaaatgaagtgtctttgattgggaataccatctatctgggaaaagacagggctgcaacttctgaagaccttgacactctgtcctgttaccctgcttcatttttctcctgcgcttatcactacttgatgctataaacaaataaaaacatatatgatataaggtctatttctcctactcaactgtaagttccatgagggcagggctttctttcttgtttactactctattccctgtatctaaaacagtgcttggcacatagcaagtgctaaaaaatattctttgaatgagtgtatgaatggaacttacagtcagctgaaggagacagttattaagcataagagtgatgaccagtccaattgtgtgtgtcaggcatgtgtgaaaacgtgctaaatttgacttgcttattaggacagtaactgatacttctaatgttcttgcagcccatgacctcttctttaagaagtgtccattctgtactactttcccattattcactcattcattccaaagcatttgctatacagcagtattataccagataccatattaggtgctggggctagagagaatataaaagctaacattgattgagtgtttagtatgcgccaggccctgaactcagcacattacatgtattaactctttaacccctatggcagccctttgagataaaaactaatattatcttcactttacagataagttgagacacagaaagttaggtgactcaaatgggttcactgccttaaggatctcagtctaataaggaaagcagaaaagcaaagcaaccttataatatggtgcaataatttgctataatgaagttatatacaaagtgaagtagaagcatagaagaagcagcactaaatttgtctgggtgagtcagagaaggctaaccaggaaaaatagtttctgaactaacacttgaaggaggtgtagcagttcatcactgacagtgatgttggggtgggtctggtttcaggagaggggaggaaattggctttggtctgaggctgaggtgtgggcaaagcattagcttatgtgggtccattagcttatgtgagtccacaaaaggtgtgtgtgtgtttgtgtgtatgtgtgtgtgtgtgtgtgtgtgtgtgtgtgtacgaaatgggggctcaatgatttggtagtggtttggtttgtcaagaagcaggctgggaactcaataagcatctttccattcatttctactgtgtatcccacagcttcacacacacatgcacatttcaacattggtgactgcttcacttgcacacctaaggtaatgatggacacacctgtagcaatgtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcatcatgtatagtcttgatgggaagaagtggcagacttatcgaggaaattccactggaaccttaatggtatgtaattagtcatttaaagggaatgcctgaatactttaaagaattttggcagatttcagatattggacaaacactcttagcttccacaaacttaattccaaaaaataatttttcacttatgagcaatagagttattacggacatatcagcaaaaatgtagtagtgtcaaggctcatagatgatagaaatgaagagatgctgtattgatagaaatatgtgattcaggactgtgtggattgatgattgtgagcttgcttatggatatcctaggtttgaggttatagtaggacaatcaggttgaaatgtccagcaggcagtaggtgaaagacaagtttagrgggcaaaaccatggatggagatgaagattcatgacttccacataaaaggatgggtgaaactttgggaattgatgaattctctagaggtgagctcaagacccttaaaggcttaaaacctcagcgttattgtctactcttccctcatttttatgcccacaaatctggtcaatcctttatttgcaatgcctctcacatctctttcttctgtttccatttataccgctgttgccacagcccagggtcccatcacctcacacttgatctattgtattacattcctaactagtcttcccccgtttctaatctgttctccgataaaagctgcacatcattttcaggataatcatcagtcgcctgcctaaaacttttcaatgtcttcccattgtctttagaataaagttcaaagtcttcaaatgaccccaagcaagataacttttgtttgcccctttagatccattttcctgcttctctaccctgcttcttgttctgtgaggtgagcttgtatagaatacatcaacaggttaccttgtcctccagcttttggttggatttcaccaacagggagcactggcaaaagattggcatatttattcttctgactttctccttgcagaggagttcactgtatctccccacttaaggtcactgtttccctcagagtggctttttctacctgtactagctactattgctgtgtaccaagccacttcaaaacttgctgtcataacaataaccattatgttttgctcacagattctgtagatcaagactgggacacagtggggatgggtggtttctggagcctcagttaggattatttaacagctgggtgctggaatcatctggaagttccttctcttgcttttctggtggttggtactgactgtcagctaggacagaatctggggttgttgactgatgtaactttacatggattatccctgaggcctggccttccttacagcatgtttcaaggtagttggacttctttttgagggggggtaggaaggtggggggaggacagagtctcactctgttgcccaggctggagtgcactggtgtgatctcggctcactgcaacctctgcctcccgggctcaagtgattctcctgcctcagcctsctgagtagctgggactacgggctcatgccaccacacccagctaatttttgtatttttagtagagacagggttttgccatgttgaccaggctggtcttgaactcctgacctcaggtgatccgcccacctcagcctcccaaagtgctgggattacaggcacccggcctgtagttggacttcttacacgtcattttagggcctccaagtgtgagtgttacagttaacaaggtgaagactacataaccttttctgaccgagtcttctaagttatgtagcatcacttttgttgacaaaaagtgttgaactctataaaatatttgaagagatttattctgagccaaatatgagtgagtatggcccatgacacagccctcaggaggtcctgagaacatgtgcccaagatggtcagggcacagcttggttttatacattttagagaggcttgagacatcaatcaaatacatttaagaaatacactgatttggtccagaaaggcgggacaactcaacctgggggcttccgggctataggtgaatttaaacattttctggttgacaattggttgagtttgtctgaagacctgggattgatagaaagggaatgttcaggttaagataaacattgtggagaccaaagttcttttgaagtcttatagtggctccccttagagacaatagatgacaaatgttttgtattcagatcttagttaatctctttaggattgggaggggctgggagaaaaagatctagctatgttaatagagattctttacagttgcaaatttccctccacaaagaacagctttgcagggccatttcaaaatatggcaaaaaaacatgttttggggtaaaatattttgattttcttccttgtctcataatgttatgccagagtaaggttggaaagtaaatcatgacatataaggttaaataaaacccatctgatgagaatttatgatttgtagggcatgactccccagaccccttagataggaatttgggcaagataaaaaaaaatcagagtttagtcctcactttcaatacattctattggttataagcaaatcgcatatccacccagattcaaggggaagagacatagaccctaatttttaatgggagaaatgttaaataattggtggtcattttttaaagccactacaataatctatccaattctctctttcaggatgtttctctcttctgatcctttcaggtttagggattgtcaacaaacaaaaagttaaaccctgtaaaatacttgaagagatttattatgagccaaatatgagagaccaatggcctgtgacacagccctcaggagatcctgagaacatgtgctcaaggtggtctggctacaacttggttttacgcattttagggagacataagaccgaaatcaatagatggaagatgtacattcattgagtttggaaaggcaggacaactggaagcgaggcggggcttccaggtcgtaggtagattcaaagattttctgattggcaattggttgaaagagttaagttattgtgtaaagacttagaatcaatagagaggaacatcggggttaagataaggggttgtgaagaccaaggttctgtcatgcagatgaagcctccaggtagcaggcttcagagagaatagattgtaaatgtttcttatcagacttaaagagtctgttctatcagtctgaaggtctgtgttgatgttaatgctggtcagatttttctgaattccaaaagggaggcgggtataataaggcatatttgatccccactttcccatcatggcctgaacgtttttcaggttaactttggaaggccctttgccgaaaggaggggggattagaattttattttgggtttacaggatggtaatactctgttcccaccctcctaactagtatctttattaaaccttccacaaattatcctaatttccatgttttctgttccttgctggatcccttgtttcatacagtaattggtgctagaagaaaccccaggaaacagattttcaaaatgcaattctaaggttatgttgctaatatattcaagaaacacagagataacatatttgccaaggaagaaaatgagcagttagggaatccatgacatgtgttagtattatagtttctcagattatcaccagtgatactatgggatgagttgcagatggcaagtaagacactggggagattaaatgacagtggcatttagtcactgtggcaacaaacgtagcattacctgattgtagagtggtctgtcttcttacagccctagagggcatacacatggaaaaagaaatgaaatgttatgaatatatacaaaataagaacactgatgaacatacatggaaaatcaggatgcatgcatagagcttttgaggaatactccgtatcctgtggttgtaggcagatacgacttaggggctgagcataagttgcagagctgcagtgacaattaaatgcttaactccaccagatctattatgctgtggtaagagtaccggtgggaaggagtgaaactctgaggcctgagatggaggcatttaggcagacatggatgaggctgagaattgcaaacctccaaattcccctgaacctcctttgcctgaggaggcaaccactccccagtctctgaagcagtcatccctcttttgtgtaaaagcctttcagtggctataactgagataggtgcctcacaaaccagtgactattctccttagagaccctgtttggacactacgaaagccaggcgagtcacagaaaatgacagcagatcacaaatttaatcaggtggtgatgccaaaaaacaattgcaattccagatatcatatctctgttgaagcaaatttacacagccccaggcacctgatatggaagtattgacctagagaatgttttttcttcatttccatacattagtaaaatcagaatacatttgaatttaccaagtaggaacaagagtattaagtttactgcccatgcatcagggcaatgttagctctcttgttttctatcataatatagactcaagggacctcaaacatctttacatcccacaagcacaatgcctgtccattacactgatgacattatgctgacaggatctggtaaacacataacaaataagcctgtcttgctcttgactttaatgagaatgtaacctgtgtttcactgtttaatataatgttcactgttagtttcaaatactttttatgatgtttaaaaagttttctcctatccctattttatttgcaatggcaactgaattttatcaaatgcttttccagcatctttgacatggtcacatttctcttttgtgttgtcaaattatacttaacattcaatagtgtgctgacaagaaattaacaacccacaggggagcaaagtgagaagaggttaagaagtaaaggccttgatttatagcattggcagatttccctgacataaatactactcccatcatgcctggccccagggatgggaagagatgcttacttacaattggctctcacagaccagtgcaagagcactactgtgctccatttctgggaaaactttcgtcagtcatagtgtgttagttatttaaaacttagctggatccaatttgccaacatttcatttataatttctatatctatattcatgaatgaaatgggtttagctttttcagtagctctacttaccaggttttggcatgagggttatattaaacttgaaaaataaagtgggaaagcttccatttttttccatgaagactattgctctagaatagcttatttaatgtaggaatccagtatttaatgagagtaaatgaaaaagccatatgagccatgtgctttatttagtgagagatactaggctatattttccaatcgttatatgattattgctattctcatttgtgttgccttgagttaatgtctgcaaatgtgcacattagagtcatatatcccttcctgtgccatacatctatatctgtatacacacatatgtcttttctccttttttcccttctgtatcaagagttggcaagtgtttgtctattctattaatttttcaaagaatcagctcagttttaaacccaaacgtggttttgaaagagctgtttctagttcatcaatctctgttcaaaactttaaaaattctattttcctttcttttggtttgtttcctacaatctggaggtgaatgcttagttcacttattcttcaatctttgtattttaacgataaggataaattacttacagttattaactactctcatgaggttcattccttgaacagtcactgagcaactactatgtcctgggttctaattcaggggtgggcaaactatagccccagaatttggcccatagcctgcttttgtacggactgtgagttaagaatagtttttacacgttgaaaggattgcaaagacaaacatacaaagaaacaaagaagactgtgcaacagagaccacctgtggtctgtaaagactaacacatttctatcccgcccttgacagaaagagtctgtgggctgctggtctcctctaacggtggtagagatgcctgcacggttaacattaatccttggcaccagaatcctcagcacctaggaaccagatcttgcctaacacgctaatttcagtcttgaccaccttcctccggcgtagcggttctcaaacgtctttgtctttgtactattcacgtataaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggaaaaaaaaaaaaaaaaaaaaatccctattacaaataaaagctgttgtgatccagactgcatatacctctgcgaatggaaccagaaccgtgaattccaatgcaaatcgatgcatcggcaccagacccgctgcactggatgtatctgcattgcagtcacccgagtacggagcacatcatagatgatctctgcaggttcgttgcccacataggaggcatagcgcaaatttcaaaggaacgaatacatcctggagcccaaacagctatctggttctgctgctggcctcctgacaagtaggtaagagagtcacattttatagacgacggacaccaaaaccacacatgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttrggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggaataacaaaacgcagaagcgggaacgatgtctttttattcctccccagacgcaaacgtggatgcatgaggtttggtaacaggcaaagtcatctggttaacgtgactgatgcaaaaagtccnggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcrggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctgatgaggtgcaaagagcgggatcggaggcggggcctggccgggctgtgagcggcgtatgcaaatcgagggtctcggggatgcggatccaagaccctgggaaggtacgcggggcctggcggggcaccagctgctgctagctcggctgcaatgcaagtggtctaggttgctaaaggcatcccacagcctctccatctgaacatgacccaaaggaaactcgtgaccctaattccatgtctgcgcatttctggactgttgtccccccccccccccgccccgactactcagtcctccgtcttccggtccagggccccttgccaagcaccgggtccacctctccgtccccaccccggttgccttagaagtccgtcctgtcgcaacactgcagtcatggtcttgaggcccacccgccccaacgaacaccatcatgctgaggactttcccgggcaggccctgacttgctcagaaccagcgggggtgtccccttcccacccagggccactcccctgcactgtcacccggagagactgctcctctgtgccatccctggctcccacccaaccccagacccccaccacctctccatccctccagctgtggaggtctcacaaccccccaacccatctcaccgcccccccacccccaccccaaggcaaagtgactgaagcgggcagatggcttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgmaaagggtgctcagtagcctgtcgttgtgaaccaccatgtccagcagcaggggagtgatgttccgctctccgctgttctgggcctcgttgcccgccagctccrggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggagrrccctcggcgtctcctcctcctcggcatgctgggcgttgagtgtgctatctcggcttggcccagctaggcaagatggctctcaagaggacagttaccgcgtccagtactgtgtatcctagcgaccagggcccagcccctcattggctagggagccgagaccaatgggcacgcacatccggcgacgggcacgcatgtggtgacggcccctcacaagggacacacgtccgtcaggtgacctcatcactttcccattggcctcgagggagcaggcctgggcctagaagtggctggagggccgtgggggtggggtggggcggggcagggggaatcgcgctggtgaccctctctttgccagtgggaactttccctttctactggatgggaacaccgtgggaaagacaaaggggtgggcgaggggaggacgggtaccacgccttcacaatgttgcacatccatcacgaccacctagttccaaaacgttttcaacaccccgaaaagaaaccgaaacccctgtacctataagcagtcacttgccgcacgcctccttccacaccaccactaccagcccccacaccctcccacacacaccccctgcccccgcccatacacacgttcccgatagtccctggcaacccctagtccatctgctttctgtccatagaggttagcctgttctggagatttcctatagatggaattatacgaccaaatgtgaggccgtgtgtgtctggctgctttcacttagcgtaatggtttcatcagggtgcatccatgtagaggcatgaatcactacttccttcctttgaatgactgagtacgattctgttgtatgaataggaggccacattttgtttacccactcgtcagttgatggacaggttatttcccccttctggctattgtgagtggcactgccatgaccatctctctacaggtttttctttgaatatctcttttcagttcttttgggtctatttctagcagtcaaactgctggctcgtgtggtaattctgtttaacttattgaggaaccaccaaactgatttccacagcagctgtaatctttcgcattcccaacagtagtgcatgagagtcccaatttcttcacagcctcatcaaaacctgttttctgtttgcctcattttgttttgtttacagtagccatcctactgggtgtcaagtgctatctcatggtggttttcattcgtatttcccaaatggctaatgatgttgctgtggtttgagtgcatcccccaaattgtgtgtcttggaaacttaatccccaaattcacatgttgattggaggcgcagcctctgagacggtaattaggattagataaggtcatcggggtgagacccccaggatgcgactggtggctttataagaataggaagagaggcctgaaacgacatacacgctcttgccctctcgccgtgtgataccctctgccgtccccagatgccgggtcacttcccagtccccagaacggtaagaaataaatttcttttctttataaattgttcagtgtcgggtattcaattatggcaacagaaaacagactaagacatcttttcatgtgcttcttggccctctgtacctctgctttggaggaatgtctattcaagccctttgcccattttttaattcggttgattgtattttggctgtgggcttctaaaacttattcatatattctggaaaatagactcttatcagatatgtgacttgcaaatgtttctcccattcactttctggatagagccctttgttgcccaaaagatttacatttggatgtagtccaacttgccaaatgaaaagatatctgtggctttgcctttggtgtcatactgaaggagctgttgcctaatccaaggtcgtgcaaagttacatctccgttttcttcttagagttttatagtttcagcccttacatttagatctgtgatccattttgaattaattctttacatgatgtgaggtaggggtccaggggccttcttttgcatgtggctatccagttgtcccagcgcagtttgttgaggggattattcttcccctccacccattgaggggtgccggaactcttactgaaaataaactttacataaatatatgggtttattcctgactctgagttctgtaacattgacctaatgtatcgatcacgatggcagtaccacccttttcggattactgcggttttgtagtacgttttgaaattgggaagtgtgagtccttcaacttttttcttttctgagattgttttggctatctgagccccttacattttcttatgaattttaggatcagcttgtcagtttttacaaagaaggcaggttggattctgacaggcatcacgatgaatctgtatattgccttggagattatgggcatcttaacaatattaagtgtcccaatccgttaacacaaaatgcctttcgatttatttaggtcttctttaatttattttagcaacgtcttgaaattttcagagtatacatcttgtacacctttagttaaatttattcctcgacattttattgtttcgatgctactgtaaaatgaatcatttccttaatcttattttcatgttattcattgctagggtgtagaaatacaaccgactgttgcagattgatcttggatactgcaactttgctgagccgaatatgctttgctgagcatactcagacagggttggcatattagtccgttcctacactgctataaagaactgcctgagaatgggtaattcctaaagaaaagaggtttaattgcctcatggttctgcaggctgtacaaggcttctgcttctgggcaggcctcaggaaacgtgcaatcatggcggaaggcgaaggggaagcaagcaccttcttcacatgttggagcaggaggaagagagagagaacgcacgcaaagggggaagcgctgcacattttcaaacaatcatcagatcttgtgagcgctctatcagaagaatagcaagggggaagtccgcccccatgattcaatcacctcccactaggcccttccttcaacaggtggggattacaattcgacatgagatttgggtggggacacagagccaaaccgtctcagtttttttttttttcttttgttggactctttagtgtcctctatataagaacatgccatctatgcatctatgaatagagatggttttacttgttcccttccaatctggatgccttttatttctttttcttgactaattgccctgactagaactttgagtacgatgttgagttacaagtggcattcctgatcttagggggaaatcaaccagtctttcaccattaagtatgatattatctctgggtttttcatggatgccctctatcaggttgaagaagtttctttctgttcctggtttgttgaatttattttcatgaaagggtactgcgttttgtcaaatgatcctttttgtacatgattaagatgaccatgagccccctcccccgcccccgctccgccatgcattctgttaatatggtgtattatataaattgattttcacatgttgaaccaaccttacatttgtgggataaatcctatttggtcatagtgtataaagagtggtcaataaacatttcgttgaaagaataggagtggatctggcaagcttcttggaggacaatgtgtgtgttaaagaatctgtagcatgatgagaagccaaggcaccggtgggaggaggggagttgcaaccaattcattaaggctggagagtacgatgccagtggagcagtagtggttgatgtggctgggaaagaggtaggcaggagccaagacatggaggttctattatgccatgctcaggttttagaataccctgtaggctacactgaacccactgtggtctttcagcttgggagtgacgtggtctgatttgcctctagaaatatcaccctggaagctgtgtggagaatagaacagagaggattgtgtgtggagaatagaacagagaggactgagattggaattagaaagctgctgtattataccagtcaagaaatgacagatatctcaactaagacaatggcattggtagataagactaggggacagagtccataaaaagtttaggtagtaaaatggcacacagtagacactcactacatattactcatactggtgaacctagctggagacatgataattcatgtgctcattcttcaaaaaatattgaagggtagtgccaggtatactgtgttaagcattgagacaacaccaacgagaaatattctgttgtataaataggccacattttgtttatctactcatcagttgatgaacagttcattaaatgatttccatggcaggggaggtaaatgttgtcctctatcctcttagattctccagctaggacttaaataagatagattaacaaaagaaaagcatacaaaattttatttggcattttttacatgtacatgggagccctcataagaaatacgaagactcaagtgattaattacagctgaatacttacatactagggtgggaaaagtatggtaaattgtgaaaacataacaagacattggggtttgggctaggagagttaattgtggaaaagtcactaagaaggtaagagttgtgtaacaaggttttttggtgcagctttccctcaagcctggactccccatctctggcaataagaatgtgtttcttcttcctggtatacagataatacctttcacatcagagtttcatctcttcctttcatgaaaaaaaaaggaaggtcagtgtgcccttcttgcatctgctactttcaagtgcctttaaacacaaaataatcaatatgccaaagtggcatattttgaggtggcatttgatcccctacattactgattggatagtgtgaatagtgctgccatgaacgctcctgtacaagtgtttgtttgaacagatgttttaaattgcagacgctcctcaacttgggatggtattatatcctgataaacccattgttagttaaaaccattattagtgtaaattcatttaatacagctatattagtccattctcacactgctataaagaactacctgagacttggtaatttatgaagaaaagaggtttaatggactcacagttctgcaggcttaacaggaagcatgactgtgaggcctcaggaaacttacagtcccagcagcaggtaaaggggaagcaagcacgccttaccatggtggagcaggagagacagagagtgaaggacggaaatgtcatacacttttaaaccatcagatctcatgagaactcactcactgtctcaagaacagcaaggggaaatccacccccatgatccaatcacctcccaccaggcctctcctctgacacacggggattacaattcgatgtgagatttgggtggggatacagagccaaaccatatcagcggctaacctaccaatcatcataatttagccaggcctaccttaaacatgctcagaacacttacaattaggctacagttgggcaaaatcatataacgtaaagccaaatttataatgaagtgttgactatctcacgtaatttattcaatattgcactgaaagtgaaaggcagaatggttgtatgtgtactttaagtacttttatgcatatggattctactgaatgcatgttgctttcataccatcataaagtcaaaatattgtaagtccaaccattataagctgggaaccatccatatttgaggtacatacccatgaatatatttatgggtttatttcttgcttcttaattctattccatttatatatatgtctgtccttatgccagtaccacaaagcattgataactgtagctttatacgaagttttgaatttgggaaatgtgagttatccagctttgttattttttaggattattttggctatttgaggtcttgcacaattacacatgaattttaagattggcttttccatttctgccaaaaaaaaaatggccattgggattttgatgcagattgtattaaatctgtagatcactttgggtagtactatcatcttaataatattgtcttccaattcatgaacacaggatatattttcacttctttatgctgtctctaatatctttcagcaatgttttgtagttttcagtgtacaagtcttttacctccttagctgaatttattcctaagtattttattctttttgatgctattttaaatagaattattttttattttgttaatttcatctcagattgttcattgctagtgtgtagaaatacaactgatttttgcacgttgatcttatatcttgcaactttgctgaattcgtttattagctctatagtgttttgtggattcttcggggttttccatacataagctcatgttcatctgagaataagatagctttacttattccttttcaatttggatgccttttatttctttttttcctaattgctctggctaagacttccaatacaattttgaatagaagcagtaaaagcaggcattcttgtctcgtttctaatgttagggaaatatctttcagtcttctaccattgagtgtgatgttagttttgggtattttatgaatgctctttatcatgttgtggattttctcttccatttctagtttgcttagtgggttttttttttttttttttttttgggcatgaaaaggtgctcagctttatcaagtgatttttctgcatcaaccagaatgaacttgcaggggtttttttccctatattttattaatgtggagttgactgggggattgattgtcttatgttgaaccagtcttgcattattgggataatttccacttgagcatgggctataacctttataacatgctgctggatttggtttgctaatattttgttgaagatttttgcacctagatgcataagggaatattatactcacatattcaattacatgcaatttgtaattttcttttcttgtgatatatttgtctggctttgatatcaagatatggtggcctcatagtatgagttgtaaagtttactctccttttctgtctcttggaagagtttaagaaggattaatgttaatccttccttaaacatttagtagaatttaccagtgaggccttctagcacaatgcctggcacataatatatggaatctaggatttgtatagtcagtcattaactatttgttgaattaataaattgtctccccaagcaggtttctaatcaaggcacaaagattgagtaacgaatgaaggcaaagccaatgtatacagggtattagttttctaatgctggggtggcaaattaccacaaacttaatatggcttaaaacaacacaagtttattatcttacagttcgatagggcagaagactgacccaagtcttactgggctaaaatcaaggtgtcatcagggctgcatttctttctggaagctctagaaaaggatcctttttcggtcgcctgtagtcccagctactcgggaggctgaggcaggagaatggcgtgaacccgggaggcggagcttgcagtgagcggagatggcgccactgcactccagcctgggcgacagagtgagactccctctcaaaaaaaaagaaaaagaaaaggatcctttttcctttcttttccagcttctagaggccacacacattcattaactcatggcttccttcctccatcttcgaagccagtaacattgcacctttgtgactattcttaagtagtcacgtctccctttgactctcctcttctgcctctctctctcactttcaaggcctcttgtgattacattgggccgacctggataatccaggatattctccctattttgacatcagctaattggcaaacttaattccatctgcaaccttaaatccctcttgccatgcaacataacacagtcaaatgttctggggattaaaatgtggacatcactgagagatcatattcttcctagcacatacggtttagtcacaagttaatgatcaacatttattagctatataatactcttaagttcaacataaactttttggatgctgataaaacggaatggcattttacattgatatatacttcatttcaaaacttcttctacttctcaatgattattctgtagcaacaaatttcttttaaatcagaaatttggaaacataacgagacctatctcaaatcaaagatgactatccccttttggagtcagactacacattcattattttagtcaaaatgagacataaaattcaggcccccaagagctgccagtacccacttacgcaggaggtagctagacgaaacaggtagctttctacaaatgattttgcaccatcccaccccagagaggtggtttggagtgtttacttattacctgggatttaattatactagctcttgcaaaagccaaatctaaaggccataaatagaaggtcaaattttctcctatatagaaaggagagcagcagagaaaacaaaatccttggtaaatctttaaacaaagttatatggtttgaatatgttattcattctattttaacccccccaatacagatatatttataaaaaagaatattgtgatttctggtataacttgtttaggaacaaagccacaaatttattaatattttctattccctgggaagaaaaaaatgctacatggcagaataattttttaaaatttccagccgggcacggtggcttatgcctgtaatcccagcactttgggaggccgaggtgggcggatcacaaggtcaggagattgagaccatcctggctaacacggtgaaacaccgtctctactaaaaatacaaaacattagctgggtgtggtggtgggcgcctgtagtcccagctactcgggaggctgaggcaagagaatggcgtgaacccgggaggcggagcttgcagtgagccgagatcgcgccacggcactccagcctgggcgacagagcgagactccgtctcaaaaaaaaaaaaaaaaaaaaaattcccatgatactaaactgatgtgtgatcatataatagacttacactgatacctattttagtgtattcaagcagataaaaaatcccaggtgttctatgagtgatatcattttcagtatttcttatgctgtatgccatggtttaaatctaggcctttcgaattggcattactaccatatttctcaaactgtattccctttctcttgaatatgttatgtaattttgtccagaacccagacatgtcaaggtgtcaaatcccacgttttggatactaacgtgtctcattaattcatacagtgggatcattcattaatgcccacattatagactctctctctctctacacacacacacacacacacacacacacacacacactacattcttagaagatcattctgagaccagggtggaggataggctgtgcattcccagtactctttcacagctgactgtgtcctctgccagtgttttcaaactttactgcttatgaaacagctaagggtcttattaaaatttagattctgattcagtagaactgacatggtgcccaaggaactgcatctcttttaaaaaatctttatttaggtataattgacaaaagttgcatatatttaagaggtacaacttgatgttttgatatattttgtttttcatatatgatgtttgatacattgtgaaatggtcaccacaagcaagctaattaagatatatctatctctttgcctagctacctttttttgtggtgagaacatttatgacctactcttttagcaaatttcaagtatacaatattgtttactatagttactatatcgtacattagatctccagaactaatttatcttgcataattgaaattttgtaccctttgatcaacatctccctgcttcccccacaccacagtccctagcacctaagattctactgtctgcttttatgagtttgaccatcttagattccacatatgaggtcatgaagtatttttacttcagtgtcggcttattacacttagcatannnnnnnnnnnnnnnnnnnntaatattttataattgtgggaatattccatcagatatatatatatcagattgtctttatccctccatccatcaatggacacacttaggttgtttccatatcttgactattgtgaatactgttacagtgaacatgggagtgcagatattcaacatactgattttgtatcctttggatatataacagaagtgagattgccagatcacatggtattcatttttagtttttttgaggaacctctatgctgtttttcataatggctgtaccaatttatttttgcagcaacagtgtacaaaggtttccttttctccacattaccaccaacatttgtcatcttttgtctttttgataatagctatttgctatggtttgagtgttttccccaaaaaacatgtgttggaaacttaattcccaatgcgacagtgttgggaggtagggccgaatgggagatgtttaggttatgaggactccaccctcatgaatggattaatgccgattacaaaagcacctaaggctgtgaatttgaattgctctctcttgccctctttttgcccttctgccatgttatgatatagaaagaaggcctttgccagatgctggcctcttgatcttggactgcccagcctccagaactgtgagccaaatacatttctgttcactacaaattactcagtctgtggtattctgtcatagcagcataataaattagagtccataataagttatagtccataacagactaagacactattctaatagatgtgagggaatatctcattgtgttttgatttgcatttcccctgtgggttagtgatgctgagcatcatttatctgttggccttttatatttcttcttttgaaaaattctatttgggttctttgcccatttttaattgggttgtttcttactaatgagttgtttgagtttcttacccattatcagatatacagtttgcaaatattttcatccattccataggttgtcttttcactctgttgattatttcttttgctgtgcagaaagtttttagtttaatgcaatcccagtttctatttttgtttttgttgcctgtgcttttggtgtcatataaaaaaattattgcccaaatcaatatcaggtagcttttttcctgttttcttctaggagttttatagtttcaggtcttatatacaagtgtttaatcaattttgagttgaattttatgtatagtgtgagaaaagggcccaatttctttcttctgcatgtggatattcagttttcccaatatcatttattgaagagactctcttttccccgttgtgtgttcttggcacccttgtcaaaaatctgttgactgtaaatgtgtgaacttatttctgggcttttctattctgttcccttggttgatgtgtctatttttatgccagtaccatactattttgattactggagacttgtagtatattttgaaatcaggaagtatgatgcctctagctttgttcttcttgcttaagattgctttgccaggctgcatgtggtggcccacgcctgtaatcccagcactttgggaggctgaggtgggtggatcacttgaggtcagaagtttaagagcagcctggccaacatggtgaaaccccgtctctactgaaaaaatacaaaaattagccaggtgtggtagcaggcccctgtgatcccagctaatctggaggctgaggtggagaatcacttaaacctgggaggcagaggttgtagtgagccaagatcgcaccactgcactccagcctgggcaacagagcaagactctgtctcaaaaaaaaaaaaaaaagattgctttgcctccttggggtcttttgtgatttcatattaattaaaattttttttttatttctgtgaagaacaccattgagattttgatagggatcacatcaaatctatagattactttgggtagtgtggacattttaacaatactaattcttccaatctaggaatatggaatatcttttatttatctgtgtcttctttaatttccttcataaatgttttctatattttcattgtacaagtctttcatttctttggttaagtctattcctaagtattttattcttttgttgctattgtaaataagattattttctaatttcctttgggatattttatagtgtatagaaacaccactgatttctgtatgttgattttgtatcctgcaactttacagaattcatgtattagttctaacaatttttttttgagtctttagagttttctacatgtatgatcatgtcatctgcaaaaagagataattttactattctcttctatttggatgctttttattttatttattttttaaattatattttaagttctgggttacatgagcagaacatgcagttttgttacataggtatacacgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtctgcatatctgtttggccccagtaccatgctgttttggttactgtagccttgtagtatagtttcaagtcaggtagcatgatgcctccagctttgtccttcttgtccaggattgtcttggctatgagggctctttgttggttccatatgaagtttaaagtagtgttttccaattctgtgaagaaagtcagtggtagcttgatggagatggcattgaatctataaattactttgggcagtatggccattttcatgataatgattcttcctatccatgagcatggaatgtttttccatttgtttgtgtcctctcttatttccttgatcagtggtttatagttttccttgaagaggtccttcacatctcttataagttgtattcgtaggtattttattttcttagtagcaattgtgaatgggagttcactcatgatttggctctctgtttgtctgttattggtgtataggaatgcttgtgatttttgtacattgattttgtaccctgagactttactgaagttgcttatcagcttaaggaggttttgggctgagatgatggggttttctaaatatacaatcatgtcatctgcaaagagagacaatttgacttcctcttttcctatttgaataccctttattgctttctcttgcctgattgccctggccagaacttccaatactatgttgaataggagtggtgagagagggcatccctgtcttgtgccagttttcaaagggaatgcttccagtttttgcccattcagtatgatattggctgtgcgtttgtcataaatagctcttattattttgagatatgttccaccgatacatagtttattgagagtttttagcatgaaggggtgttgaattttatcgaaggccttttctgcatctattgagataatcatgtggtttttgtcattggttctgtttatgtgatggattatgtttattgatttgcatatgttgaaccagccttgcatcccagggatgaagccaacttgattgtggtagataagctttttgatgtgctgctggatttggtttgccagtgttttattgaggatttttgtatcgatgttcatcagggatattggcctgaaattttctttttttkttgtgtctctgtcaggttttggtatcaggatgatgctggcttcataaaatgagttagggaggattccctctttttctattgtttggaatagtttcagaaggaatggtaccagctcctctttgtgcctctggtagaatttgtctgtgaatccgtctggtcctgtactttttttggttggtaggctattaattactgcctcaatttcagaacttgttataggtctattcagggattcaacttcttcctggcttagacttgggagggtgtatgtgtccaggaatttatctatttcttctagattttctagtttatctgcatagacgtgtttatagtattctctgatggtagtttgtatttctgtgggatcagtggtgatatccccaatatcattttttattgcatctatttgattcttctctcttttcctctttattagtgtggctagaagtctatctattttgttgattttttcaaaaaaaccagctcctggattcaatgattttttgaaggtttttttgtgtctctatctccttcagttctgctctgatcttagttatttcctgtcttctgctagcttttgaatttgtttgctgttgcttctctaattctttaattttgatgttagggtgtcaattttcaatttttcttgctttctcttgtgggcatttagtgctgtaaatttccctctaaacactgctttaagtgtgtcccagaaattctggtacgctgtgtcttcattctcattggtttcaaagaacatctttatatctgccttcatttcattatttacccagtagtcattcaggagcaggttgttcagtttccatgtatttttgtggttttgagtgtgtttcttaatcctgagttctaatttgattgcactgtggtctgagagactgtttgttatgaattcccattcttttgtatttgctgaggagtgttttacttcgaattatgtaatcagttttagaataagtgtaatgtggtgctgagaagaatgtataatctgttgatttggggtggagagttctgtagatctctattaggtctgcttggtccagagctgagttcaagtcctgaatatccttgttaattttctgtctcattaatctaatattgacagtggggtgttaaagtatcccactattattgtgtgggagtctacgtctctttgtatgtctctaagaacttgctttatgaatctgggtgctcctgtattgggtgcatatgtatttaggatagttagctcttcttgctgcatttttccctttaccattatgtgatgctcttctttgtctcttttggtctttgttggtttaaagtctgttttatcagagattaggattgcaactcttgcttttttttttgctttccatttgcttggtaaatattcctccatccctttattttgagcctatgtgtgtctttgcaagtgagatgagtctcctgaatacagcatactgatgggtcttgactctttatccaatttgccagtctgtgtcttttaattggggtatttagcccatttacatttaaggttaatattgttatgtgtgaatttgatcctgtcattatgatgctagctggttgttttgcccattagttaatgcagtttcttcatagtgtcaatgttctttacaatttggtatgtttttgcagtggctagtaccagttgttcctttccatgtttagtgcttctttcaggagctcttgtaaggcaggtctgatggtgacaaaatccctcagcattcggttgtctgtaaagaatttcatttctccttcacttatgaagctttaagaggtttaattgactcacagttctgcatggctgtcccataagtcccatgttctttcctcaggaaacctacagtcatagcagaaagggaaataggcacatcttacatggcagcaggcaagagagagtgtgtgaaggaggaactgtcaaacacttataaaaccatcagctctcataagaactcactatcaggagaacagcgtgggggaaaccatccccatgatccaatcacctcccactaggtccctcccttgacatgtgggcattatggggattacgattcaaggtgagatttgagtgggaacatagagccaaaccatatcagtatctaaaaggaaaaaccttcagtttttccacatttggttatgatatcagctgtgagcttttcctatatggtctttattgtgttaagttccttctgtatctatcttgctgaaagtttttattatgaatggatatctagttttgtcaaattctttttctgtattgatcgaaataatcatgtgtttttcatctttcattctgataatgtggtatatcacattgattgatttgcccatgttgaaccatccttgcatcctagggataaataccacttgttcatgatgaatgatccttttaatgtgctgttgaatttggttggctggtgttttgttgaggatttttgtatccgtgttcatcagggatattggcctgtagttttctttcttttcttttcattttctttttctttctttttttttttttttttttttgagacagagtcttgctctgtcacccaggctggagtgcagtggtggtatgatcttggctcactacaacctccacctcctggattcaagcgattctcctgcctcagcctcctgagtagctgggactactggaacatgccatcacacccagctaatttttgtatttttttagtagagatgagttttcaccttgttggccaggctggtctcgaattcctgacctcaagtgatttgcctgcttcagcctcccaaagtgttgggattacaggcttgagccaccacacctggcctggcctgtagttttcttttctagtgttgtttttgcctggatatggtatcagggtgatgttggctaataaattgtattttgaagtgttctctcttgtattttttggaagagtttaagaaatactggtattaatacttcgttgaatgtttgatggaattcatccatgaagccattggtcctgggcttttctttgttggaaggtttttgattactagatttaatatccctatttgttgttagtctgttaaggctttctatttctttgttattcagttttggtatgttatatgtttctaggaatttatccatttcctctaggttaaccaatttgttgacacttataatagtcccttatggttctgtctgtttctgtgacatcagttgtagtgtctcctctttcatttatattttatttatatgagtcttctctctttttttcgtagtctagataaggacttgtcaattttgtttattttttcaaaaaaatcaactcttagttttgtcagttatttccaattgtttttttattctcttttttatttatttctgctctagcatttattatctcctttgttctgctacctttgggcttagttttttttttcttctttttgtagttcctggaggtgataagttgggttgtttatttcatatgtttcttctttttaaatataggcatttattgctataaatttccctattagtatgcttttactgcatcctttaagttttggtatattatcaagattttggtttcttctgtgacccaatggtcgttcaagaatgtgttgtttagtttccacatatttgtgaattttcgtgttttcttattgttattgatttgtagtttcaatccattgtggtcagaaaatatacttggtatgatattaatcttcttaaatttattatgacttgttttgtgacctgaaaggtgatctgtcctgaagaatgttttgtgtgtgcttgataattctactgttgggtggaaagttctgtatatacattttaggtccattgggtctattttattcttcagttctgttttgtccttattgattttctgttgggatgatctattcattatagagagtggagtattgaagtcaactatattatattgttatctatttctccttccatgtctgtcaatgtttgctttatatatttaggtactttcgtgttgggtacatatatatttataattattacatcttcctgttcaagtgacccttttattatataatgaccttctatgtctcatgtcacagttttttacttaaagactattttttctcatacaagtatagccacccctgctctcttttggttacagtttgcatggcataactttctccaccccttcactttcagcctatgtatgtccttaaatcaaaagtgagtctgttatcaacaacatgtagttgggtcctgtttatttttgtttcttacttcccatctctgaattgttggctttttaaaaagcccattcagttactctgtgtcttttgactggggagtttagtcaatttacacttaaagtaattattgataggttaggactttctgttgccattctgttaatagttttctgttttgtagttttcttgttcctttcytctttttctttctttgtggtttgatgatttttgcttggatgtgttttgattcttttctctttatcttctgtatatctactgtgtgggggggcggtcgggggggttaccacagggatcaaattgaacactttatagttatggcagtctgttttaagctgacracaccttcaatcacatacagaaactctatactttactcattccccccgccacaactttatgtaatcgacgtcatattttacttccttctatattgtgtttccattgacaaatttctgtcactatagttactattactatttttgtcttttaatttataaattaatattaatagtgatttataacaatcattatagtgttacaatagtctatgtttctctttatatttacctttagcagtgaaaggattcatatgcttttgtgttactgttttttttttatttcaacttgaagaactattagcacttcttataaggcaggtctcatggtgacaaaccccctcagtttttgtttgagaaaggctttatctttgtgttcattcttaaaggacagtttttccagataaagtattgttgattggatttttttctctcagtactttgaatatatcatcccactctttcctgacctgcaaggtttctgctgagatatccactcatagtcttatggagctcccctataggtgacaattcactttcttcttactaccccaaaattctcttttgtctttgttgaaaatttaattataatgcatctcactgtagacttctgtgggtttaatgtatttggttatctttgggcttaatgaatccagatggcacttcccctccatagatttggggagttctcacctattatttctttaaataagtttcctttctctctctcttctccttttaagatttctataatgcatctatcattttgcttgatgatgtcccataagtcctctgttcttccttcactctttctcattgttctttttattccgctaactagataatttcaaatgacttgtcttcaagtttacaaattctttcttctgaatgattgagtctgctattaaagatcgctattaaattttttagttcagtcattcttcagctatattcagcaatattctttagctacaggatttttatttggttcttttttatggtttttatttctttattaaacttctaatgttgttcatgtattgttttcctcattttgttagtcgtcttcctgtatcctcttgtagctaattgagcttctttaaatgattattttgaattctttgtcaaaaatttcatgaatctccatttcttcagggttggttactggagctttattagttccctttggtgatgtcatatttgcctgattcttcatgatccacatagcctagcattggtatctgtgcattggagtgagctgacacctcttctggtctgaagttgggtactcagacaatgggcccattaccagggctttggataggtgtagctctcactgggtccttgagtgggcaggactgcctgcagaccatgatgcagtgggcctggagctgggtcaaagggctgcttcagggtccccacttgggcccacagtcagtgggcctgttatgggggcacaggtaagtgtggattcaggcaggactgtctccagaacatggtacagcaagactggagttggctcacagggttacttctgagtccacagtcaggtctagttggtgggcctgcttccagaggtggactggcatgactcccacctgtttcctaagtaggcaaaacttccccaagaccatggtagtgtggtactgaagctgctttaggtacagggctgcttcagagtccacagttgggagccctgttactggggttgccaatgggagttgctcctcccagattcctgggcagatagggatagtggtaggaccacatacaaacaactctggagctaagtccccagggtggtgggctgcttctgggtccacaaccagaactacagttgacaggcctgccgctagaatgtgggcctgccttattaaagtattcatctttgttcttgagctctaccagggtttctcaacctcctacctgaatcccaaggctcccacaaagacacttttgtccatagatcattgtcaaattattgttcctgtgggggaacaagagctagggacctcctatcccatcaactcactgataccgttctcctgatgctgcattttgaattgccctcaggtgatgctgctactcctggtctgtggaccatgctggagtagcagagcccaaatggcttcctcaacttttatgagccttttacaggaactcaaagtagaaaataacttcacttgccccagacctaataatttcctttgttcccacttcttcttggtgctttcctcctttgtgtctaccatcgtaacatccatctaaccatagttgtcttatgtagatgttggatgctgttgagaaacgcacaaagcaaattagaaggaagatatgattgacagaaattgctttttactctgtattcactttccatgtatttgtgctaatctctccatacaggtcttctttggcaatgtggattcatctgggataaaacacratatttttaaccctccaattattgctygatacatcyrtttgcaccvarytcattatagcattydcagcactcttcgcatggagtbgatgggctgtgatttaaatagtaagtgccaagtcatcccatatccttcttccctcaaccatgggtagggtgactaactgttctagttatcctgagactgggggaggggttcccggtatcaggacacaaaattgtcagtgctaaaaccagcatagtcctgggcaaacccagaaataccattcaacccagcagtcccatcactgggtatataatcaaaggaatataaatcattctgtcataaagacacatgcacgcatatgttcatttcagcactattcacaatagcaaaggcatggagtcaacctaaatgcccatcaacaacagattggataaagaaaatgtggtacatacataccatggaatactatgcagccataaaaaagaatgagatcatgtccttttcagcaacatagatgcagctagaggccattatcataaatgaactaatgcaggaacagaaaaccaaatatcatgtgttctcataagtgggagctaaacattaaatgcacatggacacaatgatggacactcaggaggggagaggttgggaggggggtgtgggttagaaggttatgtattgtgtactgcactcactacctgagtgaggggatcattcatacaccaagcctcagtgacatgcaatttacccatgcaacaaacctacccatgtacccctagaatctaaaataaaagtagaagaagaaaagaaacaaagaaaattaaagagtcacacaaagtgggaagagctggctggaaaacagatagcaataacagaattggccgggcgtggtggctcacacctgtaatcccagcactttgtgaggccaaggcgggtggatcacgaggtcaggagatcaagaccatcctggctaacatagtgaaaccccaactctactaaaaatacaaaaaattagccgggtgtggtggtgtgcgcctgtagtcccagctactcgggaggctgaggcaagagaatcgcttgaactcgggaggcagaggttgcagtgagctgagatcatgccactacactccagcctgggtgacaaagcgagactccatctcaaaaaaacaaaaacaaaacaaaacaaaacaaaaaaccaataacagaatctgtgcaaaagttaaaacctgagaaatgatattatgatgacagtagccctagaatatcagtggaagctgctcagtataactgaggctgaagcatgtccttgtgataaccttcttttttcttttctttgagkttgcagcatgccattggkaatggagagtaaagcaatatcagatgcacagawtactscttcatcctaytttaccaatatgtttsccacctrgtctcyttcaaaagctbnacttcacctccaagggaggagtaatgcctggagacctyaggtaagaggcaacagatttactgtttaactgactcagagcagtggttggggaaaaaatckgggaaggccttgactgtttcttctgaggtatttctgtcaactgttagttctaaaaagtgtgtcaaggaagtttggttatgggcagacaaccacacaggcatttgggggaaatgatctctaattgaacctcctggaagaagaatctctatatctagtactgagctaatatctgtcaaagaattgtagaagctaaagtccattttacagataaatatcaacaattagctttctttccaggtttctcattacatcaatgaaaagtaaacatttactgcacatcttagtatccctaggatgagcctagggatacaaaggtgaattgtgaaaaattttggccctgaagttgcttagagttgaataagagagactgactagccaatagaaagtggaggctgggtgcggtggctcatgcctgtaatcccagcactttgggaggctgaggcgggccgatcacaaggtcaggagttctagatcactcttttgctgaggcaggataatcgcatgaacctgggaggcggaggttgcagtgagctgagatcatgctattgcactccagcccaggcaacagtgcctgactctgtctgaaagaggcagagagagagagagagagaaagaaaggaaagaaggaaggaagaaaaagaaagaaaggaaggaaggaaggaggccgggcagagtggctcacgcctgtaatcctagcactttgggaggcctaggtggcagatcacctgaagtcaggagttcaagaccagcctggccaacctggtgaaacctcatctctactaaaaatataaaattatctggacatggtggtgggcacctgtaaccacagctactcgggaagctgaggcaggagaatcggttgaactcgggaggcagaggttcagtgagctgagatcatgccattgcactacagcctgggtgacagagcaagactccgtctcaaaaaagaaagtagagtgagaagtgctgtggtatggttaagagggatttgggaatttctgggagtaaatggtgaccaagaggctactagtccaactctattgccctcagrtgaataatccaaaagagtgkctgcaagtggacttccagaagacartgaaagtcacaggagtaactrctcrgggagtaaaatctctgcttaccagcatgtatgtgaaggagwkcctcayctccagcagtcaagatggccatcagtggactctcttttttcagaatggcaaagtaaaggtaagctggtctccttggaaagaaagaaagaaagaaaaaaaataccacctctcctagagcttaacataacataaaaaggttgatatatgaccaaattttcagagcaaaatttattaagtacctatggtagcaagacattgtaaaaggcattctgagagaacacagtgactttaagaaaaaggyaaaatactgagaaaagggcagagtagatccaagagttaattctcctcatcagcaccttgattcccaagcctttttgacctttaagtttagtggtccaggaagtcttcattcttaatctgggtttgctggataattcaacaaattgtcctgattaaaagacatgacataaagtcttatcaccccatgagtaatgggggaaggaatagttcctctctttggtattttttatattcttttttcaccaagaattaaccatgatgtggtccttaccaatctctctaatacagtctcttgccacttggctctttaagctccatccatactaagaaattctcaggtcactaaatacagccattatatctcataccaggcttttaaatagatactatttcttctacctggaacatttttctagctaccctctactgccactttcacctgactcattcgttaagtctcaggtaaacatcatgtccaagaagaattcccttatccatcaaggctggatgaaagacttcaccaaactggcagtttggtgaactgaagtctagacattggatattctagaagaaaaattcccatttaaaaaaggttatatctctgattagtgccacaacatgatgaactttcaaaatatgctaagtgaaggccgggcgcggtggctgatgcctgtaatcccagcactttgggaggctgaggcaggcagatcacgaggtcggtaaattgagaccatcctggctaacacagtgaaaccccatctctactaaaaatacaaaaaattagccaagcgtggtggcgggtgcctgtagtcccagctactcgggaggctgagacaggagaatggcatgaacccgggaggcagagcttgcagtgagccgagatcgcaccactgcattccaacctgggcaacagagtgagactccatctcaaaaaaaaaaaaaaaagaaaatacgctaagtgaataggccagacataaaaggatagatattatatgattctacttatatgagtgtgttagtcagggatatccaaagaaatagaaccaataggagattctgtctgtctgtctctctctctctgtctctctggatgagctaaactgttttagttcaagactgaaagcaggaaaaagctgatgttccagtccaaaggcagtcaggcagcaagaatactttcttacttggggaagactcagtctttttgttctattcaggccttcaactaattggatgatgcctcccacattagggagagcaatctgctttactcagtctactgacttcgatgttaatcccattcaaaaacaccttcacagaaataaccagaataatgtttgagtaaatatctgggcaccttatgaccaagtaaagtagatacataaaattaaccatgacaagtccaccccttgtcaatgtagcacccatcatacacatctcctttatctctaagtagagacaaaaatgaggtcataattccacctaacatgatataacaaaacttggctggtattgataactaccttcttctactacccattctgtattgactttgccttcagcaagcatctcagctgattgtggttctttacctgatgaggtgacccaaacctttattcctgaagagcctgggccactagtagtcctgcatggattgggttgctgtagtttcccattgaccagaatcatagggcctggtaatactaagagacactctaagggatctattgtattccagacacactcttccatacctccattgtgaagcagtagttcagtttccttccaggaaggacaaaacgctgccccttccatgatgaacatattccaatgtaatcaacctgctgccagatagctggctgatcatcctgggaaatactgccatactgaggactctgtgtttgtctctactgctggcagattgggcacttagcagtggccatagccaggtcagccttgttgaatagaagtccatgttgctgagcccatgcatagcctctatccctgccaccatggctactttgttcatgagcccatcaggcagtgacataggtggctgagtaaaaaggatgactggtatccacagaacaggtcatcatatctactttttttttgagatggagtcttgctctgttgcccaggctggagtgcagtggcacaatctcagctcactgcaacctctgcctcccaggttcaagcatttctcgtgcctcagcctcccgagtagctgggactacaggcacgcatcaccatgcctggctaatttttgtatttttagtagagacagggtttcaccatgttggccaggctggtcttgaactcctgacttcaggtgatcctcccgccttggcttcccaaagtgctgggattacaggcgtgagccactgcacccggcccatcatatttacttgattattgaaatccttatctgctgaggtcacccttcgttgagcactcacatgggacataaatatattcacatcctttgcccattcagagagatctgtccacatacctcttccccaaatttctttgtcacctgttttctaatcatgttccttccaagtccctatctggacaaagcactgactacagcccattacttgacatataattgcacacctggccatttctccttctaagcaaagtccacaaccaggtacactgcctaaaattctgcccactgtccttcatgggtatctcagatcgggactgtccacttttgtgtagtacctgcatatcgtgcagaaccgtctgtaaaccaggcccaagactcctcttcctctgtaaactgatcatagggaactcccaatggggccataagtgcaggctgggagagagaaggcagggtagcagaaacaggcaccatggacatttgggctacttcttcatgtaatttacatgtgttttcagtacctgctcagacatgatcatgtatataccacttccatttgatgatggagtgccattgttcatacccaactttatggcttggtgggtcagataacacctagttcatgatgggcagttcaggtcacatggcaacttggtggtctgtggctaagcattcagtatctactaaggcccagtagtaggccaagagctatctcacaaaaggagaacagttattcacagaggattacaggaggatttctcactacagtagcccctgctccataggtcagggaaccaatgtgaagatcctgctagctgctcaatatatctgttccaattacgcattccaggactggggaaataaccacaagatagtctcacagatcctctgcatccactttgagatggacttgagctaaaattccattgatcatttgaccctccataagcccatactctgactggtggaccacagtgacattttgggtctcctgaaattagtgccagttcagagccattgtccagtagtccctgaaaggtctgattaattatttttcttcagtgcacatttattctgatagaaaggccatatgtccctttggggaaggctgagagaaagagtggcagtattcttggcagtgtaccagagtccttcctcaaggagactgagcctccccttcattcaaggagtgctgggtctgtaaacctgctcaagtctgggaattgattgagaggccgtgactctgtttttattattcaggttagacttttgttcacttgacctagaacttttccacttatgcagttcaagaatttggtaggcattctatctatatcacatctaggaacactataatctactagccaacaccataggtctgtgcaagtcatactattctaactgctgctttgactctgctgtcccttatggtaaccacacttaccttgcctttggcagttgagtgctgcccattggccccttccaccccaggatccaattattcccattgtatttaggttttctaattcagtgactgcaggtcctgctgtaaggtgtcacctacagagaagagtgatcacagagcccttcaaggatgctgaggttcccctcacaaatttattcctcaaagtaatagtgagatctgggtcttctgaactctcccagtgttggtgagtatgtcttaaatgacaaattcactctagcatttcaatctcctttcttctacattaaaccagggcaagtctgaaatttctagtttgctcactgtgggccatcttttggtctgtgtttcagccaaccaattaaactgttagaggccttcctaattccctgagatgcaacattaagtccagaatctctgcttagtgggcccatgtcaataaatttggcctaatccaactttacgtgccttccaccgttatctcacatccttagtacccattcctatacatattctctggattcctgcttgtgtaaattagaaaactcaagtcatgattttggagtgtagtgcaccttgtcatgggtcaccttcatacctcacctcgcctgctgggacttgagtgtagttatagatctaataacaaagaggggtggtagggtgggtcctgaagggaatcagcattatcttgcatggcagttgcctcaggggaagccattacagtttcctcaggcagtgcagggttaatccacttagactggagtagagatactgccaccacagggctggagagaaaactttcactgacaaagaagactcatcaatatttaggagctcaatgtccccagcttaatcagggtcttccacacatacctaatccaacttgtagtgccccattctttcccaatcactgcccttgctttaacagtagacaccctgcaaagctgggagtttggcttgctttgtaattcagttagtcacaggatgagatttggcatttgattttcagcaatcctcagctctgtggctacagtagataagggtctccttcagggcatacatagaatctgtcaagtcatttatgcagctcttgagctgggaattcaaattcctgagctcctccttttctttcatcactttttccagcaacattaggagcaaccgactaatcccatcatattcattagtttgacaaatatgttcacaagtgtcaatatacatagtcaccaagacccttgcttcttaaaagtagttgattaggagtatccaatggagatattttgcatatacatattttttgagatggagtctcgctctgtcacccaggccggagtgcagtggcatgatctcagctcactgcaacctccatctcccaggttcaagcgattatcatgcctcagcctcccgagtagttgggattacaggcacctgcctaatttttgtgtttttagtagagacagggtttcatcatgttggccaggctggtctcgaactcctgacctcaggtgatccatccacctcggcctcccaaagtgctgggattacaggcgtgagccaccgcgcccagcctggcctacatatttctattgccagatcatgccatggacaatttttactactgaaaatagtcattagtgtctttaaatttcatcaggttacagaaccaattccagaaatccaataacaaatttataaaatttatccttaaaattctgttcctttagaatcactcttggtgtgaaaatctgtattagtcatggttcccaaagaaacaaaaccagaaccaagaggagatacatacacacacacacacacacacacacacacaaggaattagctcatgtgattatggagtctgccaagtctcaagatctgcagggtgagttggcagcctagagaccccagagagctgattcgtagttccagttcaaagaccagcaggctacagacccagaaagagttaaaatgttttagttcgagcccaaaggcaggaaaaaaactgaagtcccagtttaaaggtagtcaaatagaaggaactgtctcttactaagaggacagtaagcctttttgttatatttaggccttcaactgattggataagttctacccacactggggagaacaatctgctttacttagtctaccaattcaaatgttaatctcaccaaaaaacactctcacagacacacataaaataaagtttaatcaaatatatgggcaccccatggcccagtcaagttgacacataaaattaaccaccataatgaggtatctagagcaggcaaattcataaagacagaaagtagaaaagaggttaccagggtcttggaatggggaagaaatggagagttatttttaatgagtacagagtttctgtttggggtgatgaaaaagttctggaaatggatagtggtaatgggtgcacaatattgtgagtatacttaataccactaaattgtacacttaaaaatgattaaaatggtaaattttatgtatattgtacaacaataaaaaaggctatatcactgacaatgcattgttgtatttagcaaagaaaggggaatctccagcctccccatcaacaaaaacccccacaaacttctattttaaaataatgagctgaaatcatagcggagaggtgaataatgagcaaatataaaaaggaagacctttcctcagacagaatgcccatattaatgttgttactggaagactaagccttgagcaaaatgcaaggagaactcagtgtgagaattctgcattgtcatgaatcccagaaggaagctagagaagttgcagataaatattatcctctggcacctggaagaaccattctcaacctactctagaaaaaaagcacctccagtttaggcctccaggattcctacatattaaaattataagatcacagacatagatcagcaaacatgcaagacaacaagacaacttgagtacaagtgaacagaaacaatcaattcagatttaaaacttgaagaacaccagatattgacattatcggatacataatatgaaataattatgtataaaatctttaaagtaataacatatggaaacatgaaaataaaagacaaattatccaacattattaggcagttgaaaaaaaccattgcaggttacaaagtcaacatgcaaaaatcaattgtatttttatatactaacaattacaaatatgaaaaggaaaacagaaaagtctatttacaatagcatcaaagataatacaatatttaggaataaatttaacgaaggaggtgcaagtcttgtccactaaaaacaaaaaaacccagttgaaagaaactaaagaactgtctggtctgaagacagcaaatatggaaaattagcaactagaaaaaaattaaaaattaaaaattaaaagagaaattaaataactaaataaatgaaaaggcatcctggatttatggatttgaagacataatattcttaagataagaatattaccacaaaccatttgcagattcaaagcaagcattctgggtttttttgtttgtttgtttgttttttgatttgagacggagtctcactctgtcgctcaggctgcagtgtggtggtgcaatctccactcaccataacctctgcttcctgggctcaagcgattctccggcctcaaagcattctctatcagaatcccaaagacatttttttttttgaggaatagaaaaatctatcctaaaattcagatggaatttcaagggaccctgaatagccaaaacaatcttgaaaaagaacaacgttggaggagtcatacttcccaatttcagaacttactacaaagctacaagaatcaaaacagggcagtacttacataaatatagacacatagatcaatggaatagaattgagagtccagaaataagcctatacatctatggtcaattgattttcaataaaagtgccaagaccattttgtgggaaaagaatagtctcttcaacaaatggtgctgggacaattggatatccacatgcaaaagaatgaagttggatctttaccatatacaaaatttaactcaaggctggatgtggtggctcacatctgtaatcccagcactttgggaggctaaggctggtggatcacttgagctcaggagtttgagaccagcctgggcaacacagtgagactctgtatctacaaaacaagaaaaaaaaattagctggcatgatggtacacacctgtagtcccagctactagggaagctgggataggaggatcgcttgagcccaggaggtggaggctgcagtgagccatgatcgcaccactgcactccagcctgggtgtcagagcaagaccctgtctgtaaaaaatcatttaactaaaaatgtatcaaaaaactaaatataaaagctaaaaccataaaactgtaagaaaaaacaaagaggtaaattgttatgatactggatttggcaatggtttcttagatgtgacaccacaatcacaagcaacaactctataaaaatatatatagtaggcatctttaaagttaaaagcttttgtacatcaaagaacactatcaagaaagtaaaaagatgatctacagtataggagaaaaaaattgcaaatcatatatctgataaagggcctagtatcccagaatataaaaagaactcttacaactcaacaacagaaagacaaccaaattttaaaatgggtaaaggacttcaatggaacttctccaaagaagatatacaaggatccaacaaactcatgaaaagatagacaacatcattagttattagggaaatgcaaatcaaaaccacaatgagatagcatttcaaacctgctaggatggctaaattaaaaaaaaaacaaaaacaaaatgtcaagcgggaaaataasaagtgttagcaagaatataaagaaattggaaccttccttgatgatgagaatgtgaaatagggcagccactgtagaaaatattttggcagttcctcagtaaggaaaacatagaattaacatagacccagcaattctactcctgggtgtggacccaaaagaattaaaagcaggcactctaacaaaaactaatatacaaatgcatatagaagtactattcataatagcaaacaggtgaaaacaattcaaatgttcatcaagtgatgaacagataaacaaaatgtggtctatccatatatggactattatttattcataaaaaatcaaagtactgatccatgctaaaacatggatgctccttgaaagcattatgctaagtgaaagcagccaggcacaaaaggccacattccacttatatgaaatacccagaatagcaaatccatagagacagaaaacagattagtggttgccagaagctggcagaaggagtgaatgtggagtggcttcttaataagtattgaatctccttttggggttatagaaatgttctggaactagatagtggtgatggctatataacattgtgaatgtactaaatggcactgaacttcacactttaaaattgttaaaatggtaaattttatgtttgcgaattttgcaatagataagtcagaagacatgtacattaccataatgagtaacaaactgacagctgatttctaaataatagcaaatatcagaaaataatgaatgatgtcttcacaatgctaaaataaacaatgtgaacccctctctcaaaaagaaaacctaatgaaaatatcttttatgcgttaaagcaaaagaggaaattaggacacagacaggcacagagggacgaccacatgaagatatagaaagaggacagacacctacaagccaacgagagaggccttacaagaaaccaacccttagccaggtgtggtagtgtgcacttgtagttcttgttacaagggtgcagtgagctagggttgtgccactgcactccagcctgggaaacagaacaagaccctgcctctaaaaaaaaaaataaagagaaggagaagaagaagaaaaggaaaagaaaaaaaaaaagaaccaagcctgctggccaggcgtggtaactcatgcctgtaatcccagcactttggaaggctgaggcaggaagatcatctgaggtcaggagttcaagaccagcctgcccaacatggtgaaacccccctctactaaaaatacaaaaattagctggacatgctggcatgcgcttgtaatcccagctactcgggaggctgaggcacaagaattgcttgagcccaggaggcagaagttgcagtgagcccagatcgcgccatcacattccagcctggactacagagggagactccatctcaaaaaacaaacagacaaaaaaaaaatacacacacacacacacacacacacacacacacacacaaaacaagcctgcctaccccttgatcttggacttgtagcctccagaactgtgagaaaataaatttctattgtttaagccaggtgtgcgtgtgaaaatttagaacatatgacaacagcaaaaaagtcagcatgtggataaatagaataaaggattctaaaatccatgtattatctaggaggtaaagatgttaatattaaaccttcataatttgattaatgttgtagtttataggatagccagtaagtaatagaaatacacacaatgtaagactcccaaaatggtagaagaaaaaatatgaaaggataaaatatactcarcaaacctaaatgaaagcaagcaaagagagataaagaaacataaaacaggtaggaaaaatagcaagataagatggtatatttaaattgaaatataacagtaatcatatgtaatatgaatggaccaaatatttcagttaaaagacaaagattgtcagattgataaaaaagcaaaagtagctgggtgtgatggctcacacctgtagtcccagctacttaggatgctgatgtgggaggatcacttgagcccaggaggttcagcctggacaagatagtgagacttgtctctttaaaaaaaaaaaaaaaaaagcaaaagtaaattgtgtgcattttatgagtcatatctaaaacattagatacagaaaagtagcaagacaaaaatgggaaaagaaattatgcaaatatctaaaagatatcgattacagctctattgatagcagaaaaatagactttaaagcaagaaagtattgctgaagattaagaatgtgatttcatggctggacgcggtggctcacacctgtaatcccagcactttgggaggccgaggcaggtggatcatgaggtcaggaaattgagaccatcctggctaacatggtgaaaccccrtctctactaaaaaaaaatacaaaaattagccgggtgtggtggcggacacctgtagtcccagttactcaggagggtgaggcaggagaatggcgtgaactcgggaggctagattttaacacatctctcgtcaattgatggaacaatgtatagaaatagaacaattaacatgattcacaagtttgatcttatagacatatttagaaaatagcaccttgaaattgcaaaattacaagggtggttccaacatggccgaataggaacagctccagtctacagctcccagcatgaatgacacagaagacaggtgatttctgcatttccaactaaggtaccaggttaatctcactgtggcttgtcggacagtgggtgcaggacagtgggtgcagcccaccgagcatgagccgaagcagggtaaggtatcacctcacccgggaagcacaaggggtcagggaattccctttcctagccaagggaagctgtgacagatggcacctggaaaattgggtcactcccatcctaatactgcgcttttccaatggtcttagcaaacggcacaccaggagattatatcctgcacctggctcagagggtcccacacccacggagcctcgctcattgctagcacagcagtctgagatcaaactgcaaggtggctgcaaggcagggagaggggcacccgccattgctgaggcttgagtaggtaaacaaagcggccaggaagctcgaacttggtggagcccaccgcagctcaaggaggcctgcctgcctctgtacgctccacctttgggggcagggcaaagacaaacaaaaagacagcagtaacctctgcagacttaaatgtccctgtctgacagctttgaagagagtagtggttctcccagcacagagtttgtgatctgagaacggacagactgcctcctcaagtgggtccctgacccccgagtagcctaactgggaggcacgccccagtaggggcagactgacacctcacacagctgggtacccctctgagaccaagcttccagaggaacgatcaggcagcaacatttgctgttcagcaatattcgctcttctgcagcctctgctgctgatacccaggcaaacagggtctggagcggacctccagcaaactccaacagacctgcagctgagggtcctgtctgttagaaggaaaactaacaaacagaaaggacatccacaccaaaaccccatctgtacatcaccatcatcaaagaccaaaggtagataaaaccacaaagatggggaaaaaacagagcagaaaagctgaaaattctaaaaatcagagtacctctcctactccaaaggaacgcagctcctcgccagcaacggaacaaagctggacagaaaatgactttgacgagttgagagaagaaggcttcagatgatcaaacttctctgagctaaaggaggaagttcgaacccatcacaaagaagctaaaaaccttgaaaaaaaaggttagatgaatggctaactagaataaccagtatagagaagtccttaaatgacctgatggagctgaaaaccatggcacgagaactatgtgacgaatgcataagctttagtagccgatgcgatcaactggaagaaagggtatcagtgattgaagatcaaatgaatgaaatgaagcgagaagagaagtttagagaaaaaagaataaaaagaaatgaacaaagcctccaagaaatatgggactatgtgaaaagaccaaatctatgtctgattagtgtacctgaaagtgacagggagaatggaaccaagttggaaaacactctgcaggatattatccaggagaacttccccaacctagcaaggcaggccaacattcaaattcaggaaatacagagaacgccacaaagatactcctcgagaagagcaactccaagacacataactgtcagattcaccaaagttgaaatgaaggaaaaaatgttaagggcagccagacagaaagttcgggttacccgcaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcttgccctacaagagctcctgaaggaagcactaaacatagaaaggaacaaccggtaccagccactgcaaaaacatcccaaattgtaaagaccatcgatgctaggaagaaactgcatcaactaatgagcaaaataaccagctaacatcataatgacaggatcaaattcacacataacaatattaaccttaaacataaatgggctaactgctccaattaaaagacacagactggcacattggataaagagtcaagacccatcagtgtgctgtattcaggagacccatctcacatgcagagactcacataggctcgaaataaagggatggaggaagatctaccaagcaaatggaaaacaaaaaaagaaaagcaggggttgcaatcctagtctctgataaaacagactttaaaccaacaaagatcaaaagagacaaggccattacataatggtaaagggatcaattcaacaagaagagctaactatccaaaatatatatgcacccaatacaggagcacccagattcataaagcaagtccttagagacctacaaagagacttagactcccacacaataataatgggagactttaacaccccactgtcaacattagacagttcaacgagacagaaagttaacaaggatatccaggaattgaactcagctctgcagcaagcggacctaatagacatctacagaactctccatcccaaatcaacagaatatacattcttctcagcaccacatccaaaactgaccacatagttggaagtaaagcactcctcagcaaatgtaaaagaacagaaattataacaaactgtctctcaggccacagtgcaatcaaactagaactcaggattaagaaactcattcaaaaccgctcaactacatggaaactgaacaacctgctcctgaatgactactgggtacatagcgaaatgaaggcagaaataaagatgttctttgaaaccaatgagaacaaagacacaatataccagaatctctgggacacatttaaagcagtgtgtagaggaaaatttatagcactaagtgcccacaggagaaagcaggaaagatcaaaaattgacaccctaacatcacaatttaaagaactagagaagcaagagcaaacacattcaaaagctggcagaaggcaagaaataactaagatcagagcagaactgaaggagatagagacacaaaaaaccctttaaaaaatcaatgaatccaggaactggttttttgaaaagatcaacaaaattgatagaacactagcaagactaataaagaagaaaagagagaagaatcaaatagacgcaataaaaaatgataaaggggatatcaccaccaatcccacagaaatacaaactaccatcagagaatactataaacacctctatgtaaataaactagaaaatctagaagaaatggataaattcctggacacatacaccctcccaagactaaaccaggaagaagttgaatccctgaatagaccaataacaggctctgaaattgaggcaataattaatagcttaccaaccaaaaaaagtccaggaccagacggattcacactcaaattctaccagaactacaaggaggagctggtaccattccttctgaaactattccaatcaatagaaaaagatggaatcctccctaactcattttatgaggccagcatcatcctgataccaaagcctggcagagaaacaacaaaaaaagagaattttagaccaatatccctgatgagcattgatgcaaaaatcctcaataaaatactggcaaaccaaatccagcagcacatcaaaaagcttatccaccatgatcaagtgggcttcatctctgggatgcaaggctggttcaacatacgaaaatcaataaacgtaatccagcatataaacagaaccaaagacaaaaaccacatgattatctcaatagatgcagaaaaggcctttgacaaaattcaacaacacttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgttcgcagacgacatgattgtatatctagaaaacaccattgtctcagcccaaaatctccttatgctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatatgaaggacctcttcaaggagaactacaaaccactgctcaatgaaataaaaggggatacaaacaaatggaagaacattccatgctcatgggtaggaagaatcaatattgtgaaaatggccatactgcccaaggtattttatagattcaatgccatccccatcatgctaccaatgactttctttacagaattctaaaaaactattttaaagttcatttggaaccaaaaaagagcccgcattgccaagtcaatcctaagccaaaagaacaaagctggaggcatcacgctacctgacttcaaactatactacacggctacagtaaccaaaacagcatggtactggtaccaaaacagagatatagaccaatggaacagaacagagccctcagaagtaataccacacatctacaaccatctgatctttgacaaacctgacaaaaacaagaaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagracttcatgtctaaaacaccaaaagcaatggcaacaaaagccaaaattgacaaatgggatctaatgaaactaaagagcttccgcacagcaaaagaaactaccatcccagtgaacaggcgagctacaaattgggagaaaatgtttgcaatctattcatctgacaaagggctaatatccagaatctacgaagaactcaaacaaacttacaagaaaaaaagaccccatcaaaaagtgggtgaaggatataaacagacacttctcaaaagaagacatttatgcagccaacagatacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacgcttttacactgttggtgggactgtaaactagttcaacaattgtggaagacagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaggatctgttcatgtcctttgtagggacatggatgaagctggaaaccatcattctcaaaaactatcacaaggacaaaaaaccaaacaccgcatgttctcactcgtaggtgggaattgaacaataagaacacttggacacaggtaggggaacatcacacaccggggcctgtcatggggtgggtggacaggggagggatagcattaggagatatacctaatgtaaatgacgagttaatgggtgcagcacaccaacatggcacatgtatacatatgtaacaaacctgcacgttgtgcacatgtaccctagaacttacagtataataaaaaaaaagaaattgcaaaattacacattctttgtaagcacacaaaggaaacatgttagaattttccattttaagctacaaataagctacaaataaagtagtctcaaatttcagataatataaaacatgttttctggtcacaatacaattaaagttgatataaataagaaagataactataaaatcttcctatgttagaatcaagaactatacttttaaacccatgtgtcaaataagaaatcataaattagaaaatattttaaactgaatgataacaaggcatgacatattaaaatgtgggaatcagctaaagcaatatttagaaagaaatgtatagcgttaaaaacatatattggaagagaagaaagcctgacaattaatgagctaaggtatgtctcaagaagctagtgaaacagcaaaataaaccaaaaggaagtagaagcaaggaaataataaagatatgaagtaaatgaagtaaaaaagaaacatacaatagagagaataaagaaaaccaaaagttggttccttgaaaattgacaaacttctggcaagagcaatcaagatgaaaagaaggcacaaataatatcagaaactttaaaaaactggacatcaataaagatcccacaaaaatttctgccaatataaaaatataaaaaatgaggatacttattaatattaaatgttctttcttgttgtatttaccagggattaatccattttacctaattttccaaacttagtgttaaaaggttattaatttaaaaaatccagatccagatggctacactaactatattctaccaatttttcaaaggagaaataatattaaccttgcaaaaattctttcagaaaatggaaaaagatggaatgttattcaattatcttatgataatagcataaccttgacaaccaaaccsaacaagaacaatattagaaaggaagataataggcccgttttattcataaacataaatcccaaacaaaatattagcaatatggatccaaattggatttatgctaggaatgcaagtttggcttatacattagaaaactgatataatttatcacagtgacagactgaaggattatacatattggctgtcctaagcagtgcaataagatgagaaaaagaaggaaaatatgtaaggattgaatatgatgaaacaaactcattgtatgtggaagatatgatggcatagatagaaaatccaaaggaatttatatataaattattagaatttttaaaatttttcaagcttgctgaaaacaaaataaataccaaaattaattgtatttctgtatacctgaaacagttggaaaaatagttttaaatagcatttaaaaattccaagcaggagttgcacattcctgtcagataatggcagctgcctaaatctctccacagtcttcaaaaaccatacatacacatacacacacaattttaaattatgactaaaaccacccataacccatctatagaataaccagaagacaaaaagtactataagtttatatttacaagtagaaaataaatatataaatctagccaaccttgctccagagagaaaccctgtctcaaaaaaaaaaaaaaaaaaaaaaagaagaaagcaaatgttggaaattaactgtcctataaaaacaaaagtgaattactaaatcacaagacccacaaacctctttggtcacatctattaaataaattacacttccatttatcaacagtagagggtactcctggctaagaaacctagtaagccacccagccctcatgtctgcctgcataaatcacctcttattgctgaaacaagaaaatgtaaggaatttctaaatgaacagaaaatagcatatgaagcagatggtattaatgttcttgagtttttattccctctttccttgaaaacctcatcaactttaggcatggccgtacggctcatcttgatcaatagaatgtgattggacatgacatatataccacttccaaatagaagctttaaatgtgattttgtgtttgacacactcttttgtgcctctgctccaggctccagactttaagcctctagaacgataagtgaataaatttcttttgttttaaaggcaccaagtgtgtggtgaatttgttacagtagccctagaaatctaatactaacaaaaagaaygttagagttgaattagaagtgtcagtgagaacttaggaatttaaaaaatcatattcttagcactgttcactgagggaatctagaagtaattacactgcagtaataacgagcccatcccatgcccaaatcttggtctctaactaccattttccagtcaaaagaatctgagctccctagagaaatgactttttcaaggctggatcaaggaaactgccaggcaatcttagatgatcttggtgatcttgatgtgccagaagattaatgggatcatgtgaaaagaacacagaaactggyctgaagggcttcctgttggccagatttgagacaatttgagcatcaaaaggaataatgagggtaatggatcataactggaaaatcagtttgcaaccatcaatgtacttactattgaatacttgtaaagaactttaagggttgctaataccattggataaaagcttgttgtgaaacagaatatttgcatggtctcaaagtctcactccacagattgttaggaaagggaaagggttacctttataaatatagagattaggtggacatcttaaccaagtgatcaaacttagcatcatcaataatgggacaatctggcatcgcatgccccctgatttaatgcagtaaggattaagtctaacaaaagatgtacaaagcctccaaatacagcgtaaacatttgtaaaataatctcagaacagggaccttaatgtttctcaaaaatttttccaaatacagaactttatttctatagatgtttatggtatatttgccatgctatatacattatgctatatattctatgtgctgaagatacaacaatgaccaaggtctttgcccttgtggaactgacatttggtggcggagacagaggaaacagtcaataagcatgtaaagagataaaggaaaagatactgaatgctacaaaggaaacaaataagttgagatttagaacaaaaaagagtcctattttacaagaggaataatgaggaagacctttctaaagaggtagctcagcactttgggaggccgaggcgggtggatcacgaggtcaggagatcaagaccatcctggctaacacagtgaaaccccatctctactaaaaatacaaaaaatgagccgggcatggtggcgggcacctgtagtcccagctacttgggaggctgaggcaggagaatggcgtgaacccgggaggcggagcttacagtgagccgagatggtgccactgcactccagcctgggcgacagagcgagactccgtctcaaaaaaaaaaaaaaaaattgaggcagaatttcgctatgttgcctaggcttgtctcaaactcctgggctcaagcaatcctcctgcctcagcctgctgagtagctgggactccaggggcatgccactatgcttagtttaagaggtggtatttaaactgagacccgaagggtaaaaaacatggataaaagaagaaacagaaggggtaagagccttccaagcagagggaatcacatatacaaaggctctcatgttaaataaaacaagagttgacattgttgagaaactgaaagatcagctcatctgcgatgcggtaaaataggaggaatgcagtgggagaacagatcagagacttgggcaggggctatattaggcagaacttggagaccagagtaagggggccaaggtgggaacagaccgattaaattggcatctcttgggggggtgggggggtggggaagctaacccatgcatcattttttaaaagctccaaaggcgattccaataagcagccagggttgggaacctagggggaaaatgtagctagatgaatgaagatggcccaaacgtcttttgttctgatagctaaactctctgtaggatcacagtgttacttcacagtgcatttgccaggaaaagtctcttcccatttggaatccgaagtaaaactgacaccacacttgaagatgccaggattgttagaggaaaatgtcacccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttcagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccayygttactgactbrctascttbnaattcacccccmgagtygggtgcaccagattgccctgasgatggaggttctgdgctrcgaggcacaggacctctactgagggtggccactgcagcacctgccactgcygtcacctctccctcctcagctccagggcagtgtccctccctggcttgcyttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttyttgccctccacccccataagattgtgaagggtttactgctccttccatctgcctgaccccttcactatgactacacagaatctcctgatagtaaagggggctggagrcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgmaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttrataatcttattttggcattcttttcccattgactatatacatctctatttctcaaatgttcatggaactagctcttttattttcctgctggtttcttcagtaatgagttaaataaaacattgacacatacaaacaaatgcctttgagaattgtgtttttacactggaaataaaaatgtgaacactgatttttaaaacaaataggggcactgaatagcaagatggacactctagaaaaccaaattagtgagttagaaaaccagattaaattgaactcagagtaaaaatgatataattcatgagagtctgaataaaataaatcagaaatggagcctcaatccaggagaacagcttatatggagagagagagactgagagagaaatgggagtttctgttcaatgggcataaagtttcagctatgctgctgggcacagtggctcatgcctgtaatcctggcactttgggaggccaaggcgggcggatcacctgaggtcgggagttcaagaccagcctagccaacatggcgaaatcccgtcgctaataaaaatataaaaattagttgggcatggtggcacatgcctgtagtcccagctacttgggaggttgaggcacaagaatcgcttgaacccgggaggcgggtggaggttgcagtgagccaagatcgtgccgttgcattccatcagcctgggcaacagagtgagactccatctcaaaaaaaaaaaagtttcagttatgcaagatgaattaagttctacagatctaatgtacaacattgtgcatatagctaacgataccatactgggcacttaaaaatttgttaagagagcagataccacgttgtgttcttactacagttttacaacaatgcaaaaatgcattgtaaacactatgtgcaaatagaatagcaaagaatgtatacagtgcccatgagcataacattctagtggacccacaatgcatcagagttcagtgagactcaaagggagaagaatgttggcaaagtcagtggggaggagaaaatgagtgtgatgaaataggcggtctcattaaacttcccttacaaaacacaagatcaaagataaaattattaagaatttcgagacagtgacatcagagcaaacgaaacatagggcccctcagggtgtggggccctgtagacctgcatagatcaaactcccatgaagccaatcctgagtcccaggcaagctgggacttttggtcatcctagcaatagtcatgtgagtgcaccatcttggaagtagatcctccagtacagtcaagctttcagatgactgcagtcccagcagatacatgactccaatctcatcatccactccaaaactaacctacagaaactataaggtaataaatgttttcttcacagttgctaagttggaggtcatttttcattcagctaaagttaacttatatgacagccatattctttttacaatggaaaagtcagacaggcatacaatgctcattttcagcttattcacattgtcactattttgtggggttacctggtgggcacaggacagtgaccaagtttgcaggtcctccagctcctgctggatcttttagcttctccaaatcctagaaaagttgtgtgtttagctctttcagaaaacacctgaccttctcatgcatgttactccaccatcgaagttagaagcttggagataacatgagactgatgcaggttttagtccatttcatgggctcttctcttttcaggcttccagtgtatacttgctttctccacttcacctcacctttccttccacagaaaggtcagggtatggagctcatatgagggtttagaggaatttggctcaagggccagggccagcttcctccagtgtttcgggtcacaacctagatacacctttatcagcgcctgggaatgttcaaggtcctaattttcattcaggcctgttggctgggtcacagaatgatcaagccactccatgattttctagcatgacacagcaagaaactgggggagactggaggactctacaaaaactttcattttatgtatttcctggtagctctgttttctgatagaacctaactgagataccatttttgccagttcttctatggataagtattatttttttaatttttttaatattttattttttgtagagacagtatcctgctatgttgcctcgacttgatttgcattttttttttttactttaagttctgggatacatgtgcagaacatgcatgtttgttacgtaggtatacatgtgccacggtggttgggtgcacccatcaacccatcatctaggttttaagcccctcatgtcccccaggctggagtgcagtggcatgatcatagctcactgcagcctcaatctcccaggctcaagccaggctactgcctcagcctcccgagtagctgggactacaggcatgcaccaccacacccagctaatttttaaattttttgtagagacaggatctcgctatgttgctcaggctggtctcgaactcctgggctcaagctatcctcctgtctcagcctcccaaagtgctgggatgacaggcgtctgccactgtgcctagccagtactatttctttttaattagtttgtaagagttctttgtacgttaacaatcttaattgaatgtctgtcgtatatgctgtgaaattacttaatttgtcattaaccttttatcttttttaaacaatgttttgctatatgaaagctttacatttttatgttataaatttatcagcattttcatttatggctttgggttttatgacatgcttagagtagctttttctgcaccaagattataaaaatatccacacatagaattttctatcataaaagtatgacagaaaatgtcatattttgtatataattttattttttgtttagtcctggatccatctagaatttctattttgcatagcatggcaaagggctcacacccaacatcatattaaataaggtctttttccctgatatgaaatgccacatatatatgttattataatgcatagttagataccatgtggtgaataaaatatcttagaattattcaagcctaagaggatagaactactgcaaggatgggttttggtatcaacacagatgtttatacatagagagaaaatgatgtctgtgtgcttagctgtcaaataaggagactgggggagggttaaatgtaatcagtgatatcataaggagtggtggaattctgtttggaacttcagagacctaaggagaagactgaccagcttcttctgaagacttctgccctctaaagactaaggcctaattccactggtttctttgaattccgtggtcctaagtccattttcaggtaagtggtttcccgctggatgtgggtctctttaagccgtatcaaacagtaggtgagtgtatcagttataaatgtcttaagtaataggaggcccaaattataatggctcaaataaaagtatatttttctcataccatgcagtccagaagtaagcagatacaggtgttagtttagtggcttgaaattatcagagcaacttcaggcaacatttcttaagcaatattcaaggcagcataaagggaaaatggtagcaccatctcttttatcaagacagcaaaaagccttcccaaaagctatccatcagatttcccttatgtttcattatccagagctatgtcacatagccatgcctaacttcaaggatggctaagaaagggaggattcagctttttcagcttatctagttggatgtagtaaatgaaaaatgggtgggaacaatatctgccaaaagtcgccattcattcaaaaaatatttattgagcacctggataccctatgtgctaggtactgtttagcagtgaacaaaacagacaaaaatccctgcactcatagagcttacattatattcaggagatacatataataaagtaaagtaaaatatattctactaggttctgatgaggttctggagaaaaatcaagcaggtaagacaattaggaagtttgtaggagggtggtacaattttaacaatgggatctaaggaaaatcctcattgagaaggtgatatttgagtacctgacagaggtgaggaaataaattctgagaatacctgggggaaaagcattccctggaaagggaaaagcaagttaaaaagccccaaggtaggaacatgcctagcttgttcaaaatgaaatgaggctaagttggagtgatgatcaagaggagactcataggatatgtggtcagcagtaactaggacataatctgacctacaacctaccaagatctctttggccactcactggagaagaggcttaagggaggcaaggacggaagcagaaagacagagatgatggtgggtagcagtggaggtggtgtgaagtggcaggattctggatacgttttgtaagtaaaggtgactagacttttctgatggataaagtgtatgagagaaaaagaagagtcattactatatatgtaaatctaagcaaacatttactttttaaagcaatttaaagtttgttacttgaatatataaaatatatcatggagttaaaaatatatagaaatttattatatttggtatctaaagtagtcaaattcatagaaacaaaaatgaggagctgtttagagtttcagttttccaagttgaaaaagttctagagatctgttgcacaacaatgtgaatgtacctttttcagcctgaacaggtgaaagagtttctactaattgagttggggaagattgaaaaggtatcaggtgtaggaaggaatgtccggtatctgacctgatagagcatagtcaggttttgttttgttttcttggaggggatatattttgctttggaaactgaccattttcaggagtcacctgtgtaagtcagtcaattgtccttatgttcgtgatggtgagaagatttttggaatatgagctaaaccatcattgtctaacttttcagacaaagtttctgtggaaagacctacggacaaagacatctctccttggcagagtgagctaggattaccagctcttcagccgcagctgaaggcgggagtccatggaaccccagaagctgctgataattggatttctgctatgctctctaacttgcctcttgttggagacagtagcttcctctcctttgcctttgtctgccttgggaatacaagaaaaaacaggatcgaaaccacgctcagggggtgtgtttgctgttaggatgaatgtttctttcttcataggacttaagattcatgtttcagttcaggtcaggtaaaatgaatttcatgtttaaaaagaatgttcataggaaagcaaactattctggtttggttcaatttagttcaacaagcattaacctacctactacgtaccaagcccttttctgaactacatggattaggaattgaacagcctctgttatgaaggagctcacagataggcagacaaagccatagatgccaaccttccatggagtatgatcaatgctcccaggggacaaggggataatttaaattgttttgggggaggggtcaggaaagacttgacaaaggaggtgaaattgaaaataaacctgatggtccactgatccacaatctaggttccaacatgcacacacatgctattcaagtgtcttgctggttagtggtgaatcctctcaactccatgctgcagacactttcgttttcccctccttctttcttcagggtcaaagcactgtaccttcctcccccagttgctaatgaaaagacccaacatccccagccttacattgatcagcaaactccccctagaggtccttcttccagtggccctggcccctttctcctctgctcttagggctggtggccttctcctttctcttcctgggatactccctctcctcagcctcctgcaggactcccagatatactctaggcaacaacaccttagtaaagactttcttgttatcaagtcatgcttctctttcaaaaagtacccaatatactcaagatatccgaaacaacaattattgttcctatttgacttacaaggaggcaaaaattatatccatctcaggatactttaaaaacaaaatgtttgccctttgaacatcttacagccagcacagcaaagtagtttagaatatgggct

SEQ ID NO: 17618 - DNA, 93112 bp, Homo sapiens
  misc_feature (1)...(93112): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattagtgatcgagagccatttttgctggtggcaatcatatggtacttttaatgggaatattagaaaggcaccggtaatgaccttgttgcagcacaaaggagagagtgtggggtgcccctgcatgttgtcccacctcttgtgacgtgtatcgttttggaatttccagtggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaaggtaaggagtctgtggccagacatctacacgcttcsatgctgggatgaaaagccatggaaattcccactgatgcagccgccttcaatggtaaacggatgctcgagtgttgcctgagttctaccatgttgggggaagcctccgtgtactctctgggggagccagcggagtgatttctggtgcaacgtggttgggctttgtctttagaatgggcacaaaccctccagggtgatcgacttcacaattcaccttgttctaaaatgggctacctcagtgtcccagccaaaatttttattgtaacgtgctgtcaggtgtgtgactctttcagtccagtaagcttttccggggatttcttcaagtagccagcattcagtgcaatcttcagcattgcagattcagagaaatgtggctctggagcctgtcatcctcgagaaacctaacagggctgcattaattccatatggtcctgggtctatggagcagtacatgagctcccaatgctctaaggctcttcagtcctaggctttgaagggagtgatttctcagtgttcttaaacctctttctgatggcacttgtacctgtgaggggtctagagagaaaggttagtagacttctcctttactgcaattcaggatgcagggcatgagaggattccctccctcstccaagggaagaaggttttggcgtgcacacatccttgagaagcaaagtgtctttgccttcagtcagatatataggatcgttttctgccccatggcctggaagccagaggcyttggctttcatgatcaacgatctagggaaacatgcaaaatttccrtgtctttcccctcctctgcccccgacagccaattaccacctgcatcctgcattgccaaatgcagtgccctttgtatgaacattcagtakagtttcatagaaaggtgctacttcgtgagcgcactttgcagtgagaagatctgttctgttctgtttttctaaggatttcaggtgaaatatttcctagaacttactacagttctagattggtaggaatctgtrggtttgctgtatgttttttggttggttttctcccatccatctgcctacaggtaagggaaagataacgttcrtaattctcatagactcctttctggttgtgtcataratgkcttcacatatttcgttattctcagagatactcagtttatttcttgtgttttcatttcagcaccgactgagcagaggcctggggtgcaggagtgctaccacggtaatggacagagttatcgaggcacatactccaccactgtcacyggaagaacctgccaagcttggtcatctatgacaccacactcgcatagtcggaccccagaatactacccaaatgcgtatgtctttgttctttaccataagagaataaagggccaactgaagtttctgtgacaagagacatgcttcaagctgagttctccgaactcaacttgtgtcagattcagatggygtagcaaaatgtctcaggatgatttccttggagctaagggtctgagagaagagaaatgttaagctgcctcaccttcctcctagttttgtggagcagaagggaaatgaggaggcgaggagatcaccttatgaagaaagtcagaatgacgaacsaccaaacacttagattacccttgcccaacacccactaagcgtcaatgaagactttccagttggaattccgttattctgacttccaattcctgaagggaagattgtgtttgccttttctgtctgggctcatgaggaaagtttatgtgcttacttatggacaggtgaattgatctgtttctatttctacctgtattccaatagggagaaaatctcttggtcctaagtaccagtggcctgaarggatagaggttcccagcaagagaagatccaaggaaggaaggcagatgagagtcagcacagagagkgatgctgaaaagtaaaagggatgggtagatggatagaagccctggyctgaccaccccatggccaatcatttggccataatcaacaaccaaagacatggaaaaatggtttctacatgtgggacaacagatsgtagaggacctagagaattgagagagggccaatgatgagctcaactccatagatgccttggctttcttcctggatacccttcctgcactgartagcaaggagatggagctcaagcagcctgtagccatctagctgagcagaggagagggattggagtttgggatgactctggtatwttctaggtccgctacaaataagaactggtttgtggaggaaaggagctctacaaatacgcatagaagtctcctccagtagytggcctcacatgacactgcatgtgcacagaaaatggttctacagaaagtgtggcaaagaacatttactgagaaacagcaactacaagagaacagcaagctcaattaagaagatagagatcacatagcactctgtgttattggagttcttaccagctagatgagagagtgctcacggaacacattgccaattcagtggagaccccagaacagccataatttcaaagtacaattagtatattactagaataaaggcagctgcagacaaccccttgcacagctgaaaagcaagtgtccaagcatcaaatgggtttccaatcaatgaagtgcctgtgagaggaaatctcaactctcttcagaagtaaacaacaaagtcaattgcctcarctatgcggtatccccagagtgagtcctaaattaaaaatttgactacgtgtagaaaagaatttcgtgtgatccatgaccagraaataaatcaggcaatacaaacaggctcagaaatgacatcgataattagaattgcatgaaaatttgacatatcagtatgataactgatttcagatatttaaaaaaagtgcaacaaagcaggtatcatatcaagacaaattaatagtatagaatagccaaatcaaattaaagaactattatacaaaaagtatgtcttaaatgaagaaattactgtatgtccgcctgaaaaatttagatgtttcagaagaaaaaattaaccaaaaacaattctgcagaacctacagaatgagccacacacacacacattcaaaacacacccatacacacacacatgcaaaaactcacaagttctaacacacacacaaacacacacacacatgcacatccctaaagaaatagggaaatataaaattaaccgaccctcagagacatgcaggaaaatataagaagatttcctgcatgtgggaagcaagtcacagtaaagagcaagggagtttggagtagatacaaataccggaatcacggatggctgataacttttcaattatgaagaacgttagaaaaatcacagattcatgaaactaaagggatcaaataggaaatttcgagaaaaaaaactacatgatgcacttctctacatcacagttcaaaggtaacaaggcaaggatataagaagaagaaacatctcacgagaaactggagaaaaaagagctgtgtcttcctagagtacagtgatacaaattgctaatgcgttcacctcagaaacactggaagccagataccagggaatattattaaaatgataatgaggaacaagaagagatcaaccgagaatgctgaatccagcaataaaatgccttgaagatcatccatgttggataaatgcatattgtgcactgcccaaaacaaagaaactggaaagtgtaagactttggaatcagcaggcttatgtagcaacagaggtgacccgaaagaattaggtataagaagaatagaagaattgcatgaaaatttgacatatgactaagataactatttcaaatatttaaaaaaagatgaatatgtaataaaacagataaaatatcaaaagaaagtaacagtattgactagccaaatcaaattaaagacttagtgtaaaaagctatgtcttaaaagaaaaaattactggatggctgcctgatcaatttagacatttctgaataggaaactaaccaaaaatcaattctacagaaccaactacacacatatatacacatacaacacacccatacacacccacgcaaaaactcacaagttcacacacacacacacacacacacacacaaccctcaagaaatagtgaaatagaaaaccaaccgaacctcacagacatgttgcaaaataggaaaagatttcctgcatatgggaagcaagtcacagaaaagagaacgggagattggaaacagaarcaaataccggaatcaaggatggccgaaaacttttcattgatcaagaatattaacaaaatcgcaaaaacacgaaattcaatgcatcaaataggcgtttcgaaaaaaagaaaaaatctggtatgatgcacttttgtacttcacattttcacggtaagaagacaaagatataataacaagaaacttcttatgagaaactggggaaaaacaagctgtttcttgctagaagaacagtgatacaaattgctaatgcattctcgtcaaaaacactggaagccagataccgggaatgttattaatgtggtaaacaggaacaagaagagatcaaccaagaatgctaaatccagcaataaaatgccttgaagatcatccatgctgcataaatgtatgttgtgcactgccccaaacaaagaaaccggaaactgtaagaatttggaatcagcaggctgatgtaacaagagaggtgacccaaaggaattaggtagaagaagaatagtacaagaagggaactttctgcagcccatgtaatgaagaacccagcaattggcaaatgtagatgtaaatgcaaaagtattttcttgaccaaatttctatatatttttaaatgagcgttgactactggaaacaaaatgagagcaagagatttaattttagcctcggtagaggtaagaatttgaacaagtagcgtaaatcatgtagggaataattagaagtgtaccattgtaagtttcttacctcatgcacaatggtatgtaatattaataaaatgttactgtgtgggttcaaggagatattgcaaatcctagagcaatcacaaagttttgaactctgaggtatattgtataataagaatattccatgtattcaaaagagagaagccaaggaagaaagaaatttgtcacgagtttgggctcttagtacatcctgtagctcattgaaccagcttcctggaatggagggtctgggattgacactaggccacatgtatagagtctctagagagacagtgtttcatccccatggcccgtaatacatttcccattttctcaggcagccacaggtcatgaatgtgaggatagagagaggttggagcaacgttcttgggaggcataaggaagagcaaatgcttcaagatccccgcagcccaaactcctacctgctttgccccctaatgcagtgttcctccgtagctgtccgacctcttcagatctcttagtctaccctgccatcttcctttatgccatgggtcccactgttctttcaactcatcccccttwccctcagtgcagagtagctgcggccagcagagggtagactgagagcaggagagaaggtcctgcccaggaacccattctagagatgctgcattctgcctgggagcaagttttccagggcagctttgagaagtcttgcagaaacaaacctatttgacccacatgatatgggaatgacagaaagtaatacaatttgcacagtgcttttccatgggaaaagtagagccttttcgcgaggttttgagtacatagagagtgaaggttgacctggaaaggttatcctcctggatcccatgttttttctgaagaactacctgttagttgcaacttgcacattagaatatgaagtcctaccgagagagatacggagaactagataaatacagatacttttgtatgtgaataaacgattccacaatacacacatcaaaatccataccagttattccagagagatggattgggcagaaggcagaaggagaatactctgatcgttttttgcccacgtgtatgtattatctcagtgtttctaagaagcgtttgctactttagatttttttttataataataatcttttaagtatgagaaatgtgcagacaggattagtgattgagagccatttgtgcttstggcaatcatatggtacttttatgggaatattagaaaggcactggtaatgaccttgttgcagcacaaaggagagggtgtggggtgcccctgcatattgtcccacctcttgtgacgtgtatcgttttggaatttccagtggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaaggtaaggagcctgtggccagaaacctacacgtttcgatgctgggatgaaaagccatggaaattcccactgatgcagcagcctccaatggtaaacggatgctcgagtgttgactgagttctgtcatgtaggaggaagcctccgtgcactctctgggggagccagcggattgatttctggtgcaacgttgggtgggctgtgtctttagaattggcacaaaccctccagggtgatcgacttcacaactcacctcgttgaaaaatgggctatctcagtgtcttagccaaaatttttattgtaacatgctgtcagatgtgtgactctttccaagccagtaagcttttcctgggacttcttcaattagccagcattcagtgcaatcttcagcattgcagattcagagaaatgtggctctggagcctgtcacccttgagaaacagggctaacagggttgcattaattccaaatcaccctggttctatggagcagtacatgaactcccaatgatctatgtttcaggacttcctcagtcataggtgggctctgcagccctaggtttttaagtgagtgactgccccgtgttctggtggcagttgtacctgtgagcggtctggatagaaagagtcggagacttctgtattattgcaactcaggatgtgggtcatgagaggatttcatctctcctgcaggggagtaagctgttcgcctccacccatccctgataactgaagtgtctttgtctgcagtyctagacgaaggactgttgtctctcccatggcccagaagctgaagaccttgccttttgttatgaaacgttcattgttttcatgtctgtccgtttctctgcccctaacacccaatcaccatgtatggcctgtacccccaaatgcatcgtgctttgctgtttgctgccccatagtcctcatgaacattcagtagaaattcccataaatgtgcttgcacgtgagcacagtttccattgagaagccctctcatytgtcctttttttctaagcttttatgtgaaatatttctaagaacttactacagttctaaartgttaggaatttgtttctttggtgtttttgtttgttggttggttgttgcttttctcaagtccatctgcctacaaataaagaaacaagaatgttacttgtcatattctcctgaggtcataattctcagagacttttttctggtttgtgccataagtggcttcacatgtttgtctcttcttggaaacactcagtttgatttcttttcttttcatttcagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgcgtatgtctattttctttaccataagtgaaggaagggtcagtggaaatttctgttagtagagtcatgcttcaagctgagtgttcaggactcaagttgtctcagatgaacagtgcatagcaaaatgtctcaggaacattgtctttgagcaaagagtctaagagaagacaaatgttaatctggctctccttcctcctagtttaatggagcagaaaggtatctggaggcaaggatatcacattaagaaacaagtcaagatgacaaatgatgaaactcttagagtacccttccacaacacccactaaggttcaatgcagccttttctccttggaattctattaaactaaactccaattcctgaagtgaaggttctgttggggttttctgttttggcttacaaggaaagtatatatgtatatctatggagaggcaaatctatctctttctatatctacgtctattccaatatgtagaaacacagtcggttctgaccaccagtggtctgaagggatactggttgttagagaataaaartggcaggaaggcagatgagagtcagcaaagagagagatcctgtaaagtaaaagggtggatagatggacagaagcccaggtctgaccagcccatggccaggctttcggccataagtgacaccaaagacatggaaaaatggtttctacatgttggacaacagacagtagtggaccaaaagaatagtgacagggggaacaatgagatcaactccatagataccttggctttcttcctggaggcccttcttgcactgaagagyaaggtgatggagcccagatggactgtagccatcttcctgaatgcaggagagagattggaatttgggactactgtggtagctaggattttataggcctgctgagaatgagaatggatttgtggatgaaaggagctccaggggcacgcatagtagtctcctcgaatctttggctaaacatgacgttgcatgtgcccagaaaaaggttccacaagaaagtagagaaaagaatatatcctgaggaatagcaactgcgattgaacagtgagctcaataaagaggacagagccctcatagcattctgggatactggagttctgaccagctggaggagagacctcactgaacctcttgggaatacagtagagactccagaaaagtcatactttaggagtagaattagtaaatttctagaaaaaaaggcagctctagacaaaccctggcaaaactgaaaagcaagtctccaagcattaaaatcatttccaagtcaattaactgcctgggagaggaaaaccctctttagaggtaaacaacaaagtcaagtggctcagctatgtggtgttcacagtgtgagttctaaatttaaaacttgactacacatagagaagcttttagtatgaaccatgaccaggtgaaaaatcagtcaatacaaatagacctagaaatgacagaaatgattagaatggcaaaaaatttgacatatcaatatgtcaactgagttttaggttttaagaaaacatgaatacggaatgaagcagataccatatcaagagacagtaacagtatagaagagccaaattaaattaaagaactagtataagaaggtatgtcttaaatgaaaaaattactggatgtattcccaatggagtgagatgtttcagaagtaaaaactaactgaaaaacaattttataccacctacagaaccagctacacatacacaaatgacacacacatatacacacatactcacacatgcacaggcttagaaacatgcacgcacacacacacacacacacacacacacctccacaaatactaaaaaatgaaatccactgatcctcacagacaggcgggaaaatataaaaagatttcctgcatgtgggtaggaagtcacagaasgagaggaaggagagattgctacaggaacaaatactggaagcaaggatagctaaaaacttttcaaataagaagaatattaaaaaccacagattcaagaagctgaatgaatcagacagggaatttccaaaaaaaaaaaaaaaaaactgtatgattcacttttgtacatcaccgttcaacagtcagaaggcaaagatataataacaagaaacatctcatgagaaactggaggaaaaagagctgtgtcttgctagaagaacagtgatacaaattgctaatgcattctcatcagaaacactggaacccagttaacaggggatatcattaaaatgataaactagaaaaaaaagagatcaaatgagaatgctacatccagcaataaaatgccttgaagatcatccatgttggataaatgcatattgtgcactgccccaaataaataaaccaaaaactaataatttggaatcagcaggcttgtgtaacaagagatgttgcccaaagaaaattagctagaagaagaatagttcaagaggagaactttctgcagcccacrtaatgaagaacccagcaaatggcaaatgtagatgtaaatgcaaaatattttcttgatcaaatttctatatctttttaaatgagagttgactacttgaagcaaaatgatagcaatatatttaactttagmatatgtagaggtaaaaatttgaacatatagmctaaatcatgtggggaataattggaagtgtaccattgtaagtttcttaccttatccaygatggtatgtaatattaatgaaaggttgaatttgtgggtccaaagggatattgtaaatcctaaagcaatcataaaattttgaattctgagggatattatataataagaattttccatgtatccaaaagagggaagccaaggaagaaaaagaagtctttcaagtactcaagctctgagcacatccagttgctcattgaaccagcttcctggaatggagggtctgggcttgagactaggtcacatgtgtagagtctctagagagacagtgttggatccccatggcccataatacatttcccgttttcccaggcagccacaggtcacgaatgggaggattctgagaggttggagcaatgttcttaggaggcataaggaggagtgaatgctctgagatttccccagcctgaggtcctccatagctgcccgacctcttcagacctcatagtctgcccagctgtctccctttatgccatgagtgccactgttctttcaactcatcccccattccctcagtcccggaattgctgtggccagcagaggatggactgagagcaggagaggaagtcctgaccaggaacccatcctagagatactgcatcctgcctgaaagctaggtttccagggcagctttgagaagtcttgcagaaagaaacccacttgacccacctgatacggtatcgacagacaggaatactttttgtgcaatggttttacatgctgaacatagagccttttggctacattttgagtacattgaatgagactgctggcctgggaaggatatcatgctggatgccatttttttctctggagaactatgtgttagttccaactcgcacattactatatgaagtcctacacagagagatacggagagctagacagatagagatacttttgtatgtgcataaccaattccacaatacacacgtcaaaatccataccagttattccagagagatggattgggcagaaggcrgaaggaggatattctgatccctttttggccacatgtatgtataatctcagtgtttctaggaagtgtgtgctgcattagattttttttctttaaaaaaagtgataatatattaagtatgagaaatgtgcagagaggattagagattgagagccatttgtcattgtggcaattgtatggtatctcttttgggaatatttcaaaggcaccagtaatgaccttgttgtagcaaaatatacagtgttcctgcatatgtacccattttttgtgatgtgtattcttttggaatttccagtggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaaggtaagaagttgtgccagacatttacctgcttggatgctgggatgaaaagccatggatacccccactgacgcacaasccttcagtgctacactggttctcgtgtgttggttctgggtctgccatgtgggaggaagccttagcgcactctctgggggagccagaggtgtgatttttggtgcaacctgtgcgagctgtgtctttaggatgggcggaaaccattctgggtgctcgacttcaccactcccctcattgtaaaaggggctatctcattgtcctagacaaaattcttattgtaatatgctgtcagatgtgtgtgtctttccaagccagtaaacttttccagggatttcttcaagtagacagcattcagtgcaatcttcagcattgcagattccgagaaatgtggctctagatcctgttatccttgagaaacctaactgggttgcattaattccatatctccctgggtctgtggagtagtacatgagctcccgaagctctatctctcaggtctttttcagtccgaggcaggttgtgcagttcttagctttgaagggagtgattttttcgtgtgcttttgcctctttctgatggaacttgtacctgcggggggtctggagaaaaagagtagtagacttttgctttattgcaatgcattatgctgggcacgagaggattccctatcttattgtaggtgataagcttttggcctccactcatccctgagaagtgaagtgttgttgcctacagttttagctgcaggactgttgtctgccccatcaccaggagtttaatgctttcttttttgagcaatcatctagggacacatgcaaggtttttatatgtccttgcctcctccccaaaaaaccattttaatgcttggagacttgcttttcagctttgccaaatgcatcaccctttcttctatgctgttccatgtcgtcatgaacactctgtagagattcctagaaatgagcttccatgttagtggagtttccgatgagaagcaatctgatatttcttttccactaagttktacatgaaatatttctaagaacttactacagttctagaatggtaggcatctcttactttcgtgtttgtttgtgtgttttctcatgtccatttgcctattaataaagaatagagaatggttgtaaatctcagtgactcttttttggtttatgtcataaatggcttcctgtatttttctgttctaggaaataataagcttgatgtcttctgttttaatttcagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgcgtacgtctttgttctttaccataagcraaggaagggccaatggaagtttctgttagaagagtcatgcttcaaggtgactgctcaggactcaacttggctcagatgcagaggaacatttcctgtgagcaaaagttcttagagaagactttgtttttttgagacagagtcttgctttgttgcccaggctggagtgcagtggcatgatctcggctcactgcaagctccgcctcccgggttcacaccattctcctgcttcagcctctctagcagctgggactacaggcacccaccaccacacccggctaattttttgtatttttagtagagacagggtttcactgttctagccaggatggtcttggtctcctgacctcgtgatccgcctgcctcagcctcccaaagtgctgggattacaggcgtgagccaccgtgcctggctgagaagacattttttaagctggctctccttcctcctagttttatggaagcagaaggatatatggagttgagaagatcttattaataaaacagccgggatgacaaatgaccaaagagttagagtatccttctacaacatcggctgagggttaatacaaccttttcaccttggaattctatcattctaagctctagtccctgaagtgaatgttgtgttggccttttgcaycttgggtcacagggaattgatacttgcacatctatggagaggcaaatctttttctatctacttctttttcaatgggtacaaacacacttggtcctgagcaccagtggtctgaagagatacggtctgcccagaggagaagaacaaaggcaggaaagcagatgagagtcagcaaaggggcgatgctgaaaagtaaaaggggcgggtagatggacagaagccatgatctggccattctatggccagtctttcggccataagtgactaccaaagacacggcaaaacggtttccacatgttgaacaacagatgctagaggaccaagagtattgcaagagggagaaaatgagatcaacccatcaatgccttggctttcttcaaggagacccttcctgcactgaagagcaaggagatggagcccaagctgactgtagccatgttgctgaacagaggagagtgattggactttgggattactcaggtagttaggattttctagccatgctaagagtaagaatggacttgtggaggataggagctccaggcatagaagtctcctcaagtgttagtctaaacataaagcagcacttgcatagaagattttccacaagaaaatatggcaaaaaaacaccatatattgaggaacaacaactacaagggaacagtgagcttaataaaggtgacagagctcacatagtgctctggaatattggagttttgaccagctagagagaagagacctcattgaaaatcttgggcattcagtagagacctcagaaaagtcagactttatgagtagactttgtatattcctagaataaaggcagctccagaaaaaacctagcaaagctgaaaagcaaatctccaagcattaaaatggtgtcctagtcaattaactgccttctagaagaaaactcaacactctttacaggtgaacaacaaagttaagttgctgagctatgcaatatccacagtgtgagtcctaaatttataactttactacacataaaaaagcatttagtgtgaaccataaccaggaaaataatcagtcaataaaaatagaaccaggaatgatagaaatgatttaaatggcatgagaatttgacatattagtatcataactgcattgctggatttaagaaaacataaacatggaacgtaacagatatcatatcaagggaaagtaaaaggataaaagagtcaaatcaaattaaaggactattaaaaggtatatcttaaatgaaaaattcactggatggtctcccaatcaggttagttgtttccagggaaaaaattaactgaaaaataattcaatagaatctacagaaatagctgcacatatatacacacaatggcacacgtgcacacacccacacccacacaggtgtgaatcctagagccacacsagcattgaaacatagagaagtaaaaattgttcattgaggaatatgtagcaatgctcaatgtgttttaccctaataagagcttttgtgatgtatgattgaaaaactgacacaactgaagagagaaatagataagcccacactctgagttagagatttccttgattctctcactatggttataaatctttcccaaacacaacaggctagaacaaatatgcagaaaattagacatagtatctttgttctcaataaaaacgtcgacctatttaacattataccgaactaccgaatacacattaaagtgtgcatggagcattcactgaggtgtactctacacatgaccttccagcaagtctccatagatttaaaagaattaaagtcatacagagtgtgtcactttattctcccagaataaagtgagatatgaataatgagaagtttgccagcttctcaaatatttgggagtcatayggtgcatttcaaaatactctttgggacaaagaaaacatcactaaggaatttagaaaagttttgaactgagtaagaatataacacaatttatccaaacttaggagatgcagtgaatgtctttaggcttttacataattttagatgctcttagggaaaaacagaagcatgtaataatcaagatttcaaactgcaattctcaaagtgtagtctagagaaacctgaggacctttgagtaccttcagagacagtccatgaggttaaaggactttgctacgtgaaaagtaagatgctattggccctttttactttcattttccaacaagagaagaggggagttttccagcagttacataatatgtaatggcatcatgtctctgatggctaagaaaatgggcaattgttgactttgtgtgttaaaaaaattctcagtgttggtttcttatactataaatattcatcttgtgttttgaaaaagaaaagctctttggaatcccctatgaacaaagactttgacagttgttgatctaagaccacagcttaartatctacacaagaaaaaaaaaaaaagcaaataagagccaaggaaagcagatggaaggaagtagtccaaaccagtgacattcagtgaacaagaaaagagaccaacaagggagtaaactcttgaaacagaaagttgattctttgaaaagatccatatgattgaacacagtctggctaaacaaatgacagaccaatgagggtgcacaaccatcaccatctggagtaacagaggagaggtgccattactatagcatcttccagttctgaaagctgaaaagaagattttgagaacaattgtatgtgaataaattcaggaatgttaatcatgtgggmcaattcctgaggaagacaacaaatcagcaaaccagatgctgaatagttagtgtagtcctgtagagagacatacagagaggctgacagagaaatatttgtatgtgcataaaacaatctacaagacacacttcaaaatcaatctcagttaatctggaggaacatatttcacagaaggtggaaggagggtattctgatcctcttgtacattgtacaacattgtacaatgtacagagtataattgtacaagtacaattgaagttgtacaagtacaagtgcaacttgcacaatgtacagagtaaacattgatgtttactctcaattttcttatggagcacagatgactttggatgtgttacaatatgaatgataatttgtctttgagatgttcgcagttgtttagaagttgaggaccatttgtgcatattatgggacctttagtgaaaatatttcaaagtctctttttacactttgttacagcaaaatgtagagggcgctaagtgcccttgaatcttctcccatctctggtgacctgtgttgttttgaaatttgcagtggcctgascaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagayccaagcacagaggcttcttctgaagaaggtaggaagtctrtggccagacaaccacaccctaggacgttgggatgaaaasagttgcaaaatcttagtgatatagaagccttccatgctcacacaattccaagtagaatgtggactcagggtcagccactgggaaggaacactcagcgccttctctgggagaaccagagctgtgatgtttggtaccctgtgaaagggtggtatctataggaagggtgcagaccctctagggcactggacttaccactcccctggttattcaaaggatcattttagtgtcttagccagaagaatattctaacattttgccaaatttgtgaagatttaccaagctcatgataagcctttcatggtatttcttcaagtagtcagtgttcattgcatctttggctttgcggtttcggaggaatgcggtttttgagtctgtcatccttgagaaacctaatatgacttttcttagttccatatacttctgggtccaggtagcagtacatagccaacaaatgctccatcgttctggcctatctccatcttaagccagtcctgcacaactaggctttgatgggagggatctctcagtgttcttgcccctccttctcatggaacatatatctgtgttggtctctgagaagaagagtagtggatatctactttgttgcaatgcagaatcctgggccaaagataccagccatccctccaagggaataaaattttggccagtagccctctctgagagacaatttgtctttgcctacgagtcctagatgcaggaccgcttcctgccccatcttcaagaagctgaaggctttggctttggaggatcagcagtctagggaaatgtgtgacggtttcatgtctgtccccactgacagtcaatcaccacctacaacctgcacagcctgatgcatagcagtctagtttcctgccttattctcaggaacacccagaagatgtctatattaaagagcatgcacatgagtrcaattttgactgataggcactctgatctttcctttggtgcctgtgttttaaaggaaatctttctaagaactcgttaaagttctagaatgctatgaatctttgggttttattattggtatgtccatctgcctgctagtacagaacagagcatggtagtctttctcagagacaatgatcctgtttcagtcacagatttcttctgatgcttctgtgttctagaaattactcagcttkatttctcctctttgaatttcagcaccaacggagcaaagccccggggtccaggattgctaccatggtgatggacagagttatcgaggctcattctctaccactgtcacaggaaggacatgtcagtcttggtyctctatgacaccacactggcatcagaggacaacagaatattatccaaatgggtacaaccttgagttttcttcaaagacagacagcagcccccttacatttctcttggaagggccatgcttccaactaacttcttatgacaaatttatctcagatctggaatgttgggtagaatgtctcaggcttctttcttcaggcacagtgtctgaaaggagagaaatgtcaggccagctctcttttctcatagttgacagaagcaggaggatatttgaaggtggtgagttctcatgaatagaaagctcaggacacatggccacgtgcttagaaatagcaccattccacaatgcccactaaagaccaatgcaatagttcaaccagggatttctgtcattctaatctccaagtcctgaagtgaaggttgtattagccatgttcatcttgggcaacaaataaaggatatctatgttgacatccagatcttccaatcactttctcctctaacctgtacctgggttctgagaacaaggtatctgaagagctatgtgttgccagcacatgaggggcaaaagtaggaaggcagctgagagtcaggaagtataaagattctgaagagttacacatgcaggaagatggacagaaacccagttcagaccacgtcagcgtttctgccatgaaggactatcaaatacataggaaaagtgttttcataggttggacaacagacatgacaggcctgagaaaattcagaaagggaatcaaaggagatcaaccttatcatgtccctggcatccttccttgagacccttgaagggcaagcagatggagcccagctgaccacagcagtcttgcttaactgaggagagagactggagtttgtgatgcctcaggcatctgacgtattctaggctggctaagaatgagaggggatttgtggaggaaaggagctccaagaatacacaccgaagtcttctcaaggctttggctaaatacaaagctgcgtatgcacaaggagagttttcacaaagaaagaacaataaagaaaagctactggggaaagaacaactgcaagggaacagtgagctcaatggagatgctagagctcacatagcactgggggatatttgagttctgaccactcagaggagagacacctcactgaacatcttgggcattcagtagaggtcaaagaaagccataatttgggagtaggatcttcggattcctagaaataaggtgactccagaaacactccagcaacccttcttccaagccagtctaaaaggatccaaatgatttccaagtaaattaactgccttccagaaaaaagtaaactcaaccctccttagaggtaaggaacgaatacaagtttctcagttatatgacatccccagagtgcaacttgcatttaaaaatttactagacacaaaagaagttttcactgtgatccataactgggagaaaaatcactcaacacaaataggcccagaaataatagaaattatggcattggcaagaacatttaaaatgcacctctgagaactgtgtttcaggaaaatgtcagcaaaagctgaccatgagagaaatgaatgcataatatcagaaaagaaaagaattgaagagccaaatggaaatttaaaaactgagaaaagttatatctgtaatgaggaattcactggatggccttataaccagtttagatattatggtaggaaaaggtgaaygagaaaatgattcaattaaagctagacaaaccacaagacagacagacagacacaaatacacatacacacaatgactgaaccaattaatcaacagagcctcaaggacatctaggaaaacatccacacatttaatatatgtgttaggcaagtcacagaaagagaggaaaaagataatgtgacagaagttatacttgaagccatgacggctgacaaatttccaaacatacagaaaatgagaaattcatagtcatgaagctcaatgactcaggtatagatttttaaagagcaaaactctgatttacyggggtacatcatagttaaattgtctgatttcaaagctaagaagaaaaaaagggggttcctatgaacaaacattttgacagttgatctaagaccacagcttaaatatctaggcaaggaaaagcaaataagacacaaggaaaggggatggatggaaatagtccaaaccaatgacattcagtgaacaagaaaatagaccaacaaaggagtaaatccatgaaacagaaagttggttctttgaaaagattcatgtgattgaccacagtctggctraacagatgacagaccaaggagggagtacaaccatcaccatttgaagtaacaggggagaggagccattgctataccatactccaggtctgaaagctgacaagaagatatcaagaaaaactgtatgtgaataaattcatgaatgtagatcatgtggatcaattccttaggtaaacaacaaatcagcaaaccagatactgaatagattgggtactcctatagaaagacatacagatagccagacagagaaacatttgtacgtgcataaaacaatctacaagactcacttcaaaatctctcagttaatccaaagtaacatatttggcagaaggtggaaggagggtattctgatcctttcttgtacacattgatgttttctctcggttttcttatggagtatagacgagtttggatgtgttacaataagaatgataatctgtctttgaaatgttcacagttgtttagaagttgaggacgatttrtgattgttacaggacctttagtgagaatatttcaaagtcactttttaccactttgttacaacaaaatgtagrggatgtctggtgcccttgtatcttctcccatctctggtgaactgtattgttttgtaatttgcagtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaaggtaagaagtctctggccagacaaccacacccttggacgttgggataaaaagagttgcaaaatcttagtgatacagaagccttccatgctgcacgggaatctgaatgtggactcagggtcagccaatgggaaggaagcctcagcgccttctctgggggaaccagggctgagatttttggcaccccgtgacagggtggtgtctttaggaagcgtgcagaccttctagggcactggatttaccactcccctggttattcaatagattatttcagtgtcctagtgaaaatggatattctaacatcctgccaaatttgtgatgatttaccaagctcatcatgagcctttcctggtatttcttcaagtagacagtactcattgcaaacttcagctttacagtttcagaggaatgtggtttttgagtctgtcatccttgagaaacctgatatgactttacttagttccatatcctcctgggtctaggtaacagtacatagccagcaaatgctctatctccctgtctaccttaatcttaggcaggtgctgcacacctaggctttgatggaagggatttcttagtgttcttgcccctccttctcatggaacacgtatctgtgttgctgtttgtgaagaagagtagtggatgtctactttgttgcaatgcaggatcctgggcccaagatttcccgccgtccctccaagggaataaaattttggccagtacccctctctgagagacaatgtgtctttgcctggaagtcctagatggaggaccacttcctgccccatcttccagaaacttaaggctttggctttggaggatcagtgctctggagaaatgtgtgacggtttcatgtctgcccccactgacaaccaccacctacagcctgcaccgcctgatgcatggcactctggtctcctgccttgttctcaggaacacccaaaagagatctttgccaaagaacaggcacatgagtgcaattttgactgataggcactctgatctgtcctttggtgcccaggttttaaagaaaatctttctaaaaactcattgaagttccagaatgctatgaatctttgagctttgttattggcatgtccatctgcctactaatgtagaacagagcatggtcgtcattttcagagatgatgtcctgtttctatcatggattttttttctcatgcttctgtgttctggaaattactcagtttgwtttctcctctttgaatttcagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatgggtatgtctttgagttttctcccaagagaaasagccacccacttaaatttctcctggaagagccatgcttccagctaacttcttatgacccaatttctctcagacccagaatgttggacagaatgtctcaggcttcttgctttgggcacagggtctgagaggagagaaatgtcaggccagctctcttttctcatagttgatagaagtaggaggatacttggaggtggtgagktctcatgaatagaaagctcagaagaacatatgaccatgtgcttagaaatagcaccattccacaatgcccactaaagaccagtgaaatagttcaaccagggaattctgtcattctaatctccaagccctggagtgaaggttgtgtttgccatgtttgtcttgggtaacaagtgaaggatatctatattgacttcgagatcttccgatcactttctcctctaacctgtataaacacattgggttctgagaacaaggtgtctgaaaagctatgtgttgccagcccatgaggggcaaaaggaggaaggcagctgagagtcaggaagtatagagatgctgaagagttacacattcaggaagatggacagaaacccatgtctggctatgccagcctttctgccatgaaggactatcaaatacatgagaaaacagttttcacaggttggacaacagatatggtaggcttgagagaactgagaaagggaatcaaaggagatcaacttcatcattaacctgtcttccttcctggacacagtgttggattgaaggacaagcagatggagcccagctgaccacagcagtcttgcttaactgaggagagagactggagtctgcgatgcctcaggcagctgatgtgttctaggctggctaagaatgagaagggatttgtggargaaaggagctccaggaatacacacagaagtctcctcaaggctttggctaaatacaaagctgcgtatgcacagggagagttttcataaagaaagaacaacaaagaaaagctacttgggaaagaacaactgcaggggaacagtaagctcaatggagatgccagagctcacatagcactgggggatatttgaattctgaccactcagaggagaaacacctcactacattttgggcattcagtagagaccaaagaaagctgtattttgggattgggatcatcttattcctagaatcaaggtgactccagaaaaactccaacaacccttcttccaagccagtctaaaaggatccaaatgatctccaagtaaattaactgcattccacaagaaaaaaaaaactcaaccccccttagaggcaagggacaaatacaagttgctcagttatatggcattcctattgcgttacttctatttaaaaatttaatagagacacaagaagctttcactgtgatacataactgggagaaaaaatcactcaacacaaacaggcccagaaattatagaattgatgacattggtgagaacatttaaaatgcacctctgagaactgtgtttcaggaaaatgtcagcaaaagctgaccatgagagaaacaaaagcagaatagcaagagaaaagaaaagaaccggagagccaaatgaaaattaaagaactgagaaaaggtacatctctaatgaagaactcactggatggccttatcatcactttagacattacggtaggaaaggtgacctagaaaataattcaataggagctacacaaatcacaggacagacagacagaccaacagacagaaacacacacacacacacacacacacacacacacacacacacacacacacaaagactgaacctattaatcaacagagcctcaagggcatctaggaaaaatccacacatttaatatatgtgttaggcaagtcacagaaggagaagaaaaagatatcatgacagacattatacttgaagcgatgatggctcrcaacacgccaaatatacagaaaacaagaaactcatagtcaagaagctaaatgactcaggtatagaattttaaagagcaaaactctatgatttactgggatatatcatagttaagttgcctcaattcaaagctaaaaagaaaaaaagggggttcctatgaacaacagctttgacagctgttgatctaagaccacagcttaaatatctaggcaaggaaaagcaaataaggcacaaggaaagaggatggaaggaaatagtccaaaccaatgacattcagtggaaaagaaaatagaccaacaaaggagtaaatccatgaaacagaaagttaggttctttgaaaagtctatatgattggccaaagtctggctaaacagatgacagaccaaggagggagcatatccatcaccatcatgagtaacaggagagagatgccattgctatagcatcctccaggtgtgaaagctgagaagtagatattgagatcaactgtatgtaaataaattcatgaatgtagatcatgtggatggattscttaggtaaataacaaatcagcaaatcaaacactgaatagatcatgcagttttatagagacttacagacagcctgacagataaacatttgtatgtacgtgaaacaatctccaagacacacttcaaaatccctctcggttaatccaaaggaatgtatttggcagaaggtagaaggagggtattctgatcctttctggtacacattgatgttttctctcagttttcttataaagcatagattactttgaatgtgttacaataagaatcataagctgtctttgaaatgttgacagttgtttagaagttgaggaccatttgtgagtgttatgggactttagtgagaatatttcaaatttgcttgtttacactttgttacaagaaaacatagagggtgccaggtggtgctgtatcttctccaatctctggtgacctgtattgttttggaatttgcagtggcctgaccaggaactactgcaggaatccagatgctgagattcgcccttggtgttataccatggatcccagtgtcagatgggagtactgcaacctgacrcaatgtccagtgatggaatcaactstcctcacaactcccacggtggtcccagttccaagcacagagsttccttctgaagaaggtaagaagcctgcagtcagacaaccataccctcggacattgggataaaaagatttgcaaaatctttgtgatgcrgaaaacttccatgctgcacaggaagtcgaaggtgaagtcatggacagccaatgggaaggaagcttcagtgccttctctggggggaccagagctgggatgttgagtgccttgtgagggatggtgtctttaaaaggggcacagaccctctaggacactggatttatcacttccctgttatcaaacgaatcatattagtgtcctagccaagatggatattctaacatcctgccaaacttgtgaagatataccaagctcctaagcctgtccagccctttcttcaagtaggcagtgtttattgcagtcttcagctttaccattttgaaggaatgccatttttgaggctgttgttcttgagaaacctaacatgtcttcattagatccgtattgtcctgagactttgaagcagtacatagccaccraattgtttatctccccagcctaccttcatcttgggcatgccttccacacctaggatttgagggaagggatttctcagtgttctcatccctgcttctcatggaacatttatctccgttgttttttgagaagaagagtagtggatgtcagctttcttgtaatgagggatcctgggcccaagattccctgtctcccctcctaggctataaaattttggcctgtactccttctccctgagaggcaatgtgtctttacctacaagtcctagatgcaagatccttttctgccccacaccccagaatctgaaggcttttgctttggaggagcagtggtctagtgtgcaagggtttcatgtataccccccactaacagccaatcaccacctatagcctgaacagcttgatgcatggcaccctggtctcctgccttgttctcatgaacacccagaagaggtgtaagcaaaagaccattcacatgagtgtaattttgaagtataggcactctgatctgttttttgtttgtttctttgtttgtytgttttccagggttgaattaaaatatttatgactacttattaaatttctagaatcctataagtctatttgtatttttattctacatttcaatttgcatgctaatatagaagagtgtaaattgttaatcctcagattattccactttgtgtgtcataatttttttcacatttcccttttctaggcaatactgagcttgattttctcttttaatttcagcaccaactgaaaacagcactggggtccaggactgctaccgaggtgatrgacagagttatcgaggcmcactctccaccactatcacaggaagaacatgtcagtcttggtcgtctatgacaccacattggcatcggaggatcccattatactatccaaatgcrtatgtctatcatgttagccataaaaggaacaatagtcaactaaaatttctcttagctggcccatgctacaagctcacttcctaggtccaaatttctcatagactcagagtttgtagcaaaatgtctcaggaaacttacttttgagcaaaaggtctgaatgaagagaagttttaggattgctatctttcataacaatttgatggaagcagcaggatatatggaggtggtgaagtctcattaatgtaaagctaaggagatcaaatgaccaaatgctgagacaaagtatcattccacaatgcccactaaaggtccatgcagtctttcaaccatgcaattctatcattctatcctccattccctgaagtgaaatttgtgtttgccatttttgacacgaatcagaagtaacaaattcaggctgggtgcagtggctcaggcctgtgatcccaacactttgggaggacaagacgggcagatcaccagaggtcaggagttcaagaccagcctggctaacatggcaaaaccccatctctacgaaaaattaaaaaattagccggtcatggtggtgggtacctgtaattccaactacttgggaggctgaggcaggagaaacacttgagcctgggattcagagtttgctgtgagccgagaacatgccactgcactccagcctgggtgacagagcaagactcaatctcaaaaaaaaaaaaaaagaagaagaagaagaaaagaagaagaggaagaagaagaagaggaagaagaagaagaagaagaagagtaagagaaattttttggagccgcaggaggagccagaagaagaagaagaagaagaagaagaagaagaagaagaagaaggaggaagaagaagaagaagaagaagaagaagaagaagaagaagaagaagaagaagaagaagaagaagaagaaaatagaaatgagtgcatatatttatatatgagtactagcctgtatgaacacactgggttctaagcaccagttttctgaagggatatgggttgtcaggcagagtaaaagcaggaatgcagatgagagtcaggaagtaaacagatgtggtgattaaaatgggcaggtacatggacaaaaaaatgcatgtctgacaaaaactggcctcttgccataagtgagtatgaataatatggaaaaactgtttgcacatgttgaacagcagacagtacaacctgagatagtttagaaagggaaacaaataagatcaaccccataattacccttcctagacttaagggcaaagagttttaaccaaagcattccacagcagtcttgctaaactggggagagagactggagttttgtttactaataaaaccgagattttctaggttaggtaataatgagaaagtatttgtggagaaaaggagctccaggaatacacacagaagtctcttcaagtctctggctgaacagaaagctgtgtatgcacagaaagagtttccagagagaaaggagaacaaagaacagctactggggaaagaacaactgctggggaacagtgagctcaatgaagatgccagagctcacatagcactgggaggtatttgagctctgaccagcctgaggagagacacttcattgaacatcttgggcattcagcaaagaccccaaaaaaccatacttcaggagtagaattaatgcattcctagaataaagtctactccagaaacaccctagaaaagcttagaaaccaagtctaaaaagatccaaatgatctccaagtaaattaattgcctgtcagaagaaaacaacctcttcagaggtaaacaacaaaattaaattgctcaattatatagtatgcacaatgtgtggcatacatttaaaaatttgctaaacatacaaaaagcatttagtgtgacccataaccaggagaaaaatcagtcaatacaaatagacccaaaaatgataaaaataacagaattggcaaggagatttaaaatgtatgtatcataattgtgttcaaggatttaaagaaagcgtggacaagaaataaataaatggataatatcaacagaaagaaaaattgtaaaaggaccaaatggagagtcaagaactgaaaaaaaagacatctctttaatgagaaaatcactacatggccttataatcatattagatagtacagatgataaagctaactagaaaatattagggtggtgcaaaccatagcacgcttatacaaagcctgagaagataaacagagcctcaaggacatctatgaaaatatcaaaatatttaatatttgtttaaagcaagtcacagaggargggaaagagatattggaacagaaaaaatacttgaagcagtgatggctgatgactttctaaatatggaaaaaatgataaactcacatagtcaagaagctcaatggatcagatataggattttaaaaagtaaagctgtatgatttatttggacacatcataattaaattgtccataatcaaagatagaaagtaaaatcttatttgaagcccaagggaaaaaacatacctttacatagagtaacagtgacacaaatgactgatgccttctcatcagaaacaacacaaatcagaaacaatagaataacacctttagagtggtaagaagaaaaaaagatcaaatcagaaacaacaaaataacacgtttagagtggtaaggaggaaaacaagatcaaatcagaaacaatggaataacacctttagagtgtaagaaagaaaaaaagatcaaatcaggaacaacagaataacgccttcagagtggtaagaaggaaaacaagataaaatcagaaacaatgaaataacacctttagagtagtaagaagaagaaaagatcaggtcagaaaaaatggaataayatgctaagaagaaaaaaaaagatcaagtcagaaacaatggaataacacctttagagtgaaaagaaggaaaaaaacccagcaagcttaaacgctatgcacagcaaacaattccactgaaaatgaatgttacgtaagtacatattctgtcctcctaaaaacaaagaacaaataaaagaatgtttcatcagcaggattatgtaataaaagatgtgaaagaatgctatgtaagtagaagaaaaataataccatatgggaattggcatcaaaaccacaaaatactatcaaaacaaaaaaactttattgataaatttaacacaatatgcaaaagaactataccatgtatactacataacattggtgagaagaaaattagaagatctaaataaagacacatcatgcttatagattaaaaaatccaatgtcacttttcacaaaactgatctttagtttcaacccacacccaagcagaattcctgcagtcttttcttgaaaacctaacagaatgtatatgctagaatcaccaagacaatctttaaaaagaataaaaaacttggaataaaatcacaagtttgtgggatagatgcatatggtaatatggaaattctcataaagacacagtaatcaagacatgtggtattggctgggacgcttggctgtaatcctaacactttgggaggccaagatgagaggattgcctgagatgaggagttgcagacaagcctgggcaacatagcaagaccctcatctctacaaatatttaaaaaaattagccaggtttggtgccatgtgcctgtagtcccagctattcaggaagctgaggtgggaggatcactggagcccatgaggtggaggctgaaatgagccatgattgtgctactgaactttagcctgggagacagattaaaaccttccctctctctctcaaacaaacaaacaaaaaatacatagtattgggcaaaacatatgcaaacaaaaacagaaaagggtcagcataaatttacatatatggtcaatttattttcaatacaggtagcaaagcaatttaatgaggaaatttttttccaaaattggtctgaaacaactggatagccatagaaaaaaactataacaaatgtgacgcttgaatcctactgtatgactcaaattaaattaatttgagatagctcttagacctcaatgtaacagctaattctgaggctgaaatataagactgctatgaaaaagtatagtatcttataaccttggagaaggaaaaattttttgagggaagaaccagaaaacactaactgtaaaagaaaacaaatgataatgtggacattcattgaataaaaacttatgctcaccaaatatgactgttaagaaaataaataagtaagtaacacactggaagaaaaacactctcatccatatatctgacaaatggcctgtatccagagtatagaaacatttctcccactcactaatcagaggacaaacaacctaatcaaaatgggcaacaggcttgaatagtcatttcttaggagaagatgcacacagagccaacaatcacctgaaaaagtgcacaacatcttagccatcaaaaatcaagagttataaccctcataagatgacactgaacatccagtgtacatggatatcattaagaagacacaataataagtggtgtcaccgatttggagctagaatgtgccactctctcatatgctggtggaagttcaaaatcatacaacaaattaaaaaatcagtctgatgctttcttataaagttcgataaatatgcatctatcctacaaacctgtaattctattcttgaatatttaccccccaaaatgaaaacataagtccacaaaaatctatataaatattcatagcagctttatgttttataaactcaaaataaaaactatttcaatgttttcatcaaaagaaaatgaaaactatttaaatggtttcatcaaaagaaaatgaaaaaagaatttccagtatatttatacaaaggaatactattcatcaacaaggaacaagttactgatagtctcagaagcatgaacaaacctcraaaatatattaaggaaagaagccagacgtcaaagtgtatagtctgtatgagtccattcatgtgagtttatagaaaacacaatttatggtgaaagaaaccaatagcatttgacactggccgtgggaagagggtagcagagattgattgagcagccacacaagggagtttctggggtggtgaaaatgttctgcattgtgagggcagtgtgggctacacaagtatatgtatttatcaaatctcatccagctacatttaagatctgtgcatctcactctatgtgaaaatatactcaactgaaaaacagagcaggtatctgtttcaggtgctacatcacttgatacgtccagttgtgttaaaaaccactgcctaacatcctcaaatgggggatctgggcttgagactaggtcacatgtgtagagtctctacagagaccgtgttggattcccatgctccataatacgttccaagttttctcagacagccacaggtcatgaatgtgaggattctgagaggttggagcaacgttcttgggaggcataatggggaaggcattctccaagattcctccagcctggggtcttcacctgctgtgcctcttactgcattgttttctgactcatccatagccacttgaccccttcagatcccatagtctacctagccgtctccctttatgccttgggtcccgctgttctttcaactcatcacccattccttcagtcccagagtggctgcagccagcagaggatggactgagagcaggagaggaggtcgtgcccatgaacccatcctagagaagcagcatcctgcctgggagctagttttccagggaagcttttataagtcctgtagacccaaacccacttgctctaccagatacagtatttatagtaatactattttcatgattattttatattgcaaatgtagagcatttatgctacactatgagtaaatagagtaagggggctggcatgggaattatataatcttggatgccacttcttccttggggaaatgtatttgagttccaacttacatattactatatagtcttatagagagagagacaaagagctagacagacagagatatctttgtatgtgcattaaaaaatctaagatacatatttcaaaatctgtgtcatttattctggaggaaagtatttggcagaaggtgaaaggaagatattctgatcctttcttgtacagacatgtattatctcagttttcatagagagcatatactacttttgatgttttaaaacaaaaattataatctgtgatgtgtccacagttgtttaaaagttgaagctgaagaccatttgtgcttgtggcaatattattgtggtataatgggaatatttcaaaggcacttgttaacactttgttacagcaaaatgtagagggcgctaagtgcccttgaatattctcccatctctggtgacctgtgttgttttgaaatttgcagtggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaaggtaagaaatttgtggttagacatctatatactgggatgaaaaaccatggaaaatcttactgatgcagaagccttcagtggtacactggagggttggttgagggtctgcaatgtggaggaaagcctcagcgccctctctgggggatccagaactgtgatttttggcacgctgtgaggaggcagtgtctttaggaagggcacggtgtctttaggaagggcacagacccgccagggcactggacttaccactcccctggttattaaatgggtcatttcagtgtcctagccaaaatggatattctaacagcctgccaaatatgtgaagatttccaagccaataagcctttccagtgatttaaagtagacttttttcattgcaatctacagtttgcagtttcttaagaacatggcctttgagtatgatatcctagagaaacctaaggagactgcattatttttctattgtcctggggctgcatagcaggaggtaaccaacgaatgctgtctctccctggyctatctcagtctttcacaggctctgttcacctcagctttgaagttagaaatttctaggtgttcttgcctcttcttctcatgaaacctgcattggcagtgagtctacagaagaagaggaagagaattctgctttgttacaattcaggactctgggcactagaagattccctatctctcctccaagggaataagttgtttgtctctaaccctccttgagaaacaatgagtctttgcctgcactcctaaatgtaggatgatttcctgcccaaattttcaaaagattaagccttttgccttggtatgagcaatggtctagggaaatgcgcaagggtcttgtgtcggcccctgactgaccaccagtcacctcctacagcctgcaccaaggaatgcattgcattctggtcttctgccctgtggttctcatgaaaaccagcagagattcatatgatggagctgcacatgaatgtaatttccaatgtccagcattctcctctgttctttatctttagatttaaaaataatgtttctatgaacttattaaaattctagaatactatgaatctactgggtcttttcacatccttttgctactagtagaaaaaagaatagtaataattttcagaggctactgtccagtatgtgacataaattgtctcccatgtttctctgctcatgcaattactgagtatgatttattttattttaatttcagcaccacctgagaaaagccctgtggtccaggattgctaccatggtgatggayggagttatcgaggcatatcctccaccactgtcacaggaaggacctgtcaatcttggtcatctatgataccacactggyatcagaggaccccagaaaactacccaaatgcgtatgtatttgattaaaacmataagaggagcaacagccaactcaaatattggttagaagacccatgctttaagctcacttcctagggacaaatttctcttagactcacattttggcaaaatgtctcaggacctttgcttttgagcaaagagtctaagagaagagaaattttaggcctgctatttttcctaatagttttatggaaggagtagaatatacggaagtggcgaagtcatattaatgtaaagctcagaagataaatgaccaaagcttaaacacagcaccattccacaatgcccactaaaaatcaatgtcatctttcactcgtgcaattctgtcattctaaatttcaattcccgaaggtttgtttgccatttttgtcatgggtaataagtaaaaaaaaaaaaattaagatgtgtatatatatatatatrtatatatatatacacacacacacacacacacaaacatctgaatatttatatatatgtctgaatatttatatacttgtgtataaaacttatatttaaatttttgcataaatttatatatttttaatatttcactaaaaattatattgtttcactatgtatgtctgagtatttttatatattttaatataacattttaaatatttatatataaatattcaggtatgtaactgaatattcatttacacacacaaatatatgtgtgcatgtgtgtatatatatatatacccatatatatatatatatatacacatatatatatatatatatatagtatatatatatatatatatatatacacatatatatatatatatatatgtatatatatatatatatatatatacacacacacacacacacacatacatacaggtataaacacactgggcctgaagcaccagtggtctgaaaggacatgtgttgccaggacttgaagagcaaaagcaggaaggcggatgagagtcaggaggtacacaaacgctgaaaagtaaaatggacaagtacatggacaaaaagcaggtataagcataacagccttttggaagtaaatgactataaaatatatgaaaatactgttttcacaagttgcacaacagatagtagtgtattgagataatttagaacagaaaacaaatgtgatcaaccccataagtgtgctgtatttcatcatggattgaaggaaaaagagatggagcccaagaagaccacagcagtcttgatgaactgagagacaccagagtttgggattacaaaggcagctgggattttctacacttggtaataatgagaaagaatttgtggagataaagagctacagtcatgtacctagaagtcacctcagtgtaatataaatctgcatatgcacagggagtgattccacaatgaaagtaggacaaagaacagctactggggaaagaayaactacaagggaacaatgagttcaatggagatggcagagctcacaaagcactgggggatatttgagttcttaccagctagaaaagagacctcattgcaaatcttgggcattcagtagagaccccagaaaagccactctttggaaacagagttgatgtattttaagagcaaaatctactccacaaaaatcctagcaaaattgaaaagcaagtcagaaagaccaaaatcctctcaacataaattagttgcccatcagaagaaagcttaacctcttcataggtaaacaataaaatcaaattgctcagttatctggcatccacaatatgtgacataaatttaaaaatttactagacatacaagaagcatttagtgtgatccataaccaggagaaaaatcattcaatacaaatagacccagaaatgacagaaatgatagaattagcaaaaacatttaaaatatacatatgatcayttgatcttgtgatcagatatcacaagagaagaaagagatacttgaacagaaaaaatgcctgaagcaatgatggctgaaaactttccaaatatgaagaaaaaaaarctcacagattcaagaaaactaatcaatcagaaatatgattttgaaaagtaaaaatgtatgatttactttggcaaatcttcttggttaaattgtctaaaatcaaagaaagctaggaaaattttataagccagaggaaaaaagattgtttatataaaggaacagttacacaaatgactgatgccttctcatcagaaacaatgaaagtcagaaacaataaagtaacatctttaaagtaatagaagaaaaacccaagaggtgagggatcatggcagacaggaggcaggactagattgcagctctggacagagcagcatgcagaggctcatattgtgaattttagccccatattgactgcaagaacagaccagcaatcctgagaggacccacagaccgtgtgaaggaagcagactgctcctgcaggataagggagacaccccaaatactgtgagttccccaactgcagaagtggaaaagggaggccttactccctcaaacacaccccacaactggagaagctgaaagtctgtttgcaggagaagttcccaactttacctgggcctcagtaaatttagagagctgagccaagcaaaatataggggtagaggaagcagcagagaagacctcagagcttgctggatccccaagcagctcattcctgcctggcaccacagagatccatcagaagtgtggccaaaggaacagagggtaaaactccacatggaggactgctctacctgaactttctaacaatttgaacagggggagaagcctcctggccagaacttgggggagggcatgaatctggtttgcagacttcacaggtgggggaaggactaaagcccttttctttcacagctgggaggtggaaagcctcaggcaagttttcaagcctgactttccccccacctggaaacagacttggagctgttgcggggttgggggcatggtgggagtaagaccagcccttcagtttgcatgggtgctgggtgaggcctgtgactgacagcttccctccacttccccgacaactcagatgactcagcagaggcagccataatcctcctaggtacacaactccagtgacctgggaacttcacccccacaccatacagaagcttcagtaagacgtgcccaaggaaagtctgagctcagacacgcctagtcccacccccaactgatggtccttccctacccaccctggtagcagaagacaaagagcatataatctttggagttctagggcccacccacctctagtccctctccacactagtatagctgatgcaggaggccaaccagcacaaaaatagagcattaaaccaccaaagctaggaacccctatggagtccattgcaccctcctccacctccaccagaacaggcactggtatccacagctgagagacccatagatggttcacatcacaggactctgtacagacagtccccagtaccagcccagagctgggtagacttgctaggtggcaagacccagaagacaggcaataatcactgcagttcagctcacaggaagccacatccataggaaaagagggagagtactacatcaagggaacaccccatgggataaaaacatctgaacaacagccttcagccctaccttccctctgacacagtctacccaaatgagaaggaaccagaaaaccaaccctggtaatatgacaaaacaaggctcatcacactcccagttcaccagcaatggatccaaaccaagaagaaatccctgatttacctgaaagagaattcaggaggttagttattaagctaatcagggagggaccagagaaaggcaaagcccaatgcaaggaaatccaaaaaaaaaaaggtataagaagtaaaaggtgaaatattcaacaaaatagatagcttaataaaaaaacaataaaaaattcagtagactttggacacacctttggaaatgtgacatgctctggaaagtctcagcaatagaactgaacaagtagaaaaaataaattcagagctcaaagacaaggacttcaaattaacccaatccaacaaagacaaagaataaaggataagaaaatatgaacaaagccttcaagatgtctgggattatgttaaatgaccaaatataagaataatcgtggctcctgaggaaaaagacaatactaaaagcttggaaaacatatttgggggaataactggggaaaacttacctggccttgctggacacctagacatgcaaatacaagaaacacaaagaacatgtaaatacaagcagcacaaagaacacctgggaaattcatcacaaaaagatcttagcctaggcacattctcatcaggttatgcaaagttaagacgaaggcaagaatcttaagagctgtgagacagaagcaccaggtaatgtataaaggaaaccctatcagattaacagccagtttttcagcaggaactgtacaagctataaaggattggagccctatcatagcctcytcaaacaaaacaattatcagtcaagaattttgtatccagcgaaagtaagcatcatatatgaaggaaagatacagtcgtttttggacaaacaaatgctaagagaattcaccattaccaagtcaccactagaagaactgctaaaaggagctctaaatcttgaaacaaatcctagaaacacatgaaaacagaatctctttaaagcataaatcacacaggacctataaaacaaaagtacaagttaaaaaacaaaaacaaaaaacaaaaccaaagtacggaggcaataaagaatatgatgaatgcagtggcacctcacatttcaatgctaaaattgaatctaaatggcctaaatgctccacttaaaggatacaaaaagagttggtggctggcaagatggctgaataggaacagctccagtctgccgctccccgtgagatcaacacatagggtgggtcatttctgcatttccaaccaaggtacccggctcatctcattgggactggttagacagtgggtgcagcccacagagggtgacctgaagcagggtggggtgtcacctcacctgggaagtggaaggggtcagggaactccctcccctagccaaaggaagccgtgagggactgtgccgtgaagaccagtgcattctggcacaaatactatgcttttcccacggtctttgcaacctgaagaccaggagattcccttgggtgcctacaccaccagggccctggatttcaagcccaaaactgggctggcatttgggcagacactaagctagctgcaggagttttttttcataccccagtggtccctggaatgccagcaagacagaaccattcacccccgtgaagaaagggctgaagccagggagctaagtggtctttctcagtggatcccacccccatggagcccagcaagctaagctccactggcttgaaattcttgctgccagcacagcagtctgaagttgacctgggacgctcaagcttggtgggaggaggggtatccacaaatactggggcttgagtaggaggttttcccctcacagtgtaagcaaaaccgctaggaagtttgaactgggcagggtgcactgcagcttggcaaagccattgtagcaagagtgcctctctagattcctcctctctgggcagggcatctctgaaagaaaggcagcagccccagtcagaagcttatagataaaactcccatctccctgggacagagcaactggaggaaggggtggctgtgagtgcagctccagcagacttagtttcctgcctgccagctctgaaaagagcaccagatcccccaacacagcactagagctctgataagggacagactgcctcctcaagtgggtcctggtttcagaagataataagaaactcctctgagctaaaggagcatgttctaacacaatgcaaggaagctaagaaccttgaaaaaggtcagaggaattgctaactacagtaagcagtttagagaagaacataaatgaccttagggagctgaaaaacacagcacgagaacttcatgacacatacacaagtatcaatagcaaaatcgatcaagtggaagaaaggatatcagagattgaaaatcaacttaatgaagtaaagcgtgaaaacaagattaaggaataaagaatgaaaaggaatgaacaaatcctccaagtatgggactatgtgaaaagattgaacctacgtttgattggtgtacctgaaagtgatgggagaatggaaccaagttggaaaacactcttcaggatattatccaggagaacttccccaacctagcaagacaggccaacattcaaattaaggaaatacagagaataccacattcaaattcaggaaatacagagaacaccacaaagatactcctcaagaagagcaacctgaagacacataatcgtcagattcaccaaggttgaaatgaaggaaaaaaatgttragggcagccagagagaaagtttgggttacccacaaagggaaccccatcagactaacagtggatcttcctgcagaaactctacaagccagaagagagtgggaggccaatattcaacattcttttttactattattatactttaagttctagggtacatgtgcacaaggtgcaggtttgttacatatgtatacatgtgccatgttggtgtgctgcacccattaactcttcatttacattaggtatatctcctaatactatccctccccactccccccatcccatgacaggccccggtgtgtgatgttccccactctgtgtccatgtactctcattgttcaattcccacctatgagtgagaacattcggtgtttggatttctgtccttgtgatagtttgctgagaatgatggtttccagcttcatccacatccctacaaaggacatgaagtcatccttctttatggctgcatagtattccatggtgtatatgtgccacattttcttaatccagtctaccattgatggacgtttgtgttggttccaagtctttgctattgtgaatagtgccgcaataaacatatgtgtgcatgtgtctttatagcagcatgatttataatcctttagatatatatccagtaattgtatggctgtgtcaaatggtatttctagttctaaatccttgaggaatcaccgcactgtcttccacaatggttgaactagtttacagtcccaccaccagtgtaaaaatgttcctatttctccacatcctctctagcatctgttgtttcctgactttttaatgatcaccattctaactggtatgagatggtatctcattgtggttttgatttgcatttctctgatggccagtgatggtgagcactttttcatgtgtctcttgactgcataaaagttttcttttgagaattgtctgttaatatcctttgccaactttttgatggggttgtttgattttttttcttgtaaatttgtttatgttctttgtagattctggatattagccctttgtcagatgggtagattgtaaaaattttctcccattctgtagcttgcctgttcattctgagggtagtttcttttgctgtgcagaagctctttagtttaattagatcccattggtcaattttggcttttgttgctattgcttttggtgatttagtcatgaagtccttgcccatgcctatgtcctgaatggtattgcttaggttttcttctagggtttatatggttttaggtctaacatttaagtctttaatccatcttgaattaatttttatataaggtgtaaggaagggatccagtttcagctttctacatatgkctaggcagttttcccagcaccatgtattaaatagggaaacctttccctatttcttgtttttgtcaggtttgtcatagatcagatggttgtagatgtgtggtattatttctgagggctctgttctgttccattggtctatatctctgttttggtaccagtaccatgctgttttggttactgtagccttgtaatgtagtttgaagtcaggcagagtgatgcctccagctttgcttttttggcttaggattgtcttggcaatgcatgctcttttttgttccatatgaactttaaagtagttttttccaattctgtgaagaaagtcattggtagcttgatggggatggcattgaatctataaattaccttaggcagtatggccattttcacaatattgattcttcctatccatgagcatggaatgttcttccatttgtttgtgtcctcttttatttcattaagcagtggtttgtagttctccttgaagaggtccttcccatcccttgtaagttggattcctaggtattttattctctttgaagcaattgtgaatgggagttcatccatgtccctacaaaggacatgaagtcatgtatgggaatgcttgtgatttttgcacattgattttgtatcttgagactttgctgaagttgcttatcagcttaaggagattttggtctgagaagatggggttttctaaatatacaatcatgtcatctgcaaacagggacaatttaacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctatgggtttgtcataaatagctcttattattttgagatatgtcccatcaatacatagtttattgagagttcagcatggagagctgttgaattttgtcaaaggccttttctgcatctattgagataatcatgtggtttttgtctttggttctgtttatatgatggattacatttattgatttgcatatgttgaaccagccttgcatcccagggataaagccaacttgatcatggtggataagctttttgatgtgctgctggattcagtttgccagtattttattgaggatttttgcatcaatgttcatcatggatgttggtctaaaattctcatttttgttgtgtctctgccaggatttggtatcaggatgatgctggcctcataaaatgagttagggaggattccctctttttctmtgattggaatagtttcagaagaattggtaccagctcctctttgtatctgtggtagaattcggctatgaatctctcctggactttttttggttggtaggctcttaattattgcctcaatttcagagcctgttattggtctattcaaggattcaatttctttctggtttagtcttggtaggktgtatgtgtccaggaatttttccatttcttctagattttctagtttatttgcacagaggtgtttataatattctctgatggtagtttgtatttctgtgggattggtagtgatatcccctttatcattttttattgcatctatttgattcttctctcttttcttctttattagtcttgctagtggtctatcaattttgttgatcttttcaaaaaaccagctcctggattcattgatgttttgaaggtttttttgtgtctctatctccttcagttctgctctgatcttagttatttcttgccttctgctagctttttaatgtgtttgctcttgcttctctagttcttttaatggtgatgttagggtgtcaattttagatctttcctgctttctcttgtgggcatttagtgctgtaaatctccccctacacactgctttaaatgtgtcccagagattctggtatgttgtgtctttgttgtcattggtttcaaagaatatctttatttctgccttcatttcgttacatacccagtagtcactcaggtgcaggttgttcagtttccatatagttgagcagtttttaatgagtttcttaatcctgagtcctagtttgattgcactgtggtctgagagacagtttgttataatttctgttcttttacatttgctgaggaatgcctcacttccaactatctggtcaatttcagaataagtgygatgtggtgctgagaagaatgtatattctgttgatttggggtggagagttctgtagatgtctattaggtctgcttggtgcagagctgagttcaattcctggatatccatgttaactttctgtctcattgatctgtctaatgttgacagtggggtgttaaagtctcccattattattgtgtgggagtctaagtctctttgtaggtctctaaggacttgctttatgaatctaggtgctcctgtattgggtgcatatatatttaggatagttagctcttcttgttaaattggtccctttaccattatgtaatggccttctttgtctcttttgatctttgttagtttaaagtctgttttatcagagactaggattgcaacccctgctttttttgttgttttccatttgcttggtagatcttcctccatccctttattttgagcctatgtgtgtctctgcacgtgagatgtgtcttcagaatacagcacactgatggatcttgactctttatccaatttkccagtctgtgtcttttaattggagcatttagcccatttacatttaaggttaatatttttatgtgtgaatttgatcctgtcatcatgatgttcgctggttattttgctcattagttgatgcagtttcttcctagcatcgatggtttttacaatttggcatgtttgtgcagtggctgataccgattgtttctttccatgtttagtgcttccttcaggagctcttgtaaggcaggcctggtggtgacaaaatctctcagcatttgcttgtctgtaaaggattttatttctccttcacttatgaagcttagtttggctggatatgatattctcagttgaaaattcttttctttaagaatgttgaatattggctgccactctcttctggcttgtagagtttctgctgagagatctgctgttagtctgatgggcttccctttgtgggtaacccgacctttctggtgaatctgacaattatgtgtcttggagttactcttctcgaggagtatttttgtggcattctctgtatttcctgaatttgaatgttggcctgcctttgtaggttggggaagttctcctggataatatcctgaagagtgttttccaacttggttccattctcctcgtcactttcaggtacaccaagcagatgtagatttggtcttttcacatagtcccatatttattggaggctttgttcatttctttttactcctttttttctctaaacttctcttctcgcttcatttcattcatttgatctttaatcactgataccctttcttccacttgattgaatcaactactgaaacttgtkcatgtgtcacgtagttctcgtgccatggttttcagctccattagatcatttaaggtcttctctatgctgtttattttagtctgccattcatctaaactttttcaaggtttttagcttctttgcaatgrgttcgaacatccttctttagctcggagaaatttgttattacagatcgtctgaagccttcttctctcaactcatcaaagtcattctctgtccagctttgttctgttgctcgtgaggagctgcgttccttcggaggagaagaggcaccctgatttttagaattttcagctgttctgctctggtttctccccatctttgtggtttatctacctttggttcttgatgatggtgatgtacagatggggttttggtgtggatgtcttttctgtttgttagttttccttctaacagtcaggaccctcagctgcaggtctgttggagtttgctggaggtccactccagtccctgtttgcctgggtattaccagtggaggctgcagaacagcaaatattacagaacagcaaatgttgctgcctgattcttcctctggaagcttcatctcagaggggcacccagctgtatgaggtgtcagttggcccctactgggaggtgtcccccagttaggctactcgggggtcacggacccacttgaggaggcagtctgtccattctcagatctcaaactctctgctgggagaaccactactctcttcaaagctgtcagacagggatgtttaagtctgcagaagtttctgctgccttttgttcagctatgccctgcccccagaggtggagtctacagaggcaggcaggtctccttgagctgtggtgggctccacccagtttgagcttcctggtcgctttgtttacctactcaagtctcagcaatggcagacgcccctcccccagctttgctgccgccttgcagttcggtctcagactactgtgctagcagttcaatctcagactgctgtactagcagtgagcaaggctctgtgggcatgggaccctctgagccatgtgcaggatataatmtcctggtgtgccgtttgctaagaccattggaaaagtgcaatattagggtgggagtgtcccgattttccgggtacatctgtcatggcttcccttggctaggaaagggaattccctgaccccttacacttcccgggtgaggcaatatcccgccttgcttcggctcactctccgtgggctgcacccactgtctgacaagccccggtgagatgaacccagtacctcagctggaaatgcagaaaccacccatcttctgctttgctcatgctgggaactgtggactggagctgttcctattcggccatcttgaaacctcccctctctcacgatcacaaggtcccacaataggccgtctgcaggctgaggagcaagaaaagccagtctgaattccaaaactgaagaaattggagtctgatgttcaagggcaggaaacatccagtgccaaagaaagatgtagaatattcaacattcttaaagaaaataattttcaacctagaatttcatatccagccaaactaagctttataacaaaggagaagtaaaatcctttacaaacaagcaaatgctgaggaattttgtcaacaccaggcctgccttacaagaggtcctgaagaaaacactaaatatggaaaggaaaaaccagtaacagctactgcaaaaacataccaaattgtaaacaccatcaacactataaagaaactgcatcaactaatgggcaaaatagccagctagcatcataatgacaggatcaaattcacacataacaataytaaccttaaatgtaaatgggctaaatgccccaattaaaagacacagactgggaaattgaataaagagtcaagacccattggtttgctgtgttcagaagacccatctcagggtgaaaagacatacatgggctcaaaataaagaaatgaaggaatatttaccaagcaaatggaaagaaaaaaaaagcagcggttgcaatcttagtctttgatgaaacagactttaaaccatcaaagatcaaaagagacaaaggagggcattacctaatggtaaaagtatcaatgcaacaagaagatctgactgtcctacttatatatgcacccaatacaggagcacccagattaataaagcaagttcttrgagacctacaaagagacttagacttccacacaaaaatagtgggagactttaacaccccacagccaatattagatcgacgtgacagaaaattaacaaggatattcaggacgtgaattcagctctggaccaagctgacctaatagacatctacagaactcgacaccacaaatcaacagaatatacattcttctcagcaccacattgcacttattctaaaattgaccacataattggaagtaaaacacttctcagcaaatgccgtagaatggaaatcataacaaacagtctctcagaccaaagtgcaatcaaactagaactcaggattaataaactcactcaaaaccacacaactatatggaaactgaacaacctgctcctgaattactactgggtaaataacaaaattaaggcagaagtagataagttcttagaaaccaaagagaacaaagacacaatgtgccagaatctctggtacacagctaaagccatgtttagagggaaatttatagcactaaatgcccacaggagaaagcgggaaagatctaaaatcaacaccctaacatcacaattcaaagaaccagagaagcaagagcaaacaaatacaaaagctagcagaagacaagaaataactaagatcagagcagaactgaaggggataaagacacgaaaaccctttaaaaaattaataaatccaagagctggttttttgaaaagattaacaaaatacatagaagcctagccagactaataaagaagaaaatagagaagaatcaaatagacacaataaagaataataaaggggatatcaccaatgatgccacagaaatacaaactaccatcagagaatactttaaacacctctatgcaaataaaatagaaaatctaaaagaaatggataaattcctggacacatacaccctcccaagactaaaccaggaagaagtcaaatccctgaatagaccaataacaagttctgaaatcgaggcagtaattaatagcttaccaaccaaaaaaagcccagaccagagggattaacagtcaaatcctaacagaggtacaaagaagagctagtactattccttctgaaactattccacacaatagaaaaagagggactcctgcctaactcattttatgaggccagcatcattctgataccaaaacctggcagagacacaacaagaaaagaaaatttcaggccaacatccctgatgaacatcaatgtgaaaatcctcaataaaatactggcaaactgaatccagcagcacatcaaaaagcttatccaccatgatcaagttggcttcatccctgggatgcaaggctggttcaacatattcaaatcaataaacataatccatcacataaacagaaccaatgacaaaaaccrtatgattatcgcaatagacgcagaaaaggcctttgataaaattcaatacccaatcatgctaaaaactcttaataaactaggtattgatggagcatgtctcaaaataataagagctacttatgacaaatgcatagccaatatcatactgaatgrgcagaagctggaagcattccctttgaaaaccagcacaagacaaggatgccctctctcaccactcctattcaacatagtattggaaattctgtccagggcaatcaggcaagagaaagaaataaaggtattcaagtgggaagagagggagtcaaattatttctctttgcagatgacatgattgtatatttagaaaactctatcatctcagcccaaaatctccttaagctgataagcaacttcagcaaagtctcaggatacaaaatcaatgtgcaaaaatcacaagcattcctatacaccaataagagacacagagccaaatcctgagtgaattcccattcacaattgctacaaagagaataaaatatacctaggaatccaacttacaagggatgtgaaggacctcttcaaggagaactacaaaccactgctcaaggaaataagataggacacaaacaaatggaaaaacattccatgctaatggattggaagaatcaatattgtgaaaattgccatactgcccaaagtgatttatagattcaatgttatccccatcaagctaccattgatttcttcacataattagaaaaaactactttcaatttcatatggaatagaaaaagggcctgtatatccaagacaacctaagcaaaaagaacaaagctggaggcatcatgctatctgacttcaaaatatactacaaggctacagtaacaaaaacagcatggtatggtactggtaccaaaacagatatatagaccaatagaacagaacagaggcctcagaaataacaccacacatctacaactattggatctttgacaaactggacaaaaataagcaatggggaaaggattccctatttaataaatggtgttgggaaaactggctagccatatgcagaaaactgaaactggatcccytccttacaccttatacacaaattaactcaagatagattaaagaattaaatgtaagacctaaaaccataaaaaccctagaagacactttgggaggccgaggtggatggatcacgaggtcaggagatcgagaccatcttggctaacacagtgaaagcccatctctactaaaaatacaaaaaattagctgggtgtggtcgtgggcacctgtagtcccagctacttgggaggctgaggcaggagaatggcatgagctgaggaggttgagcttgcagcaagccaagattgtgccactgcactccagcctgggcaacagagtgagactccatcaaaaaaacaaaaacaaaaacaaaaaatcaaaccctagaagaaaacataggcaataccattcaggacataggcatgggagaagacttcatgactaaaacagcaaaaccaatggcaacaaaagccaaaatttacaaatcagatctaattaaaataaagagcttctgcacagcaaaaaactctcatcagagtgaaaaagcaacctatggagaaaaattctgtggtctagccatctgacaaagggctaatgtttagaatgtacaagcaacttaaacaaatgtacaagaaaaaaaaaacaaccccatcaaaaagtgggcaaaggatatgaacagacacttctgacaggaagacctttatgtggctgacaaacatgaaaaaagctcatcatcactgttaattagagaaatgcaaatcgaaaccacaatgagataccatctcatgcccgttagaatggcgatcattaaaaagtcaggaaacaacagatgctgaagaggatgtgtggagaaagaggaacacatttacactgttggtgggagtgtaaattagttcaaccattgtggaagacagtgcggtgattcctcaaggatctagaaccagaagtaccatttgacccagcaatcccattactgggtatatacccaaaggattataaatcattctacaataaagacacatgcacacgtatgtttattgtagcactattcacaatagcaaagacttggaaccaactgaaatgcccatcaatgatagactggataaagaaaatgtggcacatatacactgtggaatactatgcagccataaaacaggatgagttcatgtcttttgcagggacatggatgaagctggaaaccatcattctcagcaaactaacacaagaacagaaaaccaaacaccatatgttctcactcataagtgtgagttgaacaatgagaacacatggacacaggaaggggaacatcacacacaggggcctgttggggwgttgaggctaggggagggattggattaggagaaatacctaatgtagatgatgggttgctgggtgcagcaaaccaccatgacacgtgtatacctatgtaacaaacccacacattctacacatgtatctcagaacttaaagtataataataataagatacagaactgcagaatgaataagaactcaccaaccatctgctgccttcaggagactcatttaagacataaggactcacataaacttaaagtaaatgggtggaaataataataagtggtgtcactgatgtggaggtagattataaaactcttatcatatgctggtggaagatcaaaatgataaaacgaattaaaaaatcagtcagatggtttcttaaaaagttccatcaatatgcctctatcttacaaacctgcaattctattcctgaatctttatcccaaggaaatgaaaaagtaagtccacaaagagttctatatgaatatttataggagctttatttattataattcaaactgtaaaaataatttcaatgttcatcaataacaaaatgaaaaaataatttgcaacctactggtacacttgaatactattcagcactgagtatcttaaatagcatggatggagctcaaaaatatactcaggaaagaagccatgtrtattctgtatgagttcatttacatgagatcatttacatttcctccaaaagaggaaaaactaatttctgttgaaagaaaccaatgtatttgcctctggcagtggtaagggggtagcacagattaattgggtagggactcaagagagtttctggggtcacagaaatgttccgtgtggtgatgggagtttgggctccacaggtataggtgttgatccaaaatcatcaaaaaaacaacattgcagatctgtgcatctcactctgtgggaaagtatatctcaactgtaaaaagggcagaaattgcttttaaacgctcagccttttagcacatccagttgcttggagaaccagcttactcaaatgggggtctaggctggagactaggtcacaggcatagagtctctaaactttcccatggcacataatacgtttcaggttttctcagagagctgcaggttagtaatctgaggattctgacaagttgggtcaacgttcctaggaggcatgaatgggagtgcattctctaagatccctccaccccagggtccttgctttctgtgcctcttactccattgttttctgactcctctgtagccactcgacctcttcagatcccattgtctacccagccatcgccctttatgacttgggtcccactgttctttcatctcatcctccattccctcagtttcggagtggctgccgctagcagaggatggactgagagcaggagaggtggtcctgcccaggaacccatcctagagaaatggcatcctgtctgggagctagttttttagggcaggttttataagtcttgtaaagccagacacacttgatctacctggtatgttatttacagtaatactattttcataattgcttttcactctaaaagtagagccttttagctacactgtgagtaaataaaggggctggcctgggaatggtatcatgttggatgttgtttcttccctgaagtaatatatatcagttacaatttacatgttactgcagagtcctagagagagacacagagaatgagacagataccaatacatttttatgtgcattaaaaaaatctaaggccaggcgcagtggctcacacctgtaatcccagcactttgggaggccgaggtgggtggatcacgaggtcaggagattgagaccatcctggctaacacggtgaaaccctgtctctactaaaaatacaaaaaattagccaggcgtggtggcgggcgcctgtagtcccagctactcaggagactgaggcaggagaatggcttgaacccaggaggcagaccttgcagtgagccgagattgcgccactgcactccagtctgggcgacagagcgagactccgtcacaaaaaaaaaaaaaaatctaaaatgcactcttcaaaatctatgtcatttattctggaggaatgcagttggcagaaggaggaagatattccgaatttttcttgtatacatttatgtatgatctcagtttttttatggatcatagaccaattttgatattttaaaataaaaattataatctatcttggaaatttacatggttctttagaacttgaggaccgtttttgcttttcggaatattattgtacctaaaatgggaatattacaacgtcactttttaacactttgttataacaaagtttagacagcgctgggtgcccctgaattttttcccgcctcttgtgacctgtgttgttttggaatttgcagtggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcayggaggctcattctgaagcaggtaagaagtctgtggccagatatctacacatttgaacattgggatgaaaagagatrgaaaatctgactgatgcagaagccttccatgctacacagaaacttgagggtatggcaggtggaaagaagcctcagcactctctctggtggagcaatttttggcgcaacgtgcgtgggcggtgacttcaggaatggtgcaaacccacctgggcacttgacttaccactcactttgttatgaaaggggttatctcggtgttccagacaaaattccaattctaacatcaggccaaatttgtgccaaatttcacactagtgagtgtttccaggcatttattaaaatggacagtgttcattgcaatcttcagcattgcagttgctgaggtatgtggccgctgagtttgtcatcctggggaaacctaatatgatgatatttattccatctaatcctggggctatttggcagtaaataccacagaatacactatttctctggcttatttcagtcttaggtaggctctgcacacctatgcttggaaggcaggaatttcttggtgttcttgtgccttcttctcatggaacgtgcatctttggtgtgtgttgagaggaagggtagtagacttctgctttgttgcaatgcaggatgctggaacaagaggattccctgtctctactgtaagggaataagattttagcctccatccttctctaagaagcaatgtgtctttgcctccaagtactagatgcaggaccatgaactgccccgtccaccagaagcttaaggctttggcttttcaggagcaatcatctagggaactgtgcagggttttcatgtctgtcccctactgacagccaatcaccatacagcctgcataacctaatccatcatcgtctggtttcctgcctcattgttttcatgaacaaccagtagagagccatacgaaagagcttgcacatgagtctttgttccaattgtaagagcactgataggtccttttcccaccaggttttgaatataaaatttctaagaacttattaaaatattagaatgytattaatctattgtttttgcttcagcatgtccttctgcttgtgagtatactaaagagaacagtcataattctgaaactactgtcctgtttgtgtcataaattgcttcacatgtttctgcatactagtagttactcagcttgattttgtctattttcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgagtatgtctttgatgttacttgtaagaggagcaacagccaacttaagttcctcctagaagagccttgcttcaagctaacttgttaggacaaatttcccttagacccagaaggtgtgtcaaaatgtccagacaactttgcttttgatcaaagagtctgagagaataggtattttaggcttgctatcttttctaatagtctgatggaagcagaaggctacatggagctgatgaggtctttttaatataaagctcaagagatcaaatgatcaaatacttagagtgccattctacaaggctcataaaagatcaatgcactctttcacccatgcaattctatcattctaacctcccttctctgaaatgaaggctttttgccatttttgtcatgggtcacaagtaaataattcacatgtatatgagtatatatataaccaggtgtgtttattcagactagtatgtatatatatacatatatatgttcatataagttagtattcatatatatgttcatatatatatgttcatacagactagtattcatatatatatacatatatatatacacacacayatatatatatatatatatgttctagggaaacatgcaaggtttttatgtctgtccctgactgatgaccaaataccctatagcctgcacagctgcaagctgtatagccatacaatttgcaggacacacacacatacacacacacacacacacacacacacactaacwtataatataatataatataatataatataatataatataatataatataattaatatatataaacctgtgtgaacacactgggttctaagctccagttttctgaagggatatgggttgccaggagaggaagagcaaaagcaagaatgtagatgagaattaggaagtaaacagayatggagattaaaatgggcaggtacatggacaaaaaaccaggtctgacaaaaactggctttctgccataaatgactataaaagatattaaaaaacactttccacatgttggacaagagacagtacaggactgagataatttagaaaaggaaatgaatgagcgcaactccgtaactattatgactttcttcctggagaaccttcctggactgaagggcaaggaattggagccaaagccaaccacagcagtcttgctgaactgaggaaagagactggagtttgggatagctaagaaaatgtgtattttctatgctaggtaataatgagaaagaatttgtggtgaaaaggagctgaaggaatatgcatggaagtctaatataaactgcatatgcacagggagaaattctacaaagtgggacagagaaccactactggggaaaggacaaattcagggaaacagtgagctcaatggtgacgccagagctcacgtagcactgggggataccggggttctgatcagyccgaggagagacacctcattgaacatctcgggcattcagtagagaccccagaaaagtcatactttaggagtaggatttatgccttcttagaataaagactaccccagaaacaccctagtaaagcttaaaaaccaagtctaaaaggacccaaatgatctccaagtaaattaactgcctgacagaagaaaactcaaccatcactggaggtaaataacatgattacagtgctctgtaatgttgcattcacaaggagtgacatcatttaaaaatttatgaggcaggaaaaagcaattagtgtgatccataactaggagaaaaaccagtcaatacaaatagaccaagaaatagtagaaacgatggaattgacaaagaaattaaaactgtatatatgataattgtgttcaaagatttaaagaaaacatgaacatgagggaaacaaatgcagaatataaaaaaaagcaaatgcgtaaaacaaccaaatggaaattaaagaactacaaaaaagtataaccttaataaaatactcactggatggccttaatattagtttatacattacagaagaaaaagtgaaccagaagataactcaatgaaagccatacaatctgtaagacacacacacacgcacacgcgcgcgcgcgcacacacacacacacacagagagagagagagagagaaagagagagagagaaaggctgaaaaaaataaatagaaccttaaggatatcagtgaaaatagcaaaagatttaatatatgggtaaagcaagtcacagaaggacgggaaggagatattgggacagaaaaaaatactcaaagcaatgatggctgaagactttacacgtatgaagaaaatgataaactcacagtcaagaagctcaatgaatcagaaatagtatttttaaaagcaaaactctatgatttacttgggtacattatagataaatcgtccaacatcaaagataacaaggataatcttataagccagaggaaaacaatatcatttacatagagggacagtaatgaaagtgaccgatgccttctccttggaaayaatggcataacatctttaaagtgataaagagaaataaaaacagatcaacctaggacgacatgtccagccaaaacaaacaaataaacaaaaaaaccctttaaaataaacgtgatgtaaatacgtattctgccacctccagaggaaacaagsaaaaaaacaaaagaatgtttccaaggcaggcttctgtattaaaagattttaaggaaagttattcaggtagaagaaaaataataccagatgggaactttaatccatactaagtaatgaagagccctggaaatggcaaatggcaatgtcaatataaaatactcttatttatctaatttttaaatgtatttaaaggacaatttgtgatattaattaaaataataggaatatattgttgtttcaacgtatgtagtagtaaaattcataaaaacagtagcacaaataatgcagatgataactggaagtatactgttaatgagttttttgcattatccatgaagttatataatattaatagatggttgaatgtgatagtttaaggtgggatattataaatcctaggacaaccaaaaaaatttaaactgagaggaatggatagtaagaggaatagtccttttatgcaaaagaaggaagaaaaagaggaataaagaatataaaagatatggtgtaaacagaaaatacatagcattattgtagacacaaactgaactaccttatgagtatattaaatataaaaggattaagcattacaaataaaaggcagagattgtaaattgaataaaaaccacagctaagtgtgttctttttagaataaatactctttaagtgtaaagatctactttaaacaccaaaatatgaaaaaggatatataccatgaaaacctgaatcataaataagctggagtggtgattaatggatgcaggcactcctaaagactaataagtgaatgtggtcaaattgaagaaacaaaagtatatacgtgctcaatgtgcaaaaactttttctgtatacatgctatgatcctttggaaaattaaagttttaaagcaatatcactgacaatagtatcaaaaccaaaaaatatttagtgataaatttcacacactatgctcaaggactatacaccttgcactagaaaacaatgttgaggaaagaattaaaagatctaaatatacaccatgcttatagattaaaagactccatatcagttctcgtgaaattgatctttggatgaaacccacacccaagcactattgcaacagtccttttttggaaaaaaaaattggaggacttatataccttaatataaagacttataaaagtacaggaatcaagacatgtggtattggcctggccccttggctcatgcctgttaccccaacattttgggaggctgagtctggaggatggcttgagcccagatgttcaagaccagccttagcaacagagtgagaccctctctctacaaaaaataaacaattagatcgatgtgatgacttgcacatgtagtttcagctactcggaatgctgaggtgagaggattgcttgactcaggaggtctagccatgagtgagcattgatcatgcctctgcattccagcctggatgatggaatgagacactgtctcaaaaaaaaaaaaaaaaaaggatatgtgttattggccaaaaaagtatgcaaacctaaaaagggatggcccaccaccagacccacatacatatatggtaaatggattttccgtatagatggcaaagcaattcaatggagacaaaaatgttttacaaaatcattctgaaccatttggatatccatgatacaaaacaaaagcagaacttgacttttgcttttcatctcaaattattttgatatctcttccacctaagtgtcagagctaaaactgaacctgaaatatgaaagttccatgaaaaaatataaaatcttcacaaccttggagaaggcaaacttttttgaggcaggagtctgtaaacactcactataaaataaaacaaattataatgtgggctttcatgaaaactcatgcttaccaaaagtcattgttaagaaaataaataggcaagtaacacatgagaagaaaaatgctctctgtccatatatctgacaaatggcttgtgtccagaatataggaacatttctcccactcactaaacagaggacaaacaactaatgggcaacagattgaataggcatttcttggggatagatagatgtacacatagccaataagcacctgaaaaaatgtccagtatctcagccatgaaaaataaagagttataatcatcatgagatgtcaccaaacacccaatggacatggatattattaagaagacaccacagtaactgatgtcactgatgtagagcaaggatgtgaaactctctcatatgctggtgaaagtgcaaaatgatacaaccacttttgaaatcagtctgatagtttctccaaaagttcaataaatgcacttttaccctacaaacctgcaatcctgtttgtgaatatttaccccacagaaatggaaacataagtccacgaagacatctccaagaatattcatagcagctttattttttataaccccaaactgtagacaatttcaatgtcaatcaataagaaaatgaataaataatttgtgaactagtcatayaatggcatactgttcagcaataaaagggagcatgtttttgatactctcaaatagtatggaagatgctcaaaaatattacattaaagaaagatgccagataacaaaaatgaacattatgtatgagtctattgatgtaaggttccagaaaggtaaaactaatttctggtgaaagaaaccaatatcatttgcctctggccatgggaagagagtagcagagattgattgagcagtaaaacgaagtttttttctggggtgatgtaaatgtcctgtattgtgattgaagtgtgagttacacaagtgtacatgttcatcagaagtcatcaaactacatctaagatctgtgcatttgactatacatgaaaatatacctcagttgaaaatagatcaataacctccctcatatactatacttgctaacacagccagctgcttggagaaccagcttgctggaatggagaatctgggcttgagactgggtcacatgtatagagtctctacagagacaatgttgcattcccacggtacataatacatttcaaggtttctcagacagccacatgtcatgaatgtgaggattctgagaggttggagcaacattcctgggaggaacgaaggggagcacattctccaagatcccccaccaccggggtcctcaccggctgtgcttttttttttttttttcttgacagagtctcgctctgtcgccaggcaggagtgtaatggcccaatctcggctgattgcagcctccaactccagggttcaagagattctcctgcctcagcttcatgagtagctgggactacagatgtgcgccactgcgcccagctaatttttgtatttttagtagagacggggttttgccatgttggccaagatggtctcgctctgttgacctcgtgatccacccgccttggcttcccaaagtgctgggattacaggcgtgagccaaagcacccagcctgtgcctctyacttactcaattgtttttctgaaccctccatagctggtggaccttttcagatcccatagtctagccagccctctcactttatgccttgggtcccactgttccttcatctcatcccccttctgtcagtcccgcagtggctgtggccagtagaggatggactgagagtaggagaggaggttctgcccaggaacccatcctagagaaacagcatcctgcctgggacctagtcttccaggtcagcttttataagtcttttagactcaaactcacttgacccacctgaagtggtattgacaataatgctattttcatggttgtttttcactgtaaatgcagagccttttagctacacgactagtacagagagtaagggaggctggcctgggaatgatatcatcttggatggcatttcctccttggagaaatatatgttagttccaactcacatgttactatacagtcctgtagaaagagatacagagagttagacaggtatagacgcatttgtatatgcataacaatctataagacacacatcaaaatccgtataccggttcctctaggggtatgtgcttggcagaaggtagaaggagggtattctggttcctttcttttgcacatttatgtatgatctcagtttttatatggagcattgatagggtttggctatgtccccacccaaaatctcatcttgacttgtaatctctataatcctgataatccccatgtgtcaagggcaggaccaggtggaggtaactggatcatgggggcagtttctcccaggctgttctcatgacagtgagagagtctcctgagatctgatggttttgtaagtgtctggcatttcccctacttgcacttactctgtcctgccgcctgtgaagaaggtgcctgtttctcccttgccttctgccatgactgtaaatttccagaggcctccccagcaatgtggaactgtgagtcaattaaaactcttttctttgtaacttacccagtctgtctcgggtatttcctcatagcaatgtgagaacgggctaatacaagcatatactacttttgatattttaaaataaaaattatcatctatctttgaaaggcatgcacaaatgggaagttgaggaacatttgtgttgtggcaattgtatgatacctttaatgggaatatttcaaagacacttgttaagactttgttagaacaaaatgtagagggtgctggatgtccctsaatattcttccgcctcctgtaacttgtattgctttggaatttccagtggcctgacaatgaactactgcaggaatccagatgccgatacaggcccttggtgttttaccayggaccccagcatcaggtgggagtactgcaacctgacgcgatgctcagacacagaagggactgtggtcgctcctccgactgtcatccaggttccaagcctagggcctccttctgaacaaggtaagaagtctgtgtcttaccttgtctagcacatacctctctatgtgcttggacaacgggatgaaaagacatgaaaaaccacactgatgcagaagcctttagtgctacacgggagctcgagtgttggttgaggttctgccatgaccaaggaagtctcagtgccgtccctgggaaagccagagctgtgatttttggcacaacttgtgggagtagtgactttaggactggcgcaaaacctccagggtgctcaacttaaccactcaccttattctaaaatgggttatttcagtgtcccagtcaaattcctattctaacatgctgtcaactgtgtgattatttccaagccaataagcatttccagtaatttcttaaaatagtgttcattgcagtcttcagcgttgtggctcctgaggratgtggcccctgattctgtcrtcctagagaagcctgacatgactgcattgattctgtatcgtcctgggtctatgtggctgcctggctgtctgtaatcatctgttttatttttatttttttctacagaytgtatgtttgggaatgggaaaggataccggggcaagaargcaaccactgttactgggacgccatgccaggaatgggctkcccaggagccccatagacacagcacrttcattccagggacaaataaatgggcaggtctggaaaaaaatgtaagccactttgatttggactctttttccctttgctgacaaatcttttcaaacagaagaggggcagaggaaaatactggaaagacttcaggaggctaagcgtaattagccttagcatggaaagtgcaagcagcacaggccagcaaagccccacgcgtgtgggggttctcaggcctcttctcttttgacatttctttactgtttccattgttgggtgctgtttctcgtttctagtgcttgtcctctaagccaggggtccccactccagtactggtactggtactggtactggaactggtaattatctgtggcctgttaggaactgggctgcacagcaggaggtgagcttcgggggagcaaacaaagcttcatctgtattttctgctgcttcccatcactctcatagctgcctgagctctgccagctgtcagatcagaggcagcattagattatcatagcacaaaccctattgtgaactgcacatgtgaggaatctagattgcatgctccttatgagaatctaatgcctgatgatctgtcatgcttccatcacccccagatgggaccacctacttgcaggaaaattagctcagggctcccactgattttaccttatggtgagatgcacatttatttcattatatattacaatgtaataataattgaaataaagtgcacgataaatggaaggtacttgagtcatcctttaaccatcgccccctcaccccaggtgcacagaaaaattgccttttatgaaactggtctctggtgccaaaaaagttggggaaccacactgctctgggttctagtagtcagagatgccctctatgaggcttaagtcagatttttctagaaaagatttggatgggccatcaggtcaccatgagacttcccttagcctcatgcattctctgtgatggtttactttggggcctatgaatagggaagactgagatataggaaaaaccaaagtgtctgtgttcccccactctcacacccatgtaacataacacttctcacaccagatatggggggatttctcctcacaccccaagcgagtctccagcagataccagctgggtgtcctacaatgtaactcggtcctgacactctatctggagacagtgtcagatcccacaagttaaggctcagtcctacaagactgccccactgcagatgccaatcccaagttscaggctgtgacctgtacttctgcccagctggataaagatctgtttttctatatgaccctccatgggtttgattactttgctagagtggctcacagaactcagggaaacacgttacttttatttacccatttattataaaagatattaaaaaggatcctggtgaacagccaggtggaagagatgcacagggcaaggcacgtgggaaggggctcagagcctctatgccctctccagtgcaccagtccccagtaccctaagtgttcagcaacccagaagctctccaagtgcagtcttgttgggtttttatggaggcttcattacagaggcacagttgattacatcattggccatcggtgatcggctcaccttcggcccctcttccctccctggaggttggagggtggggctgaacagttccaaccctcaagtcacatggttggttcccttggcaaccagcccctggggctatccaggaacccaccaagagttgcttcattgcagctcccttcacccaggaaactccaagggatttaggagctctgtgttaagaactggggggcagagacccaatatacatttcttattctatcacaatatcacaggaagctaaggatgatactgcctttgtgtgtcttggctgtggatggtgcataatgcatggaagtaagcatttctgaatcaacagcaaacaggctttatcaggtagaagacccctcagcgccccagggacaaagctcatcaatgatgtcccactgtcctctgaggctctagctctaagacctccagtgggtcaagctcctggagaagtggcacattctccaaagacccttcagggtcaccacaccctggttaagggtgtggcctcataactccttttgactatgactgatggcttacagcatagaaagaaataactttgtcaaaaaatataataatgatagaaaggaagaaggaacgctcccttttgtcttctaagaatagatgtgaaatgtgtgtgccttrgaatatcttctccctctcctgctccacgtgagctggagcttacatgcctgcttgttttcagtactgccgtaaccctgatggtgacatcaatggtccctggtgctacacaatgaatccaagaaaactttttgactactgtgatatccctctctgtggtaagttgccttctgttttggtaaggaaactgcttccttaatatggatttggaaaaaaaaaagcaaaaaaaacagaaaatggcttttgagctgagtgcttctggggaggagatggctgccctctccaccagagcctgcttttcatcatggccaccttgaacctgccctactattggccccatttgttaggaaaacacccgcccctcccaccacacacacataaataaaataaatgtcaaattcccaaagggcaaacttagaggtgatctaatcagcccgggatagtcccaccgaacccttctttgtctagcgtgggatgcatgaaaaacaaatttagagtcattatgatgaaaaactgtcctcttctgcagctgagaagaaaaaaaaaatacgagcagcaggaaacagctaagcatgtaatgcacattgtaaacctcagatggccatcctaggaaatcaatgaagggtagtgcagctctttagccccagatggcctttctcgtaagattactactcatgagtcccattagcgacattgcttagagactgcttgttaggttccttcctcattgctctgagactcttattgggagtatgaggcttggatcaggggaaggggaattgacattagatcttaaatgattggggtaacaaatccatgggggaaaaaaagccacttgtacttgttccctattttcttcctgctgaccaatcaacttgtctgtccgagttacagaacaccaccctggacttttcttttgtgtaatttggttgcttgtggttgggtctgccatgtgaagggaccttgagctgggggaagaaggttggcctccaagtccactgaagaccagcatcctgagattgcctggggaggtggtacagggcagtgatgaagatcatgggagccacactgcccatcgtcacatttgggccactcctggggagagcaagagggaagaaggagaggttagggtgataggaaagattctacttggccaatattattataatgtggcattgtggtctctggatttagtgtgagttgatagctgacttttttctcgagtgggtgcttttgttctattttgtcggtgctattgcagaagcatcttggtggttcctctacctcaaagtctcttgatggggtcagttccagttctccgcttctggccccatctagtacacgccactgcctctcactgcctgggctctctatccttgacaggctgccttgaatttaagcccagtctgacttacctgcctcaaacacccacagtagtgcctgggactcatgcacctttgactcccatggaagggaagtgcagtagcttcccaggtgcaattctgctgtcctcacccacattgaggatgtatgagaatcaggttcttagagattggagaaagaaggaagaatgggaacaagatttcttccaatggactgtgaggttccccaccttactttgatgtaagacaagtgaggttaaccccaagcctggtgaggagggttcccatcagacacttggaaatcctgaggactgtttcctgcagaaggatgtggttggtgggatattcaggtttgactcatgattgagaaagttagagcctctggttggagaaagagtttaataactatttcatttccaccaacacattcagtacgaataataaataagtaaaaataaatagaaacattcagttttattttgaatagtaggagtagggtataatttctgtagttactcttttagtacaatgatgcatgtttactgtatgtaaggcatactagcagaaattgagctcagcactagaaaagatgattgcattccatgccatgcttcttttttacaaaagacttctatagatagattctcaaaacaacccacagcaaatgaaaagttatttggaaaactcaggttccagattcactggagtgtagaatctctggttggttggggaggaatttcctcttgcagttgttattaataattatatgaataattattaactatattaatatttatagttttgaagaccttgaagggctggagacaacagagaagcatttttgaacaccctctgtagcccctgcactgttgtaggcattgatgggtggtaccaaagatgggacactttccctacctccagagaccttgtgggcttgctgcagagagaaggcagggaggaggaaaagaagaatagaggcacatgtgtgtaaattacccccacagcagtcagttagtcatgggaggctccccagaagaactgtcctgaagctggctgagagaaggcaacatttcaacataggacagttatccttgctacataaaatcacatacacacatgcacatatgtccacacacagagactcacatgcaaaagaatcctttgtgcctttcagtaaactttacatggtttagaaagaacttatatttccttgaaaggagagtgtcctttgttgtttactaccactttttaaacttagaaagaaaaatctaaagagtgtttatsattttaccatttaatttcacctttgagatgtgaaaaactagtgcttggaattcgtcctgaattaaacgacacaattgctaacttggactcaaatgcgacttcttttcccaccttgtgccacagcatcctcttcatttgattgtgggaagcctcaagtggagccgaagaaatgtcctggaagcattgtagsggkgtgtgtggcccacccacattcctggccctggcaagtcagtctcagaacaaggtaagaacaggcccagaaaccatctatactgtccttccatgtaagccccacaaaacccttctacatttacacagaacccacacagctgatgcatcaatacctgcctctctgttttctgaaggaggaaaaaatatagaaaaattaaaaaaagttatattattataggttctctacttggaaaatagccaaaatacaaatctttttcttgatctgggcagttccatcaaaatctgtaggcacagtgatttgcaccaagttccaatacttttggaaaatattgaagatgctctgagggtttctatggatatccattgtctcactgtcagatgaaaagaaagggaagtttttagaaatgtgacactttgcagtgagggaggacaagagcaaacttacctacagtctatcacaggcacagatttttttttacacttttgtgaatcattgaattcaatgccgaggctattcatctattcacaaacacatgaacaarttatgggttgtgatccccataaatgaagagtaatcagtccgaacccacagaacctggacattttgggtatcgtttcagtggaacatgcaattcgtaagttcagtttgcttgggtgtctcttaggaagaacacataggacacagacccatctgcctgcatgttttgcttcctcatctcctttctacaccagggcacctgtgctcaattgctgttctcctctaaagagacttccttctgtaagtttgtgaaatgccatcgacaaacctgatcgcatcgcatttcactctgctgttgagttgatttttctttactttatcgtttgtaacttcttgctctacagagctttcaccttccacatatttcagattcattctttcctaaactgtgtggtggtctatgtcctcactgactatcaacatactgccatcatgcacttcctatctctattcctcttcgttgcaatctggctccaagtggctcacaccattattctgatctatcaactgcctacacagtcctagaaagtaagtgagtcaagaaacatcccccaaaagtaaacttttcaggtaagatcagaagaccctcatgagtcactgctgctcaggatcgtatctggctccttgaagagtgaccttgcatagatcttgtcataaaaaatgaaagagaccttgggaaggtcttgggctggtcacttttgtcagagtccagggctgtggggtgaaagccrcagctatagagcttcattctggagtcacttagctttgctctcctggggacaggctgtgcctattcttgcctcaggcatcaaaaaaagtggcacagatgggcccttctgaaaaatctcactactggagcacagctcgaagtttctactatcctgacgttgggcggtagtcctttgctttgggaatatgaacatgatcaaaactgagtgaacttgtcttcctggctttctgtacaatgaagtagaacaaaccatccaatttgaccaaagycttggcatgttttctttctaggtttggaaagcacttctgtggaggcaccttaatatccccagagtgggtgctgactgctgctcactgcttgaagaagtaygtttaagggaaaactgacatggggtcttatcttcaagacttttttcctccctctcttcctccatcccttctttcttcccaccctccccttccttcctccccacctctcttccttttctggaaggaacactaggaaccagggaatgcatgcagaatcctgaggcagaatttccagggcaattggatgagagaggagggaagtgtttctagagggaatctgcagagggaagacccagtgcaagtgattttttggacctgtataaaccgcaggacagagctgttcactaccagaggcatcaatctgtattgcattgctctagagcaatatctgaggctgaataatttataaagaaaagagtttaattggcacatgtttctgcaggctttacaggaagcaggatgctgtcatctcctctgcttctgtgtgggcctaaggaagattacaatcatggtggagggcaaagtgggagcaggcatgtcacatggccagagcaggagcaagagacagagagagatggggtgggggtgctgcacaataccaaatgaccagactttgcaagaactaagagtgagagctcactgatcaccatgaagatgtggcccaagccattcaagagggatgcacctctatgatccaaacccctttcacaggccatagctccatcactggggactacagttgaacacgagatttaggtggggacaaatatacaaactatatcacagtctctgatgaaacagattgagaacagaccttaactgtcagtttccagcaaattgtgaattttgtttcttgccactcataagtcactgattctgggtggccgagggtgtcagagggacagcgccaagttcatggcacagaggatacctgaaggggctggaccatatttttctcttgacatcctcatcttttctaggtcctcaaggccttcatcctacaaggtcatcctgggtgcacaccaagaagtgaacctcgaatctcatgttcaggaaatrgaagtgtctaggctgttcttggagcccacacaagcagatattgccttgctaaagctaagcaggtactcgctcacctgtggtcttcaccccacgctggtgaagatatttgctttatgtctgggttttatgggccatggccactgcatggcagtggggaggaactgtctatcacatgaaaggctcaagggctttggggacagcatcaatcttcaaccccagccctgccacatgttagttgtgctctttaaaaaggcagaaggattcgtttcctcacgtggaaaaagagataccctgttacccgtaaaacttacttaatgttcaccagttcatccacattcatgatcagggaaaggttgttattccaggctaactattctcctttcataataatatgctggagagaatcaaatgagattgcatttcaaagcgcttgaaaaaccaccatatcgagccatgcttagtgtgggcgcctctaatcactgctattcaggaggctgacgaggaagaattgcttgagcccaggacttcaaggctgtaggcagctatgattgtgccactgcactccaggctgggtgacagatcaagaccctgtctcaacaaaagaaaagaaaacaaaacaaatgaacagaaatattccacaatgtcaaaaaaaaaaaaaacccacacaacatacaatttacaaatgcaaataataatattattgttgtcttctttgattttctctttcctggtgaaattttgttttattaagcctgacaaagtgatacctttgcttacrtcacttaaagttagtctatttggacctaggtgacagtacaatcagctaagaaacagtatttgtaggagaggcaggtttgggacaggtgacaaggcatgtggggtgctcgctgtgctggtggctctggaaggcagggtgtcaatgcagacagggatgagcatggcctggttgggaaggcatggggcaggcaggagcctgagctgctctcctgggcctggtcacaagcccatggcagcttctctgggtctgtgaactgaggggtgatgtcctggaatcctctgacactctaggaaggagagaagggcctttctggctcagcctttataaacagtagctgatctccctcttgctccccagggtcctccccaccatcccagcaaatgtgcaaatacaagatctctgctcctcatggtcctcagagagctggggtgttctgatggcttgaacaagtcacttaggaaatgtggggttttggaggcattctctgataggctgatacgttttgagtttagagttcccaccgcacatccccacacccctagagtctagggcatttagtgctccatgagggaacctgtagagtgaggacatctgcatcacaggctgggccttctagtgtccagaagcagaaagtgtgtctgcttcaaagttggtgctaatgatgatttttggtcagaatacggcatttctcatttccattcctttatccccttgaacttactaaagtagaatcaggtctaaaaaccagagttctaatctttaagagtccctgggattctaaggtatatgaatgtccttggaaaacaataccatttagttcatgcaaggtgcttatttcccatcctctttcatttgatgtctagcattttactgcattcttaccaccacggtttagtaacattcacgaggaggaagtggaggatccagatggagcaacttgctctgggcacacaaggcatttgcaattttataccctcttgatgatgtctcagccagacattctgcccagtcatcaatgccctcttcaattaatatgaaaggacacacttggcatgagattccaatcgtgcacagaatatacatgagaagtgtgcctttgtcatccctactttcaaaggctaaggccaccctcagtttcttgcatgcaactgatgcctttcaaatgaaaccttacatctgtgtagtccataggcaaccacaggcaaatgtgagggtgaaacgctgtgttctacattgttctgtgtcagtgaagcaaggcagtgccagctcagagggctctggggcttcaaggcagggatgcctggttgtaggtactgccacttccagctgggcagtgaaacataactgctaatactttccttacaggcctgccgtcatcactgacaaagtaatgccagcttgtctgccatccccagactacatggtcaccgccaggactgaatgttacatcactggctggggagaaacccaaggtgagatcaattccattgcccacgtaacaaattgtttttgaccttcagtgcatgttacaaaatgagcattttggagatagttgtacaaattcctacccatgaatgtggtctacccactcctgactttgcctggacacctgtctatgtctccataatcagtcttcaagggacttgggcaaggggagcggtgccatttccttgagtctctctcttttttgttttcagaatcttttaattttttttgtaatgattgtatgtttcccttacaacaaaaacaaacaccagtagaggtctttgagtctcttaatcataatttcagcattcatattgcttccccaggtaagtggggttttgacccagccctcaagttaagggtgttagattatttttcatgtgaaattagacagactgcgtttctaaacatggtgcaaaacagtaacgacaaaagttgtaattaaactattcttcttcccaaatacccacatgtctaatgtgtgtgtgagggtgttaggcaggggacctgaagctgggggagaggcagacagttcccatggccccaagtctaggatggcatttggtattggttgatgggtgagagcaagagagggaatatttttgtgcatgatgtggtatcagcacctgtactacattttatggattccttcttctctttgcggtatgccctgacaataattatatccgtcagccttacccccttggcagtaggaaaactgaaactgtcttaaagtctcagctctactttctcagaggtgcaggcaagggcactgggagtctggggccctggaaaactgttctgactctgccacttgccagatagacctgaactagacacgttacctctttgtaccacttggctctaatcccttatctgtaaaaccagcattttcaaatggtgctttgcacatcagccttttgcataagctttgatttgataaaatgttttttgtgtttttaaaaagattaaaaaccacaggtttagataatttcaaagtaggcttccctttttctgtcattttcctattatttttaaaacctcacctccttgactccttgttccctttttctgcactgctgagtctgggagcactgaggccaggtaaaaggaaacttggcaaatgaggggcacctatgggtgtgggaggctgctcctggtgtttgcatattttaaartttaaatgctacaaaccactgtgagttaggtattattgttcctattttaccattgaggaagctggggctcagagaaggtggagggtggtacagacaaacctgaattggaaccctggctcctgcctatgggctgtcaggacttagaaaagtcgtgagctctcgctgattgtttcctcagctgatgtgggctgcagggctgttatgggggaaataataagaaagtgcatcaagtgctgagcacatcctaagcactccatcatggcagctcctactactaataaagaatagaattatatctaacatgattctttcttgcaagtgacagaaaatccaactcaaattggattaagcaaaacaagggaaattcttagtgagctgcaaagttttcaggctcacatgatggccccaaatcccaggtcctcccaatcatggagtaggcactatttgggggcacaaaggtgacattcccatggctgcagatgctgtggtgctgtggctgtaccgggaaagaataagaaaggccactctcccaattatgtgaacaatagtctgcccactctgagaagtcaaacttgggtcaccgtcctgcccctgaacccatcactgactggctctgacctgcaccaattgttccatgttggaggtgaaggcaagaccccactaatacccataaggggcaaaagttagatagatccttcaagaggattatgggaggtagggcaaaaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccatctccaataccaccatcactgtaaccatcatcaccaccaccatgatcactatcaccatcatcacaatgatcactgtaaccatcattactacccaccaccatcaccactactccaccaccatcaccattatcattaccatcaccattatcaccaccatcatcatcaccagcaccaccatcatcaccagcaccaccatcaccatcaccatcattaacaccatcactatcaccattggtttaatcatcaccaccatcatcataaataaacatcacataaccagggtgtagctgggtgttgaccccagagcccactcactgtttcctctctcccacccccatccacacatttctaaccaccatcctgcactgggctcccagtctcctctggtctcacccacatgtccactgagaaaaggattttcagaacaccaactagaccaggaggagccacatacataactcaggcctgcttatcaactttctacatgttaataatgacatcagatcaatgggtgttctcagcttctcagaaggaggtcaaaattctccccctctccccttcatgtgtccagaccttcccggatttggatgtaccaagtgcagagtggtgttgaggccaaggggctcatccatgtaagtctcatctgcaatcactgggctgatcccgtggccctgtctccagggcgccatcagagagggcttcaatcctcaggttacctgtggcccaccctgccctcagaggtgccatctctacattggccacgagatggcagcacatactcatagactgcattaatttcccagcaactcctggtgggttttccctcttatcaggatgtttgccttgctcagagagcaaatctgagagcagtgacacctaacttaactttcagcaaaatattttgagaagggtgcccctttacacatctgtgcagtccaggtgatgcatcccatgcccaatgctcggtagtcaggaggagcttcctccatgcagctctgcggaagagactcttccacgctgctcatgtaaactccagattcggtgtcagttttctgacaccgaagacaatgatctaagtgcagtcaagggctttggggaaagcaggagagagtgcctcagttctagcctgtgccatgcttgcaaagttttgcaaaattctaatgagagctgggcttgcaacattggaaacttggattatttgtgagagcactgagaaatccctgggcatgtccatctggaaaaacagcatttcctctggcactttagcagaggttctgtttcaatttggcgaaggaaattaagcagtttttcacaaaagaagaactacaacgaggagaattgtccctagtatttcttctccctaattgtcaaggaagtgtaaattagaaaatgaatcaggacaatttccacctactatgttagctaatattttaaaaattgaatatcacaagggtgaggcaaagtaattgttttccagtgacattttccactgtcacacccttttagagaataatttggcaatgttactgtgagatagaaatatgtctatataattatgggaactgagacttcagaaagtaataaggaataagaatgaaatttatgaacaaacatgtggaaggttggaagcaagagtggggccaacacgcatggggaggaagcatttgggcagygactccgcagacccagactcaagctgagctatacaacctccttacgcctcagtttcctcaactgaagaacaggaatgacaagtgcctgtttcataggaccgttgtgaggattaagtgagatataccacattatgagcttgtgcctggaaaggttgattcttagtaaatgatgactattcttttttattgcaataaaatttatacaacatagagttactattttaaccatttttgcaggtaccactgagtggcattcagtacattcacaatggtgtgcaaccgtcaccatatttccaggacatttttctcatccccaaaggaaacctcatgcccattaagcagtcactcctcattaaaatattagttatgaagactgtakcatttttttaaaaactcatgatataacattgattgaaaaaatcagtataggaaattgtgcattatgatgtaatagtaaaagaagcatataaaaatctgaaaaaagtatataaaaagaatagcaattgtatttctcagactctctttacattgtaaaaatcattttgatagcttcaaaagaaaagcaaaaagtacacaaacaacaaccaaccccaaagcagcatgacaaagcccagattgttgaatccaggtcttgggaacataaaatcttatatgacatttgcactttaatgggtcagagagtccagtggcattgggagctgccttgtgttctgcagcctcacggacagacaggaggtccagctccactgctctgttcttctggaatttcctcgtgaacaagctttggcctcagtaaccatttctttcatctttttaaacacaggtacctttgggactggccttctcaaggaagcccagctccttgttattgagaatgaagtgtgcaatcactataagtatatttgtgctgagcatttggccagaggcactgacagttgccaggtaagaaaagatcaatagatcaaagtcttgtgctctcccgtctcagtctcagtcccttagacgtcagtcccaaagtggcaaattcaggaaggttttgtcagtggaagaccccagtctaagtgttgctcagaaactccccagatctgtccctgaatgcatattcagatcatctaaggagacgtcttggggcttgagttccagatccatagcaagggagccgtaagtgccataactacctcaggccactcaccttcctggtgtgtgctggtcaccagtgactgaagtggtggcttttccagtagagaggaaggtagagggtacaggaccgagacaaattacacacacttaacaatgatgtccaggctagcccagtctaaaggaaacaccaagttaggaagcaatgcatgcaggattcacaagggattattttttttcccaggaaaaaactaagtgatgtggttttgttgaatagactttgctaagtacttaagcactgcagatgcttgagtaatatgctcataagttcctttctgatttgaattactgggaaaatgtacatatggataagagaaggatggcatcccatattaaaaggttggcagcttaaagctcacatgaattttcccctacctctgtttagggtgacagtggagggcctctggtttgcttcgagaaggacaaatacattttacaaggagtcacttcttggggtcttggctgtgcaygccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttgaattaattttggttttggtcttcaaaattttcatgctcttttcatcccatctatttttatttttattttttagactttacgtcctggggtacatgtgcagaatgtgcaggtttgttacatagatgtacacgtgccatggtagtttgctgcacccatcaacctgtcatctaattcggtatttcttttagttctatccctcccctagccctccaccccttgacaggcccaggtgtgtgatgttgccctccctgtgtccatgtgttctcattgttcaactcacacttatgagtgagaacatgccgtgtttgtttttctgttcttgtgttagtttgctgagaatgatagtttccagcttcatccatgtccctgcaaaggacatgaactcatccttttttatggctgcatagaattccatggtgtatatgtgccacattttatccaatctaacattgatgggcaattgggttggttccaactctttgctattgtgaatagtgccacaataaacatacgtgtgcatgtgttttcatagcagaatgatttataatcctctgggtatatacccagtaatgggattgcagggtcaaatggtgtttctggtgctagatctttgaggaatcaccacactgtcttccacaatggttgaactaatttatgctcccaccaacaatatcaaggcattcctatttctccacatcctctccagcatctgttgtttcctgactttttaatgatcgccattctaactggcatgagatggtatctcattgtggttttgatttgcatttctctaatgatcagtgatgatgagcttttctcatatgtttgttggctgcataaatgccttttttggagaagcatctgttcatatcctttgcccactttttgatggtgttgtttttttctggtaaatttgtttaagttctttgtagattctggatattagccttttgtcagatggatagatggcaaaaattttatcctattatgtaggttgcctgttcactccgatgatagtttcttttgctgtgcagaagctctttggtttaattagatctcatttgtctattttggcttttgttaccattgcttttagtgttttagtcatgaagtcttctcccatgctatgtcctgaatggtattgcctaagttttcttccagggtttttatggttttaggttttgcatttaagtctttaatccatcttgagttaatttttgtataagtaatgcccttctttgtctcttttgatctttgttggcttaaagtatattttatcagagactagaattgcaatccctgcttttttttttctttttgctttccttttgcttggtaaatattcttccatccctttattttgagcctatgtatgtctgcacatgagataggtttcctgaatacagcacaccaatgggtcttgactctttattcaatttgccagtctgtgtcttttaattgggggcatttagtccatttacatttaaggttaatattgttatgtgtgaatttgatcctgtcattatgatgctagcgggttattttgcccattagttgatgcagtttcttcatagtgtggatggcctttacaatttggtagtttttgcagtggctggtaccaattgttcctttccatgtttagtgcttcgttcaggagctcttgtgaggcaggccttgtggtgacaaaatctttcagcatttgcttgtctgtaaaggattttatttctcctttgcttatgaagcttagtttcgctgggtatgaaattctgggttgaaaattattttcttttagaatgttgaatattggcccccactctcttcgggcttgttgggtttctgcagagagatccactgttagtctgattggcttccctttccgggtaacccaacctttctctctggctgcccttagaaatttttccttcatttcaaccttggtgaatctgacgattatgtcttgaggtggctcttctcgaggagtatctttgtggtgttctctgtatttcctgaatttgaatgttggtctgtcttgctaggttggggaagctctccttgataatatcctgaagagtgttttccaacttggttctattctccccatcactttcaggtacatcaatcaaatgtagatttggtcttttcacatagtcccatatttcttggagcctttgtttattccttttcattctttatcctctattcttgtcttcttgctttatttcattaagttgatcttcaatctctgatatcctttcttttgcttgatcgatttggctattgatacttgtatatgcttcacaaagttcttatgctgtgtttttcagtcagatcaggtcatttatgttcttctctaaactggttattctacttagcaattcatgtaaccttttttcaaggttcttagcttctttgcattgggttagaacatgctgctttagctcggaggattttgttattatacaccttatataatagcctgatataactataagatttttttgtaagcaccatcgtaaccacaaagcaaaaacctaaagtagatatacaaaagataaaaaggaatcaaagcataccactagagaaaatcacttaatcacaaataaagatacgaagagtggaataaaggaacgaagggtctacaaaacaaccagaaagcaattaacaaaatggtgatagcagatcttacctataaataattatcttgaatggaaatggattaaattttccaataaaaagacatacagtggccaaatagattaaaaaataagatccaactatatgatgcctataacacactcacttcacctgtaaggactcaaacagactgaaagtaaagggatggaaaaaatattctatgcaaatggaaacaagaagatagaggggtagttatacagattgagtatcactaatccaaacatctgaaatctgaaatactccaaaattaaaaatgtttaagtgccaacatgatgttcaaaggaaatgttcttcggagcattttggatttttgtgtttagggatgcaaaaacagtaaatatataatttgtattagtccattctcacactgctataaagaatactacaaagagactgagtaattataaaggaaagatgtttaattaactcagagttccacaggcttaacaggaagcatggctaaggaggccacaggaaacttataatcatggcggaagatgaaggagaagcaggcaccttcttcacaaggtggcaggacggagtgtgagtgtgtgaaggaggaactgtcaaacacttataaaaccatcagatcttgtgggaactcactcactctcacaagaacagcatagggaaaaccgcccccatgatccaatcccctcccactgggctcctcccttgacacatggggatcatgagggttacaattcacgatgagatttgggtgggacacagccaaaccatatcataatgcaaacattgcaaaaacaattcaaaattcaaaacatttctggtttcaggcattttggataagggaaactcaactcaacatgaggtaaagcagactttaagtcaaaaactgtaaaaagagacgaagaagaatgtaataataaggagatcagttcattacaaatatatagcaattataaatatatattaatatatatacccaaaattgtagtacctacatatagtaactaaaacaaacattaatagatctcacaggagagctacactgtaatataatcatagtagcacacttgaatagctccactttcactaatggacagatcatccagacagagaatcaatatggaaacacgagacttaaactacactttagccaagtagacctaacagaaatatatagaacattccatccaacagcagtagaatacacattattctcaagtgcacagggaatattctccagaatagatcatatgttaggtcacaaaactagtcaaaaaatgtaagaagattgaaatcatatcaggttttttttttagatcataatcgtatgaaactagaaatcaataatgggggaatattggaaaatccacaaatagatagaaattaatcaatatgctcctgaacaatcaatgagtcgaagaagatattaaaagaggaaattttaaaaaatcaagacatgagttcatgtcctttgcagggacatgaatgaagctggaaaccatcattctcagcaaactatcataaggacagaaatccaaacaccgcatgttctcactcataggtaggaattgaacaatgagaacacttggccacagggcggggaacatcacacaccagggcttgtcagggggtgggaagctggtgaagggatagcattaggagaaatatctaatgtaaatgacgagttgatgggtgcagcaaaccaacacggcacatgtatacctatgtaacaaacctgcacgttgtgcacatgtaccccagaacttaaagtataataataaaaaaagaaatatttgtttttgatttatatgccaatcagacaaaatgtgaaaagccctactgaaattaagtatcaccatgaaagataaattctggataattttttcaagttttaacaatgtagctttaattggagaaagctatcatttggaatgagttaatctatcctatactaaaataagtcacttgctttaaaacataataaatatgattttgaattgaaaacaaaaacaactcaagacaaaggaaaatggacacactaacataccaataatttatagtatgcagcaaaagtggttttaagagggaagcttttaccaataaacacttccattaaaaaagaagatctcaaataagcaacctaagattacacctcaacaaactagacaaagaactaactaacccaaaagttagtagaaggaaagaaataataaagatcacatcagaaatagtaaagactaaaaaactgataccaaaaagaaataaaactactagttggttttcaataaaataacaaaattgaccaacttttagctagattaagaaaaacagagaatactcaaataaaaccagaaagaggagacattacaatagatactacagaagtacaaacgatcataagagactactatgaataattacatgccaacaaattggataacttagaagaaatggatgaattcctagagcaaaaaacctacaaagactgactcagaaagaaatagaaaatctgaacagaccaataatgtgtacatgattgtatcagtaataacaagtctcccatcaatgaaaaggccaggacctaatggcttcactgctgaagcataccaaacattacaaagactaatatcaaccctcctcaaactcttcttaaaaactaaaaagaaggaatgctttcacattcattttatgaggatagcattacactgatactaaacacagaaaaataatacgctaataaaagaacattacaggcaatatccctgataaacatatgtgcaaaaatccgcaacaaaatactagaaaactgaatccagtagcactttaaaaagatcattcaccatgatcaagtgcgatttgtttcacgaatgcaagaatagttcaacttacacaaataaataaatgaaaggatggatgataaaaatgtgtatctatatatatatgttttatacacacacacacacacacacacacacacacacacagaggaatattattcagccttaatgaagaagaaaatcctgcctttgcatcaacctggaggacattataataagtgaaataagccagacacagaaaggcaaatactgtgtgatctcgcttacatatggaatctaagaaagtcaaattcctagaaatagagagtagcttagtgattgccagagccgtggaagggggaaatggagagatgttgatcaaaggatacaactgtatagctttgcaagataaataggttctggagatctaatgtgcagaatggtgactagagttaataatactgtattgcatacttgaaatttgctaaaagagttgatcttaagtgtcctcaccatatacac

SEQ ID NO: 17619 - DNA, 130349 bp, Homo sapiens
gggattataggcgtgagccaccacgcccagccctcaatgcctaaattttcaaaagacaaaatgacagaatgcaaaaaatgtatttctagaacaaatcttagagatgtagaagtagtctctcctttgtgcccctatattttcattcattgataaggatgtgtatacaattttgtaattgctagagttaagtaatttggtaatttatttaactggtaaacacttctactgtcatcattctttgcctgtgcaacagcacaagcttctccaccgttctcccaattcttactcttgccaacccccaatatgttgaccacgccacagcttcatgtgtaaatcttctcattcattcttccatttatttaacatgtatcacatatggcaaccattatattaagtactgcctaagcctcatggtctatcatccggaacagtggtccccgacctttttggcactggggaccggtttcatggaagacaattttttcatgggctgggtcaggggatagttttcagatgaaactaccccacctcagatcatcaggcattagttagattctcataaggggcatgcaacatagttccctttcctgtgcagttcagaatagggtttgcactccttagtgaatctaatgccaccgctgatctgacaggaggtggagctcaagcagtaatgcgcaatggcttgcaactcacctcctgctgtgtggcctggttcctaataggccacagatggataccagtccacagccctggggttggagaccccttatctagaggacaggcttgtgttcttggcagggagttggatatgaacatacagatatatcccagaatttggagaaaacaaacaaggttctgagaaagaaagtaacttagagaggcttcttttatgtaggatggtcagggaaactccattgaggaagtgacatttatgctgttaccagaaggaagttatgtagagtggttggtgggggtgaaccagaaaagcatcttgggaagaatgaagagctaaagccctgaaataggaaagcatgacatttctaggaatagaaaaaaatcagtgtggccagatcataacgtgaaccaggtggaagtgtattaaatgggttgagaaataatacagaggttggattttattaaaaatgcaaataagaaaaatactgatagattttaagtagggacttatcccagcttgatttgtatggacagaaatcggtttgatttctctttggaggaaatactgaaggaagataagatggaggcttggaagttagtcaaaagcctgaacagtgatgatggtttgattctaagtggtacaattgtaaacagaacacaagatagatggtggagagagtatgaatgggatttgttaatgatttagtagttgtaacaggaaagaagaaataaaaaataaaaattaggcttctgttgcaagttactgtgtgtatactggtgcatttacagatataaataagattgagaattgggatgggtttaaagaaaggatgggtcaagacttctatgttctgttgagttggctctgagacaatctagtagactagttaagaatgtggtagcaaaatgtgaatctagagatctcaaatatatcatagatctgattggaaatataaattcgttagttattcccacgaaggagctcacacagaaagagagaggtgggtacagaattgagcttgtaatgtatcttagtagtacttaaaagttaggtagagactgggcaaggtagcccacacgtctgtaatcccagcactttgggaggctgaggcaggtggatttcttgagtccaggagttcgagaccagcctgggcaacatggcaaaactctgtttctacaaaaaattgagctgggtgtgttggtgtacgcctatagtcccaacttctcaggaggctgaggtgggaggatcgcttgagcactggaggtagaagctgcagtgagccctgatcgcaccactgcagtccagcctgggtaacagagagagaccctggttaaaaaaaaaaaaaaaaaaaaaaagtcgtctgggagcggtggctcacacctgtaaccctagcactttgggaggccaaggtgggcagattgcctgagctcaaggagctcagaccagcctggacaacatggtgaaaccccatctttactaaaatacaaaaagttagctgggcatggtggtgcgtgcctgtagtcccagcttctggggaggctgaggcagaagaatcacttgaacccagcaggcggaggttgcagtgagctgagatcgtgccactgcactccagcctgggcgacagagctgagactgtctcaaagagacaaaaagggcagacagaggaagaggacccaatatggcaactgttgaggaaaagccaataagggttaaggaaatttaaatttgtaggtaatgatgttttggaagctgacaaaacataatggttagagaaggaaagattttgtttaatgctactaagaagtcacataatatgagggtagagaaacaaatgatggtataaaatctggcaacatggagacgattggtaagaaaattcaagaacaatgtttataatgcttcataacttcctcatagctcttagggtaaatacatattcttggaacctgcaaggcctggcaagatttggccatcatctccctctgaaacctccttattttccaggctctgcttctttctacatcagcctcacatctcttcctgttccttgaacacagtctcctcctttaaatttattatttctgcctagaatactttccttctcctcatactcatttaacttattttcttcaggtctagctccattgctttttattccaggaaaacttcccaacctccagaatagaccaaatatcctattatatgcttaaatcacagtgtggaagtattgcctttgtgatgaaagtgtcatgatgactggataattaattattgtgtcttccactaaagtgtagataggaaagaaagcatgcctgtttttgctcaccattttttcctcatgtcaggtaaaatgactggattacattaggaacttgctctgtatttgttgaatgaatgagtgaatgaatgcatgaacaaatgagtaacatctgcctctgtagttaacttgtaatctgtttctgtctttatataacctctactgtaggtagccttaaaaatctggaaaatgactttattgatttaagtaaatattaagtttttaagcttttaaaaatctattgtaagttgattaactatgattattttgaaattttcttcatcaaaatttgagatgactttggatacatactgttttcagctactcaacaagtgccattgtatttactatgtatgaaatctggtgttacttcctgcccatttcctagactcagttgttctttgcaaaatacccatttatcagcaaccagcccaccctccctctgggaatcagtgagagtggatcacatcagtatgtcataaatactcctcctgttttctttgagagttttctgctgatgcaagcggaaggcttggatgccaggcctgtatgtgatacagtagaaatttccccagatgccctgtggaaagacaagctgctacccggagtccttcctggatgtctggcttagtgtagtataccatcaaggacaacctggctctgtctcctaacaagctgctagggccttccctcttgcctaccctcctgacagcctggacctcaggctaacaaacctctgggttgccactgtctccattctgagccatcagaattgtatatacattcatctgctgatgtctctgtatttcaagctgtatgtctttacacctttataatacacagtacagattttgctgcttaaaattctagtatttcctatagacactaaactcaattttaacacaatgaatatgttaaaacattatatatgtgttggattaacacatataatgcaactcatttgttgctaatctatcttggattccttgggtagaatctgtcttctcacctgtctgaaatggaattgaatctcctaacttcttactatttttttaaagccacaaatcccttttaaaatgtccgtttaaggctgctaaactcacattgttatagagtatattttatatacttttcttccttttaaaagatcatatacacttttctcctggcctctaattttgccaaatattctgccataacagcaagctcacagaacacaagtatttgcttaaagatatttaaagcaaatccccaaagagttttctgttgcaaatgtattttaagacataggctgaggagctgagtattcaaatccatgagttctgacactgatgttttattaggcctacccacatgaaaattagtgcttacttgcacagttatcttatttaaaaatacatttgcaaaaagagaataatttcattttcactgattcaaaggtctatcttttcgagtattataaacttacatagtacaaaaagattggtaaaagggatgagaaaaataaagggcaatagtaaggtgagtaaggaaagcaaaattaaacttggagacttgggttctaaatatagcttgtctacatcctagctgcaagatcttaggcaactcaactaacctctctgaacatcacagataaaatggggaataataacattatctagctcaagggtatcgtacaaattatacaatatatgtaaagtgcaaagcatagttcctgcacatagtaagtgctccataagttaaatataataataatcatagtaaaataatattcttaactacaatcttattaaaaggttattacctagagtttaagctgtggggttatttccatttgcacaaagtgtgatagaaatttggctctgtagttcctagcagccaatgtaagagtaaaacaaaaaagtttgtaagtatcaaaagatttatttacttaaatataagaaccctacaataatgcttccaaactagggtttgcagaattaccacaagggctctgtctgtctaaaagtcccccaagcattatctattgttcaaataaatgagttgcacatgtgtgtacttttatttttaaaggcatatagatattgtattaataaaaccaattcatctaattgtattgttgaatttatactttttgccagtaagcattttcctaatagatggacttaactaagaacatcagaatggtgaagagcattgtgttaatacaattcattgtcttatttgttaaaaaagttgaaaaagtattgctgagaaaaaggaaacaagttaacttttgttaaaggtatctcttggttttcactgtcctttccctcatcagtagcgccaagaacatcttaagtcacagaaacattagtttttggaagcagggtttgctgtaactatagtagaaatgacattctgattccactcctagcttcacaaggatatctgtgaaagatttggggcaaaactgttaagctgtctgaaagtgcttttgcataagaaatgggttttactgctaaaactgtcatattgctgagttttgaatgccctaatggtaaatgatactgggttgccaaaaataaccagattagtagttttttcattcatttggccgtctcagtaagtcaaatattgatactttctactaagtcatcttgccaacacccattttgttatacttatgctgaatctgtttgtcatctcttaagtaagaaaattattgattattttgtggggatttaatttaaaaaaaatggtaatggatactgtaaaggagcattatttggatggtttaaaaacatcttccttgatgggaaaatcttttaaaaggctttctaacttggtgtaattacttgaattaaggaagtgcaatgccattctactgacttagaacaacttttttgacttcctgcaaagaggacccttacagtatttttggagaagttagtaaaaccgaatctgacatcatcacctagcagttcatgcagctagcaagtggtttgttcttagggtaacagaggaggaaattgttcctcgtctgataagacaacagtggagagtatgcatttatttatttacttttacatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacaggtaagtacaaggatattaatattttttaaattattttttctcttttggaggaatgtttgaaatagacataaaaataatttaaatgtgttggtaactggaagtgagaagcctgctgtaaaccatcaagattgttgtctcagggagacatagctagttgtgtgacagaatacattgtttctgtttacaaagacataaatgtttcgggacaaaaaatacaattttaaaaggaaagcaatgtctatctgtatctttatttacaactgttcaaagatattacaaaagcaacattattacttaacttccaaagtgacaataacacacatttataaaagcctgagaattttttaatgataaaataagtgagtttttattcttttaacaaatttgatcttttaaaaagtcataaaacagctttggttgtatgtaagccactccctcttttcagacctgaagtttgcttcctcaaattttgaatttaattgacatattttattgaatacttgggtatataatagttcaaaaatatattgagatatttagtaaaatattaactttctgcaatttttatcacagaatgtattttaaatcaagtttttagtttcttgttaatagttttaatacatttttgctttagaaattcttgtggagccaccgcccttcctgggtggtgggtaaatattacagccttgatgagatagaaatatttaaactcttaaaaatcatgcaaatgctgtattcagtaggaaaatgcaactagttggacttccagtgcctattaaagtttgaaatctttgcacatttatggtctattcaatggatagttcttgagcggcgtcaatatgaatcatgagtacatttcaatagattatagaatgtaactaataattaatatttaatatttctctttatgatgtagtatctaaaaggacattgaaaataaaatttttgtagaaattccaaaaagtataaaaagtattttaaaacaacttgcttattacaattcactttgaagtctttttttgacttttaccgttcttctttcctctgaaagtcagggaagtagctacctcttgagcatgttacattgacaatttctatttggagaggaaagaaagaggaaagaaaaacaacataagatttttgttgttgttgttgtggctgttttgctttttattgcaaaggtgaattttttaaaaatctatatatttgcagcatttgtcttagtacagaaaatgtttatcaagttaccatccctttaaagcttatgataataaaaagtaaattataaagaataataatctcaatgaagtgatatatgtatattatcacaaatcagaacagattttcatttaaaattcccactcaggaaatgtcgaaaagcatttttaaatgagcataaagaaatactgagacattttgtaagccagaatatttttcttctcttcatattcatttaacttctattattttcttcaggtctagctccattgctttttattccaggcaaacttcccaacctcctgaatagaccaaatatcctattatatgcttaaatcagagtgtgaaatatttcctttgtgaataaaaattcaactcattctattacaggatgtttttttaaccataagacacatctttgaatttataattgaaataatatgatggggtctagaaacctttatatcaactttgctgaatgatttataccatagcaaataaatggatatacataaatttattttgaaaactcaastttatcttcagttgctcacataaatattgagagcaaacatttttctaaaagacatttgtagactccctgagatatatgcttatttgtggaaaaacatatacagatataatcatttgtatctgcaaatattgtttataatcctttcaagttgcaagaaacattttgtgatttaatgtataatttggaaaattcttaatgctttaaattatttatttttcttttttagcaacaaatgagttggattctatgtttcattttaacgtgttaaaattagtttagtgcctacaggaaataataaacttttggggaacaaaatttatattgtatgctgtaaaggcataaagaaatagagccaaatgtagagagccatcaatggtaactctatgcataattcaaatattttatttaatatctaaaatgcacacacggacaaggccaaagttaatctttgccacggcaacaaccaggcagggttcagttttactcaagacttcctaatcctcttgctctgtgcctctttgccatggcaactggaagccaaactttgtttagaatttctaaataatgttaggggacaatgatggttttaagaaggcaggtgaaggtgagtgttctctggttctaataaagttgtaatgccaggcagatctaccacactatagcatggcagttaggagtatatgagttatggtatgtgaggtatatgatgagttttgttatgagtcataacagttaagactcatttcctggacataattcttcatttttccatctgtattaaaaatatatatctcatgttataaacatggactgtgccttgcacatcacagacattcaatgaaaattatttaattgaatttggtaagcagtcctattaagttctaaatactccataatttagagatttgggaatgtgattagaattacttattaatttgaaaaaaaatgtcctactaaaaacctgcctgtgacctttatcattgctaaagtttgaaatgtactttgttacaggaaagactacggctagggcctatattatctttttctcttttgttctgtgtaagtaagtataggggcagagtagttagcttgaacttagttctttctttgttctggactatttgctatcctctcaccagtgacaattaaccagtatagaaatatagatgtttctacattgttcatatacttgaacatatatttctttatgtagatactmacacataaactagttatatatttgtgggttatatatactagtcaatctatctatctgatctatctatctatctatctatctatctatctatcagttctccatgtttgtctatttggcgttcccatgaacttcagaccttcgcctgtgttctcttttctccatttggttacgtatcattgcctactatgtgttgatcactctgattctccatctctagactcatccctcagaaacacggaacttactacctttcctaaatccagacattaacatgctccccaagtcctgaaattttgctttgtaataatctctaataacttcttgctttgacacctccattgccatcatcttaattcatggctttattatttctcacctgtaaaattgtaatagtttttttaatcagtctgaagtctcatcctttttttaatgtaatctacagcttaaaaagtaaaataaaaagtgaagggttactgatttcttctcattgcctttggtataaattctaatcttttttgccagagaaactggttccactaatgatctgggggctaggcctggagctgggaagggatcttttttcttttctttctttcttcctttctttctttctttctttctttctttctttctttctttctttctttctttctttctttcttttttctttctttttcttctatgattgattaaaagaaaacaaacaggaggtagttttaacacccacctctatactttctcaaggtgtttaaggttctgggcaaatcctacttcttctattatgttctcttatgtcacttttgccacaaaatatttccattgaattgcacactttttatcaccttttcttggcatttttcaagtcatttcaatctgctcttttttgtgatgatgattgatgatgatgatgacatgtgaattagtggatttcttgacattgtaacctacatgaaatcaggtataggagacacaaaaggcataaactcatagttcccatacctaatttttcaccagacactgaataaatcatagattaaaaaaataaaactgcatattgtagtgacaaaggaaaggaaaattttcaaagagggaagtcaaaaagagggagaatatgagataaaaaaattaaccagaggcgaagtgggaggatgaagacagcaggactattttgtccagattaaattaagttgattttggatctagatgtttacagtcttgcctttttgtttttgtttgtttgtttgtttgttttttctttgctccctttcttactctccttatctcacctctcgtctggaaagagcctcctgacttcctaaaagttcatagtttgagaatgtttttcctaaattttctttgatctgctctttggacattctaggtaatgtaatttggagggtcaattttatttttcagatacacatacccataggagaaaaagcaaggaatgggagggaaatacaaatgtagcggagtgataacacaaacagatcaggtccagtcatggcaattgctggtttgaacactgatgctagtgctctgggattgcttgcaagggcagatggaatatggtgcaccctaggtgttgcattatttgcacgacaaaagtttgtagagagctgggaataatttctttacagacagtgtggtgatgaatgtcaatctgagtaggtaaggggcagagatttgtactgaggttgattcattctcttggtaaatacacaatgttcacaaaggcaaggtttcatcttcagaccatgtgtgtatatgtcaccttggtgcagagagagaaatttttcatcagtgctgacctttgatttttttttctagacatcttatagatttatgtagttatttacatgggaaacaattagaatggaaatttaacatatcttcagtttaaaattaatttctgtctagtctaaatatctttgtaagtactagatactcaatcccatagcagtggccttttaccaaaggcttagtgctatgacttttgcatacataaagacctcactttttaagatatgatacaccagaaaaaaaatatggcaagactttagcaatatgatttgatgcctatttctatataatacccaaatatacaggaataaaaattatggcaatcactggattttgtgtacctggctctaaccaatatttatattagaaaatatctaattattgtctaaaatatttaatcttcattcctgtttgtatgtcagtgtgctacttcaatatcagtctgttaaaagagtctaggaatgactactataagcagagaattatatgttcaggaatcacaacaaaaaacaagaacaaatagagaaacaaaagctttcctactctttcatctaggacaagaataaatacacataaagtcaatattagtgaagtaaacaagcatcttctatatccattcatagtaccttcaattgattgatttcttaacagacaatcagcaaaattatcagtttttattagagattttagtagagaccgagcttaaacaaatawattctatggtgcttaactctatagtatttaaagattcaatatttatttcctctaaaaatgagtcaagtgtctgaaaggaaaaagccacctaamtgaaacttcagtttctactatacagggtatttattataaaactgtaattacaatgcaattatattgaagtataaatgatcatcattcatttatttaagaatataatcaaaatttgcatacctggaagaaaaccatccaccctccaaaatagggatttgctaatgtaggagtagaaggcaaaagttgagggtaactcaggtaacacactcatacgtattaggatatgaacagctggtatagcaaacttgatagaaatcactgatagacaagaagacattctctgcattttaaattaaagtacaatttgtctgtggtcattcaagagatagtttagagaaacctatacaaataacaatgatgctaagagacaatatcaaaatcacaataaatatcatggcaatacagtgtggccactatattttaaacacatccacttgatgaaaaatataataatttactgataaaacatattaagcataatagaaaatgaggcagaaaccactccaagctgggaaacatcatgacatctgtagtgataaatattttgaaaatctaactctatgaatcttgtgatttttagctaaatcaattttcacccttgagacccaatttcctcatctataaagtgttgtaagcattaaaagttataatatttgtgaaaatgctttgaaattatgtgatactctgagaagtaaattttttcatgtgagcccatgaaatcagagcacatagccttttagcataaacttgattccaaatgatatctcttcctttcagacactgtgagcagataaagggatagtttaaggttaagtgatagaggcataatcccttataggcctttgaattcttttaactttgcattctttatttcagagatttttcaggcttctccagattctacagtctaaatagtttgtaaatccacacacttctactttgccagggatttcttagkgtaaaaatatcctgaagtctcacctgccttcaatccttactgtgtccatacccaccattaccaggataatctttgtaaaaggcagaacttacctttgtccattcctcttttaaaagctcctattggtagaaaatatactgaacccrtgatttgataccaagtatgttttggctcaacttttatgaaaacaaatatttaattagaatataccaacatttatgagttttccttaaagataaattttggaggaaaaaaactccattagaccaatttaattccctgatgattatatatatattacctagtgaaatccttggcagtttttccattttaattttaattttactgaactaatgtttagcagcatcactttcatttaatttttacaataactattagattcatgaatccattttacccatgtcaagttctactgaatatagcttatgcttggaattttcctttgtgattattacttttctaaaggtaattcttcttttcaaacaatacagatctaaattttccaaaaccatttaaattcttctctttggccagaaacattttctgtgtgtagttttggctaccgctagtttagtttttttaattggttttgtgtctcaatgctacaaaaaatataatttatgtaatttttcatttttgtcaaacttaaatcgggcaatattaaccattctcaattttttgttgtgttgaaatttctatcagtgacattaatgtggagattgacagctctttgagctagattcattttgaaattttaagactttcgattatttcttatctagccaatagaaactttagaaacacttttaagactgcttgatagcctggaattattatgtttgaattctcattcatttgtatggtattcctcttattagctttcacacttagtaccaatttcttattcattattggagcaaaaagtaaagagaagaatcaaggtgataagtttaaaatcttctcaatgtaaaatagtgtgtggggaaagtgtcaaatcatcctactttggtctttgtgcatttaggaaaaataaaagcaattagcattgcacacacatatgtaattgaatctcttcagatttgtctggctttatctctaaccactttgtgactctttttgtaacttgcatttttctaaaaatgtgaccttgtttggtcttcctactgttggccatgctgtttttccttctctccacatctttttatcaatggtgcaaattataaattgtattcaaatttactgtaaagatcatgtcctctagacagcccctatcccacttgtataacccttgctcttcagcccctttcacacctgcataggtattcttctgctgtgatgatcctttgaataattctcttggagttctctttaccaggctctcttgcagcaactggtgagctcatgtaggctatcactgggtctctgcttatttgccagtgcctgcaggtcctcagtacctgtttgctgaacaaacgaatggtctgtcagcttaacccaactctgtatgtagaaggcacttaataattcttaaaaacaattttgattctgtccttttattgttatttatgggaattatttatggtaaaaatttctacataatagaaaatttggaaaatgtcaagaaatagaaggaaaaagaaattgcttagagcccatgctaacattttgtttttyttcctctatcttttgatcacatgctgtgtatgaaatttcatgttcaattttttcccaagtaaaccttgattattctagacaatttgaaaaatatagaaatgaatagaaaaataagaatttcaggtttccagttctcaggatctaaaaactttttgagtatttcatttgactaggacaactagatctattcagttatttattaacttattagttcatttgataaacaactattttgtgagtgttttccatgtaatttgggctgaggacacctatcccatgaagcccgtattttctatcagtggcttcttggagatggtgttttaaatcttccaaaatcttcatcagcaccccaaaacttcctcctcaaagtaacaacataccttgctacagataattattggtgttatcaatgttttataaattataaatttaaaaatcactatcttaagatctatatataacatattaagtaaaacttatattcttacaagacttcctccaggtccctgttacaaccagattttctttgcagacttttaaattatggaagttctggtgctgccactgagttgtgtagattattattagatattcaataaataaagttggtagatgtgaagaggtactagacaatagtcctattttgttttggtttgtttgttttgtaatttattctgaaaaaatgtttatgtggagagaaaagggaaaacatacagaaatacacagcacacaaacaaattcttacttttttttggtagtctttctaattttccaaggtcaccagctaatagcaaatgagagttgtagggggtggggtgaaggctggggtcttaatcggggtctatctgattctagatagaccagattctagattttccactcggttactcaatcttcttagtggtcagtttaataacctggaatttaagacatgactgtgtgatgatgggcaaatcacagcaggactgaatgggagctggtaatttctcagaggttgtttgtgtgacatatgcatgtaagttcattcacctgatttagctacttacatgaaccattgtgcactgagctgcttctatatctttagcatattctgtatctatgtaaaattcacataagattgtatgacttttataaaaaacaaaaagacatctttgattaatttgtcttcactatgaatactgatgtgatgtgttacaatcatcctgaaaaggaggctaacaaaggacaggactgagtctgtcttgaggtgagtgatatgatggaaagaatggattttcccccacccaactcatttttgatattacataaagtgaaaaacattaaataattcaccaaagtatctagatttttttttgtttttgaagtgcaagggaagtaacttgacctttgttaaacactttgatmatggaaaacacataaggttctcatcttattccaggaagtgtagacactagataatcttttcatagtcatccaaaaagcatattaagtgaaccaggtaaatccatcctacactttttattccagagacaagttggctaaactttgaggagactaaaacaaaacaaaaaaaaattattgtttggttcatttgataaatgtggattccaatcatataatttaggccaaatattatactttgacttcttagacttagatttccagatagtctggtttataaaataagattttaactatgcttactaaactctatgtatttctactttccaatgacccatgttcttattttctgaatttacttattgatgctttaggtatgataaaggtatgtaatggctraggaaacataaatgaagcataagacatcagttgagagttttgacggaaaggaagtggtgatatgaaggaaacagataaaccaaagaaaaaggaaaaggtcagggagctgataaaagtaacttgaagaaactttagtgcaaatgttggattcagacaatcgctacttttaaagtacttaaagaagtcagtctttgaaatcttgcccgkattccattccagtttcatcattggagacttccaatgatgaaaaattggggaagaattaccttccaaagcctcagtttcctcgtgtgtaaaatggaaataatagcaagagatattaaatgagatgattcactcatcgattcatcaattgtttatagagcccctgctaagctaaaaactgttttaagtgttgacacagtggtaaagaaagcagaaagtgtaactacttttatgaaactgacttcctagtggtgagagataacaagaaaacaaacaacaaattgagataacttcagttatagataaatgctgtgaagaaaattaagtagtgtaatatggtagagtttaatctggccagacccagatttaggggtgaatgcacttttagacagagtgatcggggaagatccttatgaagaagaatcattgagctacctgttggctgacaagaatatggggatccatgtgagggagactggcaagagtaaaggttatctggcaaaaccaaacaaattggtaggttcgaggcacagaaaggtcaggcatctgtagtatggtgagtaagaactgagcaggttgtggtgaggctagaaagataagcagaaggcaggtcccacagggccttgatggaaatggaaagagcttgaattttacctgaagtataaagggaaggaaccattttaagttcttaagtacagaataacctaatcttctttctgtgttgaagagatcactttgactgttatgaagagaatagattggaagtaaggcaaagcctggaagcagttatgaggagactgaatgggaggatggagaaaggggatggtgatctggaccaagtgttggcagtgcaggtggaaagaaaggaaagactgacatagaattaagagaagtggctgcatggaaaagacaaagacattttagagaatgactttttttccccatgagcactgggatgggaaagagccaaattagggggtcrgaaatccagagttatgtttgggctgttattgatgtctgattttcattaggtggtagagaggtcaagaaatccrttggagataagaggctgaggcccattcagtaggtctcaactggagacataaacataggagtcattgcattcagatggagcttaaagctaagggactgcatgtgacagtgtaaataaacatgtagagagkagcagatgactggtttctgagccttgggaaacttcatatttggaagagacacaaggaggagctaggaaaagatagtgagaagaggtagccagtgaaaaaaagtagaactatactttgctttgaatgttgaaaagggttggcattatagtgagaattcagtaaattccacataaaaatctgaatttatgtctcccctagaaaggttggttgtgaacatgcaattggtaaatatctctattaactttaatattgttacaaaagtaatattaaggaatttataatatttggaagaattagatgtctttacctaatatatcccttgctagcttaacaattagaaaaagaaagaggtacatcttaacataatttgttttaataaaaactacagaatatattgagagactaaagaattagaaatttaactgaaaatttcatgcaaaggtaatgctctgttgaaccattttgtagcttatgttttgttttgatacatattttaaaatattgtttaagacaatacttgaacagattgggattgtgtgtgtgtgtgtgtgtgtgtgtgtgtgtattggttaaataactggtttatttttaaactgaaattaaaccttccatttctttgagaaatttaaaaagtagttgttatcaatgtggcagatattaggtagaatctaatatygtgaaaattaaactgcacataaatagatataaatccttttgtcagtgtgtgtatatctctgtgtgtaattttgatctcaggcttggcaggtttccttaaaacttttttttagagctacttaattttgtacttactggtggttagctaataagaaaaagctaataaaaaatagtgcttactctgtgccaggcacttctgttaacattttataaatgttatctcatttaacaagctcatgtcattgtatagtctagcttatacttgtctttaacataagcaaatttgttaatttgtgtttcctgatattatcataaaatttactggttgtcatatcctaaaagggaatagttcaatttaattttccttgttctaattttaaatacagtactaaggttgagaaagaaggggtcaggaaagggaagtaacattgagtgtctcgtgtgcctggcactccatatgatgcttcaatgcacaccaggctattcagcctcagatttgtttctacattgcttctagttctacagattattcaacgaatgtacaatccttggtcactagtcttaatagggaaaacagaattatggttaaaacaaaagagtaagtaacttaaatatgatctatcggtatttattttgtattatgatattttgcttaagttgaaaaaagggcgcatcaggtgttttggcagtttactgtgatctcaatagtgagaatgtattgaaaaatctcagtacaggagaaagctgtgcagctttctcttcctgtcgctgcttaattttcatgtagatataaagccgcagtttaagcacatctgcttaatccttatttaaaagactaggagagaactagaaagggagggagggagaggaggggaagggggaagagattgagagaaatctctcccatataacacaaacactgtattagtgtgtgagaagcagataatcgtgcatgtaggcactatcatttgtgaaatcagaaagcataatttactcccaatgctgaataatctagttgtgtgtaagcaccagagagatatttaaatacctatccaataaaagataataaaagcctagcaaacctaagtaatccattttcagatgttaatccaattacgtaaacaaatattacccttttttttttttggtcattgtttcaaggataaagtgtaaatgaaagaaatagcattccatctaggtaaaagaggaatcagcatcattgaaatgtgaatagctgtgattcctccttgctgaatggtaactttagaagagagggaacccaggagtccatccagaggctcaaggaataagaggttctcacccataggaagatgaaaaatactttcagggtgacccatgagggaaaatcaccaaagcctttgaaataaaagattttcccttttctaagaataaaagatggtgttatgtcaagggcggctcgatggtgtggatgaaagaactattgggaatggctactgaragatcaaaggcaagtggaacctcaaaattctggaagtrkaacragtcagatacaatataagaagtacttcaaaggcaagaaaataagaataataaaaatacctttagttgtcaaatgtaaaatttgtgccagttttgtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttctcttaaactaaattttaatttagtttacatgtctacgtataaggtggttatagaaaatgaatgtaaaatcacttcattaagtgtaacaaaacaaaataatatgaggaattgttatactgtttaagcatttgaaaaackataaaggagtatagaaattttgttaccactactatgattagtttctcatttggtttttcactttaagaattggaataaaagttgaaatcttgattaaaaaaacaagaaatgattcacaaattattttacaaattgaaatactgaaatacagaatgttcaaccactgtcaacatgaactyctattctgtaattaatctattctataaacatctgtatttgctaaagagcaacagatcaaggaaaagaaaaaataatccttgccatccatagagccatgatttttgtggaatcttcgctccagtttaagttttgtcagtgtctggaagaaaatacttcccatggatcatctttttgctaaagagtattctttacattttaaaacatatgaatatttacataaaggtgtttgtggaaaaggaaattatgtgccttttattttaattcacccattattctattccacatgtaaagtagaaaatactactttaagacaaaagtaaagcattatttatttaaagatctattttgtccatgaattttatcagaggtaacgcttcttaatgttattcagtgccataacttgccttttttctaggcctccattttatgaactgaacatctggatttgatggcaagaaaacatttccttccgctggcttttctaataactccctcttacagatatgcatgcctcatgtttgttaataaaattgacgtgattttaatatctggtattttaacacactgtgaattatggaattttcagtggctttatttaattaaatgcattttaaaatccttacaaaaaaatattaagagtaactctaaaatgtattagagccacagatgttttcctttatagtgttaattgatttaaggtccatcaaaatgctgttaaaatgtctagaggttaacaataacagtggcacatgggtcagattaaaattctttttgagtaaaataaataaataaatgacagcttattttcttctgatttaaaaaaattagctagtggattgaaacaacaatgtgatagctaagatttcattctctcactttataatgaaaggagatttaaaattagggattatatggtacacgaaaaatttatatacacagattacaagtactagtttttttagtgaagaaaakacaactatatattttctctttttatctgttgtcctattttacaattgtagcaattaatctgccaaactctttaatcaataaaatatggtatttaacaaccaaatttggcccctccctccccttaaatatatttccaatgctccttgctccattttaaacctgctgtcctttataagagaataatatattttgtaatttgagaaaatcatgcaaaggaaagtttctcaaaattcacattaatatgtaataatagtaataaatatgtataaccataatatcttagaattttacaatattttatagaaaacatgaatattaaagtgaaaatttaaacacatcaatttttcatgttaaaattactaagaatgaactacagattcatgaatactaagggcaacttttatctcaggaaatatatcagtggactgaaaatgtcaaatcaattcaattaaatcagtaataacactttgctgtttatgtggctgttttttcttctatttttattgtcttagattgcatggatacaatcaaaataagttaatttgtatacaggatataaatggaccagagaatgtgtcttctattaaataataacaaataagaataccttttattttgtgatggtctttactatttactgagagacaagtattgttcaagttgccgkttttttttaattagctgacatatttcctgcttttatttgagttagaattcctgtaccaaacattttaaaaagagaaaaaaaattaaagaaagagaaaaggaatttggaaactactataatgtaaagtagcattatttatacaacaattaattttagagaagcaagagaccttagaaataatctatttcaacgcatctattttacaaaaaagaaaattgaaactcatagatatttagtgacttgtcctttgttacaccaaaaatgagggaacttggtctagaattcctccagcatattatgaggtatttgttctgtggcctgatacaatgaaatgaatgttggattaggcattttgggacaagttttgaatcctaactctattactaattcctcttcactagactgagattctggtatgtggtattcaataagtgacttgacttctttaagccttggtttctttttcagtgagatttacagcttagactagtttctgaatcttgaccctgtggacaatctagttggagaactgagatgacctgggcattgtaggatgtttagcaacattcctgcctctgtaaactagacacagcagcacatttacccaacctgctctgactgtgacaaccagaaatgtctccaggcattgccaaatgtcaamtgagggcaaaattgcctaccctagccaccttaactgaaaactacaaacttcattgaaataatttctttatggctcccagcagtaacactgtgctattctagaccagttggttaaactactggatgcttcatcagaaagcacccactaagcatcactcaccatgaagttcgttgggtactctatacaatgaacaaaggagatatcacataatttttaaaaaacttaaaagattcacaggtgagaattttgtagtaacaattaagtattaactattagaaaaatttaagaagttttaacaaaatgatataaaaatatattcactataagtaggatgtaatttttgtcctgtaagagttatccatgtatttacgaattgtacctaccagaggttacaaaaatttggtcattatttgaaagattaacagggacttatttccaatcatagatgttcactatactattctaagacatttgcaactgtgtaaggcagtcatttccagtaagaattgctagaacaaacattaagcatttcacagtgaaaagggtcataggtatattttcatcctttgcrtatagaagaaatagcaatctattattctcagtttttgacttaaaaggtattgttgcttccctttctttccctcccctactcaaktttttgcccatggatccagatacctacaagggcctaatacagggaaagtgcactgtgtatgagctatgaaggcacaatggaagcttgcctggcaatcagtgccagaacagacagctagtctgatgaattctgctacacatcacagggctactagttttttkttttttkttttttttttttttgtcatacattactgcaagttccctgaggaagtttactgatctgtagttttacgagaaatgcacgtcatggaggtggcgtgggggagcgggtgaacaaggaaactttagttgctataaaacaggagctgagagctcaagcaggttggttatgttctgccagatggagataaaactgtggcagccacatcctgtgactagaaattgtttaagtaggcagacctgttggaggactaaagaacattaggcaaggagattaaattagtgtaggaaaaaaaatcagttttgtttaaaacgaaatatctacttgtgttaatagaacattctaactccaccataggatggaatcaagaggttttttttttaatacatatagtgtatatatataaatatatatatacacacacacacactgtatgtattcctatgtagattaaatattttgatttacctctttctagtaaagcaaagttcattctgaaatccaaaatattcacttactagagcagaaaaaaattagctgtgcatttatgctgatcacagtgtagataattaatctttaagaaagtaggtttttmtgtttatagttgataaagtgttagtggcaagaactttttctgttattgaatattatcatcagattactcgtgctttccattttattcctttaaaaaaatccaacttttgtaagccaccactattttctgaagattttatttctctctaagctaagaaaggatgtcaagaataaaccattttctccttttaaataaaaatgcattcactatagatattcatttgaaatctcaaacatacctgaattaagtatactcagttttgtgagtgaaaattaattattatttaaaacaaaacaaaacaaaaaaaatgttcagtgttttcattttacttctcttgctgcttttgggctctgactgggcccggaagcagaagttgcaaaacattatgagaaaacttttgctcttttcttttttttcttcaatctccacccatatggaaataccagaaatctgaaaccccattcttgctaaatattcttctcaggattgtatctctactgcaggtcttctatgacgttttacagctggcctctttccattcagaattgctgttcatctttgaatgtctctgctttactcctgaatgaacacaaacacattttttttaggtttcttgttgacattggctttctttatagcccataaaaaatgcatttgtggcatctcttccacagacaaaaatagtataattatgattcaatactcgatgaatgtgtgttaaactaaactgtgcccaagctctgtgcaacagtacaggtttttcacctttccaggggagagatgtggagcacatatacatttcagccatcctacatgcccacagggacatctttctggtctgtctcattggaatacccttccttatttggtttttagtttctttctgctttaagcacctttcagagagagagagatgttttcctttgtctttgtataggcagtgcctatcgttacagagtagcctttaaatacatatttgttgaattaataatgatacacatgaactgatgaggctctataattctatgagataatctggtatcgtgggaatattttagcatgttttgtatagatagactgacactatgactggtaatctgatagtaaaaatggcaaaatattgagcctgagtattattttattatgttgctttcttatacaaggagggaataaaataaagtgatgtggactgtaattgtgctcatgaaagacacaatgtatacatacctccttgagacggaatgataaggataacgtagaatgtttaccatgatttatcaatctctcctatataagaaaaatatttcttgtcctgaagtggtaactttggtgaagtcttttgcttgctcttttacagactaattaacaagttttctatgccggctctgtcctttcctctcctctcacccctgaaaagtggttaaaagtttggcatttgttacccagaatactaaatgtaacacatatgtggcaagatttgatggaattgcacttctgttcttattatgttcctttctggaaaattatgacaatttgtgtccccttagagagtgtagcacagttttctggttgctcctcatgataatccaaaaaaaaaaatccagctaacccttaccttttagagtaagaatctttagaagaaagagtgctttcatcaaatcatttgagaacgttaagttgaataactgatacggtactaccctacagacatgcgcaggaagtatctgcatttctgtggcgttctgctaaggaaaagaattttctttccagacaagatttttcaaaatcatattttaaaaatatcttaatgatgaatttgaagttgagaaccaacttatttcaagtaaaattaaaattttgagagataagagaatatactttttttaaggttagaactcagaggccattatgacaattaatgggctagtggagacacctggtctctaagaaggagacaccagcttcttcatgttttgatttctgccttgttctcttgtctgtcaccactagacacatactattttatagtaattacttgcatattttgtagaaaaggcagctgtgttttctacaaatatttcacaaatgttagtattgctctatgccaaggarcagaagacaaatttgtggaaaagatacatgtggcccctccccaggtgggatttcttgtgtaggccccatgcagtggagggacagagggggccagtgctcattttgaggacacgatagttcggactgtctgaggaaatcsacagtgtgtgtttaatgaccaaaccaacatggctttgaagaatayatatatatttttttttttgctttttttttttcrttgcccaggctggagttcaatggcatgatctcagctcactgcaacctacgcttcccaggttcaaggaattctcctgcctcggacttccgagtagctgggattacaggcatgcaccaccatgccttgctaattttgtatttttagtagagacagggattttctatgttgttcaggctggtctcgagctcccaacctcaggacctcaggtgatctgcccgccttggcctcccaaagtattgggattacaggcgtgagccactgtgcctgaccaagaatatttttcttaatttttctgtaaaactagttgttttagttttcaaagaaagatattttggtagtttttctttaaaatgcatatcatcatacagaaatcattgtccacgtatatggacatatatatctatataaatagattatatctatataaatatatagatatatttgtccatatatatgtccatatatatatatgatcttttttttgatatagtgtcctagacctggaattcctgtgttaaaaaatgaaaacattttcagtctcttcatatatattgacaaatggctttcagaaaagttgtttcctctattctcttcctaacattgtatgagtttcctttcacatacttttgtcagagtttaattttatcattttcaaaagtgttacttttataaaaactggtatttcttcaatttaccattttgtgattaatttaatttttactgtgttcagggttttatcatatgcttattatttacatttcctttgtgaattgtgttcctatgatttgcacatttatcttttgtgcagctgtgtttaaattttgaatataaagttatatgaaagaggaaatatgtaatttacataaacacacccaaatatatgtgtgtgtgtgtgtgtgtgtgtggtgtgtgtgtgtattctgtgttgaaataaatggtagaaccaggacaacaggtagaggttatgaggttgtcatctgtgacacagtctagaggagaaactgtgtgggcatctatcaacttacctttttgaaagaatcttaactattagtttctggaatattcagagaagacttgtaaggccaacatggactctagtttccatcctcctgagaagacattccattatgaaatctaagtaactttgacagcaaacccttcagtcttatcattttcattagataatctaccaccaacacaatgatccaaaaatgcattatattcttgcactggagttcttcactttttgcttcaccccaaaactgccgctcctaaccacatgcttagctgctaactttcacaccaggcttatgagaacagtattttcagtaagctctcttttcaattcctttcacaatggagctgcagaatctttgagttgaaagaagccttagaggtgactaggatcaatgtatatatatccctcttaccacacacactcactgaatattttctaaaaactacattaagaaaaaaagaaaagcctaatttagtgctgaactgctgaaatattttgaaatttgtggtttcaaaatcttaacactgttaattgaaaccaatgtttctcatgccttttagtctctggactcctttttaaacattcttaaacataaacctaatttttagcataattgtggaatataaagaggttttgtctatgtgggttatatatatttattgtaaaataaactagatagaatttaaaaatatttaattatttattaaataataataaatcaatatattaatataaatagcacatattgtatgaaaaacaaccagatattataaaacaaagatttaataggaatagtgtcacttttttgcatttttasaaatcttttaaatgtctgtctgaataatagatagctggattctcatatatgctttaatattctctatctgttgtaatattatataccatatagtttctggaaacattaattttctactaatgagagaatgagagagaagaagaaaaataacttcttagtactgttaggtaaataataatactcataacacttaattaatattattttgaccttgaagaatctttaaaaggttcttggggactatcttgagtctccagaaaacactgagaaccactgatacgccaacaagataaaattcttatccttaccgcagcatggaataggaccatactttcttccttataataatacttcaagtatttgaatgtatttattgtattttcatctatactattattttttaggacaaaatagacttctttaagttttccgtatttgacacattatcttgctcccttccccactacctacctccggttagcctcctctgaatactcttggatttcaatttcatttataatgtgtgatattctggactggacacagcacttcagggacctggtatcttgaatcaacaaagacttgtcttccaaacgatggtgattaagaagccaccatgtccaactggtcagccagtttttatattgtacaaatcagcaatctcagagtcaacctaaccagatttaggcaaggcacttccatgatgtattgatgtattggctattttattaatagtaatatcaataaaaataatcattaagataactgataatattcaggacttcatatgtgctagatgctatgtttaatgcatacatttattcactcttctaattcttaacaactttataatgtatatgtatttcttattcttattttatagataaagaatctgaggcatggaaaatgtaggcaatttatttgagattacagagctaataagaggcagagccaatgtttgatctgaacaacttgattctaggatcattttggctgggaattttctgagagctgtgtgtgtgtgtgtgtgtgtgtgtgtgtgtgtgwgagtgtgtgtgtataaacatgagaccatattagtatatacacaaatgtcaatatatattttaaactggaatgttttaatagagtggcttatatgatagaaataagagaaatagaggaggatggaaagggacaaaaaaagggaaaagtaattaggaatattgaaaaacctaaaatgtagttctctccatattctggatactcctgcctttttcttccactttccacacattgaccagtattcctttctcctttcctaaaatagttttacagatactatagatacccttagctatttgacagttatgtttctgttcttttaacatgtctgcttctataactgtcacacttaaatgttttcataggaatcatgaaaactatagtttttcctccaacgtaaggatctcatatcacgctttcattctgaactaaccattccctctctgcagttgatgtaactgtgccatgtgaccattgtacacatgtgggagggaggagctgaattacgcctgacccctggccagagcaagagctactggccaaaggggagattgagcatctgtgttgtacttcccacgtctcttcacctaggaagtgcaatagatttctgacgagtctatgattacccactgatgaataaagacaatctccctgcacaattgcactgcaggcaagactgaacttatgaccaccacttctgtgtaattttgaatttcttagacctgaaccctgctgagtacacctgcttccytctattccttgctgaagttcattcttttcagtgcgttaatggagccaaaccaagctggtggtggtaacaatttgaataataatagtctttaactttttatcttttgaaaaatagaattctcaggagcacttttagctataagattccttcatccaattaaataagctttaagcttcatgaaaagtgtaaaagggcacaggtgcatttgtggaaatagaaggaagcaatcttgagcctgaatacattgaggtactggcaagcttctggaagtagttgaagaagacttcagttagaagcttggtcaaatggacaaagccctgacctggacattggagacctgtagccaccttctgaatccacagctgacctagtggccttgatatataatattgattgcaggatagttttgtgatggttaagattgcaggctttaataactagatttcttggatttaaatcccaactctgccacttactgcttttctctgggaagagtgattaaccgctttgtgcctcagtttccttatctttaaatgaaaataatttgagtgcatacctcacaggtactaaagaataaatgattggaaaataaacattattgaatatatgttagtaattattattttcattgttatgctattattatttttattattaatgtatgacatcatgttacctgcctaacaacagagtattgagacaaaagcaaaatattttttctatattaataatcataataaacaccactaatgtttccaaactatacttttttttaaccctacatgcctttagttcatggaaagaaaagtatgttaaagatgctatgggggtgaagagaatgataaatattattatttaagacaatgtttgctataatttttatatatcaaataagtttatatgttctcagaaaattggtctttgaataattgaggacagtgtgggtttttattctgtttctggaaggcggtgcctgtggctgtgagaaataaggaacagaccatcttcccacatttgagagggaactatacaaaaatgggaaaatatttgttttaaatatcttttggatgtgaattttgtcataattgcaaactgttttggcagcaaaacgaattatttcggtagcaagaagagacttaacgatgctatgtgggagaaaaactaagtccctactatctttctgagagcacgtctcagaggacatgatgtgatcctgtaagtttgtagcaatcttattgtgccccagtgcagacactccttcctacttccctgtagaaaacagaactgtttttttaaaattctttctcaactaccatttttaatagtcatgttacttgatgacaaaatctgatacagtggcctttaatactatatagtgaatgatttttgaaaatttggaaaactctaaccgaaatataccaggaactgctctcctcttcatctcagatgtctacttcctcttcagacctgtgtgtgaagctctagaataggctgtttgggaagactacaaaatctcctctccgaggtcccttataaccctgatagttgctagatttgaaatcaaggatttattctccccctgccctgagcctctcccttatgtccacataggctctagcattggaagaaatattttaagatctctttctttttgactttgtgatactcccatattaaaaatggcttatgacaggaaaaggacaaatatgctatattttttcccttaaggctaatgttctcgggactaccatgaaaaatccaggtatcctaatctggagggttaccctttggatctgaatgggattggagtcagtacaaggggtggggagtgtttttagaacatcccggcagcmtttttttttttttttttttttttttgagacggagtctcgctctgtcgcccaggctggagtgcagtggtgcaatcgcggctcactgcaagctccgcctcccgggttcacgccattctcctgcctcagcctcccgagtaggggggactacaggcgcccgccgccacgcctggctaatttttctttttttttttttgtattcttagtagagacggggtttcaccgccctgctgccttttaaagcaatttaatacatgagttaaatatcatattttaaaaatagattttattttttattataattttgatgaatgcatttttgtcaaagttgtcaaagtcaagaagtcattattgagaccctgagggtaaggcaggagccaagtgagaacaagcagatgtcaaagatggtgaaaaacyagaacagccaggtcccccaggcatatacagagaagttttgcaatggcaggtccccgtggttgtctgacccagacttccaccttgaggtaactggggtaactataacgatattttcatcctgatctcttcatgcagttatatgtttccaagaacagataaactgtgaacttaatacaagtgtctcctttmcttggattctcaccatctgggtggtaaacatgacagaaacattcaagtatgttcaatgtagtacatggtaacaaatgctttagcacagactagggagcatgtctggcaacatgttggcaaataattaaattggcacattcaggataaaatgagaacatggaaaaacagaatatgattctcttcccagccctggaaagacatcccaagtgtacgtattgtttatattatgttattagtatatctttaccagcaaagggcaggtcatcatcattcaatatgctcaaatactcacatttaaagacataggcactttgagaggccaaggggggagaatcacttgagcctaagagttcaagaccggcctgggcaacatggcaaatcccatctctacaaaaaatacaaaaattagctgggtatagtgcctgtggtcccagctacttgrgaggctgaggtgaaaagattgtttgagtcgaggaaatggacgctgcagtgagccatggtcacaccactgcactccagcattctagcctgggcaacagagcaagaccctgtctcaaaaaaaaaaaaaaaaaaaagagagatgtagggagcattgtggacatctattcatggagggttaaacaatagaattagacaaccatgtgtatgtgtggaatcatgtgttttttccacacatgtaggaaggagaaggtaggaacaatgaaaagattcttttagtgatcatagtggctccaaaacagatgctttggtatatgtaatacccatttatcttataaagaaaataaagaaataataaaagcatttgctaaccatgttagatgctatagtaaatgtaaaaataaagggtctgttaatmtattaactgagcttaatatatgatgtgatataacagcagccttcaaatatgcggagggctataacagagatcatgatgaacagacttttattctggcttagaaagactagacacagaaattaaaggcataaattactctacaagcaaagcaatcttaacataacactcctttcaaggtagactatgaatatttccaccaataatatatttattaaaatagattccttttcatttgtctttttaagttaaacataatcttgcttgaatgaggatgagtataagatacctcagtcatgaccttgtagatcactgcatcagccagctttgtattcagctatcaaacaaaataaaatgtgatcactagtggttcaaatacattggagttctacaactaaagatctaaaggaatgaaatccatgactagtacaaagacataataatgccctaagcaacttacgatattttgatgtttcttttctgacaccccattcgataggcttttgtcttcatgctcagcatctcctatctcatttgggatgctatgcgtccacacctttcatcacattccagcaaaaagaaagggaaggcaaagtggtaatatatttttcctagtgaggttttgcctctttattcagggatggaaaccttccccagaagcttttgtctacacttattggccagaaatttaacatataaccattcattgctgtcagaggtgggaaggagtccctgagaaagaaattattcttgttttccagcctctattgtagcatttaacaaggaagaatgggattatgaatagctttggaatgtttatcatgtcttctagttgccatagctcatagtcattttatatgattgaatctatattaggccttttatctgacaagtttcccaatgtacaaagactgaaaaaaaataattttcctcagatgggaataaagaatgtcaactggtctggccaagtgagtttggaaagctaagatttagccttgggtgcattattgatggacaataaaggagtaggtggcactcatccattcattcagttattctagctgtgctattgaatacttgctaactgcaaagcacagagctagatcctagtaagaatatagaaaagaaagtcacagtctctgccttgaaaacatatttattttatttctaggacaagacatctacacatatacaaactgtcaattcataacatgtcatggaaacataaaagaaggtatcagtgaaagtggagtgtttaaggaaatttccatgcagttgatagaattttaatcctataatttcaataggtagtagctgtgtctcaggcattctaggcagtgcacagcaagagaaaagattgagataaagataaaaactggaaagaagtaggcaatcagtcatatttctgcaaagcaatgttagaaaattgcatgtgttagcttgtatacacaacttagcttacaatgttagcttgtagctaactgaatacagatgtgagagttaaaatatactctcctaacagtagaataatgattgttagagtggcagggatgatcttatagaaataaacattggacaaccagcaaaaacagtgaaagccagccatatggctatctggaggaagagcattccagctactcaaatccaaagtggtatcatggtgtgatgtctttttttttatttttgttttagagacagggtctcactatattccccaggctggtttcaaactcctgagctcctgtgattctcctgcctcagcctcctgagtatagtcacatgccaccatgcccagctaagttatatataaacataagcacagagtaacatggtagcaaaaaataatgtcacccaaattagggttttgaagacaatacaggagttagatagataaagaagagagggaagggcataacacaaaggaacaggaagtattaaaatgtgcgtgttatggacttgcatacaaattgagtgctttaattttgccaagcatctttcataacactataaggaattaacagtatgagatagcataagtaagggggcctgagaacttacataaacacccttggtacatggaaagtaaatataaaatggtgctgataattctaattacatagtttatagaaaagatacatgaccaagcttgaagcaagaatgattgataaggaattaggtaggttctktataaggaaaggtgatttcagatcccaaaagggcatggctgaatgtttagcctttcagagttggggaatccatttcttcctgtggaaggattagtctttaggtgaatagatatgtatcgaagggaaattaagagagcataagaaaaccccactttacctgccatctatccatggaagcagcaataagaccacctgagagctatggtacaattaaattgaagatatttgaacacataaagtaggtgtaatgtaacatataggctcaaacatttgaaagtgatgatatttggtcattgctggcctacaaaagaaatgattttatgtgattcagtctaatggtaatagttacaaaggattgacttcttcgcaaataaaatggttgaaatagtacccaaaactagcagattgggcaaaaattacaaagaaatatctaagtggttgcatagtaaccacaaaaatgaacacacttattttcagagttcaaaccgtggtagatttgagagtatgtttggaaatgactaatgcttagtgttgtttaccctgtcaccacattcctgcataaggctctttatctctgactggtcatgctcacatctgttttctgccagccttttctggtgcccgcaggcacccacctgcacccaatgtcctccttttatgctttctggcctcctttcatgtactgtgtggtccaccatactacctaatctgctatatactcacaaaactatttacttcttttgaaaaaaatgtattattagatttaaatawatgtatttatatttcccttcactttttaaagttttcactttatttttatactatgttttaagcttccctaatatcccactgctgaatcccaccgacatggaatccacggcatggtgaatccctgacttacccattcctactagaagtagagccagaatctaatccagacctcctgccagccactcccagaccccttctttcccccaaagaaaatgaagaacatattttttgtgcaaagagatacaatcaggaaatttttttaaaatcagcttttattttaactgaatagcttacttagtcctggggctgtaaagtcaactgaatgatggagtcatttttttcaaaatgcgacatcttcttacccacttctcttattactctcatcattatgaaaatcacatttgtgaaaggaaatgaatttatatcaggttttctttggcatcacccaaaggaccttagtaaagaaaattaatactaattttattttctattgtgagcaccttaatacggaactgtaagaataattactatttttaatgccaaatgaagcatgtaagtattactagcttcttttttgtattaacttctatacttatctcaggagtttttatagtgatatagacattttgtgaaatagatcatgagtgaaacatagacctggtatagcttgactggggcctactttacagatttgtccttaagtactgaatataaatgtttctgcttcttattttccttagcatttttaaagaaagtcctggaagccaaaaatctccatgatgaaatatttataattattaatcactgttatatgaccttattatgtatgaaaactatattcaacatcctaaatatgaaatgtgattagttctgattttaaagatttgtgataaaacaagacaccattgatgaaatacatagaaaaaggaagacaaaatagcttgggacacattaataacttacacaaaaaawtttaaaaattaaatcttctaatagatttgatatataatataccccagaaatatttacattatattttcaaagtctagagcatttcttccatagactccaaaactatttgtatatattatcatcgaaacacaattttgagagaagttggaatggcagtgcagttagcagataaaaaaaatacccacttttctttacaagtctctatctaattcatactccctattgctctttcctgcttcacaaacttcttaaaagattttttcatgtggtgtgaatatttaaaatctgtcttagcaattttcaaatatacaatatagctggccatctgtatttgtgggttttgcatcctctgattcagccaaccatggattgaaaatattaggaaaaaatgacgaaatacaacaatacatcataaaaataatacaacttaaaagacaatacagtataacaactatttacatagcatttattttgcattaagtattataagtaatctaaagatgatttaaggtatatgggaaaatatacttaggtgatgtacaaaaactttaatcatttcatagtgtatacatatatcaaaatgtcacattgtaccttataaatactcataatcatttgtcaattaaaaataatttaaattttttgaaatgtaaaaaaaaaaaatttttctagcctcccagtctacactctcacttttcactaacccatttactgctttcttgcttgttctcccagcacaccacaaaaacaacttccatgcatacaccagtatcacccccctcacccccctgtttccaataaattaaacccaatggaccaagctaaagcatttattatacttcacctctcagaggcatttaacgctattgacaacttccttcttttcaaaaccctgtcctcccctaattttcatgaaacatgaarctaccttctagttctcttatttatctcagccatctggctcctctttctctattcccttgttacctattggtgttggtatgtattccattctagaactttgtctcctctactgtgatgctatcatttagggtgaaatcaactactcccattgcttaatttgtcttttataaatttgtgacttctacatctatagctccagttctgctgtcttttttgtattaaagaccaatttctccaactatgcactagacacttccaactagtatcccactggtatctcaaattcaacattattgaactcaaaaacttcttttgttaacttgccttgctgtcatatttcctgtattggtgaattatatcagcttccatagacttgcctgagccaatataacctaggacatattctccttttcccttaactcagcattgactgacaaagaacatgctaggaagtctgtattcttcatgtcttaaaatattcacctctgcttccattgccacagctttgatttgggccactcacatttctgcagtagtctctgagattgttatcatccatatctctgcatttttcttgctaatgagaccttcattaaaattattttgtaagtatttaattatttagcagttcatgcctttccatatgacttaaaattccattgggttttgcttttttcctgtaacctaaagttacatctgggttggtcaaagtgaagcatagtaactacattccctttgatagtgctgcaattaagaccaatgaaatgtgaaggagttttagggaagctttttcctcagtcttaaaaagagacaaaaggaaacaatacccctctcctgtctctggttcatatttgatgagaatgtggcacctagtctttttgagaccagtggggtagttaggcccacaccctgtggatgtcagagcaaaaatatggaaggaatctgggtcctgataccatcatcaaaccattgagctaattccgttttgtaagataataaattccttactgtttactctgttcgagttccttttttttctgttagttgtagctgaaaccattttaactgttgttttttgtttggtttggttttgtttaatacggagtcttgctctgttgcccaggctggagtgcagaggcgccatctgggctccctgcaacctccacctccagggttcaagcgactctcctgtctcagtctcccaagtagctgggattacaggtgcacgccaccatgcccagctattttttttttttttgtatttttttgcatttttagtagagatggggtttcaccatgttggccaggctagtctagaattcctgatctctggtgatctaccaatcttggctacccaaagtgctgggattacaacccactgtgcccagcaccattttaactgtattctaaaagcattttacagcctgctaatacataacctcatctccaaccttgcttcctaagttccactctgtgttccacaaatgggattaatcacctactgaaagctctataataattcctgtcacctgaggatattgttaaaacttctcagtttgtagaagagggccttcattatcagcatcacatttattttccagaaagatatctagcacccctctaccttacatcttgcttttcagccaggaagaacaactttttctttctgaaatgtactagaatctcagtgttgggccacattgcttttttttttctaaaagactaatcgtcttcctttcccacctaactcaaacatatccctcttaacttagacattacttattttggggaagtcttccatgattaccctaagaatagggtaggcattctttctctctgcttccatagaaagtaggaaactattgcacttactcattgtaatgtggctatattttgatcaaaataattaaaaaatactgtgtggattcaaatttttctcagctactcacaagctgaatgatctcacacaagttatttattgcaccttattgtgctttctttttctctgaaatagaggtaataattatacatacttcatattattacaatgattcaggaagctaatgtatatggtatacttacatatatatatgacctagtataacgcatgatacataataagtgctgtgtacatgctcagtcaaataatggtcatttgaaaacatttattgagtaaatgaagaggaaagtgtttattttcaatacattcaaagatattgttttggttatttccattacagaggcataatcagtttactattcagaaaaatgcaagagtacatttttactgctcctccagtgatactatggaaaacaatgttttagaaaaataaagaaggtgtgaataatgattaaagaatcatacactctcaaagtgaaacaatttcccaagaaatgcggtagaataagccttttggtttctgattttttttcttaactttgcttgtatgttgtagaaagctaatctaaatttaagaaattgaaattttgaagtattaataatgtacttctctcccaaaattgttttaatgtaatgatttttgccatatggatgaattatatatgcatctagaggctaaaaaccataaaaacaagcttcttcttagtagacttttgttgtttattttgtacagcataaagcagcagtcaaaaagttttccaaacaaattatcttatgtattttgactaaacccagatttatcttcttaaaatgaagacctttgttgtagttgcatttgttcctcatatgcagtagaatgacccagcctctttggcttagaggtagtgcctcctttttacgacacttggagcggcatctgatgctcatcacttcagttggataaggaatgctgtccagtcacagagactcatgagatcatgtccaatgaaggcatttaacaataaattcacaactagtgagtgagaattttataaagcagtttcaagtattaagtagataggtaggtaagctttattatattttttaaatgtgaaattttacaattgtgaaaatttacaattttacaattttacaatgtcaggatggataacattgcctttttagtaatggtagccttcactatctgcattatgactgtacaataataacatataataatatatatagcatatatattttatatatataacataatatataacatatataataacatataattataacataataactggggctatgattgcaaacatttataagatgtggtatgaaaatgtcccaatcacaaaaacactcaatttaaaaatgaaagaaaatgaatctatgctatgctttgcttcatctttctctgaactagttacaaacaaaccttttaaaaataagctttcaatttgggaataattttagatttacagaaaagttgcaaagatagtaaggaaagtccccatttgctcttcatttggcttcctctaatattaacatttgccaaggttacatttgttaaaactaagaagtaaccatgggtacaatgctattaaccaaattacagctttcatttgaattttgcccatttttccaatattgttcttttcctgctacagcatccaatctaggacctcatgttgcatttatttcttatgcatctttagtcccctaggatttgtgacggttttctgtcttttttcttttgaagactgttcattgcctctgttagtttaatgatcctctgagatgttattcacagtaaaatagcatgtgaatttcacctaactaaaaagtttatttgatccaaagccctgattttaagaatttgaaagaaaaaaatgactctatttttcccagttctaaacattttactagaataataattgtattctttcaacatggaattaatgttgatgagaagcaaacatctaaatttaaaagaaaatatagtttgttgagggaggtaatagacaataaaatgtatttattatagaaaaaattcccaaaactttctcattaaatgtgctttatctttacttcattactaatatttagcttttattcttttaaaaagcatatgccaatgataatatctcattaataataagaatccatctaattttagcttgatcttccccctgactaggtttgattggattaaatcatcataaagagacaaaataatgcaaaaagtgataaatctataagcctcccctaaggtttcccatagaatgatcaacccaaatgtgctctttattttatgccatgaaatgacatactgtgtcaagaactgaatttcatcatacatgagacgtaagactatttttatatctctgtaaattgggtatgaattataaaagtatgctggtaaactgatcacttgagaacataaagtcaactttccctggaagagtttctcattataaaagaaaggcaagcatcttcttcctaatatctagctttatcaggtcaggggctatattctcggaagggataagtaatttctgttgtatctactaatttcatttaaaaagataactagagaatattggaagcattattgtagaactgtgtcaaagaccgaaatatcattcctaccttagactgtacctcaagatcgaagctctggatgctatctggaattaaaatgtttgcattaagtttaaaactcagtaaaataaatgtttgaaatgaaaaccagaccaataatgaataattttacttagacctactctccaaatgtgctaaaagacttgtaaaagttgttgttgttttaataactaagtcaagccagttttatttaattcaatacatggagtattaatgcgctgtatgaatgccgaaggtagtattggacgccacaatctttaggaaccatgcttctgagttttaaaatggtgactagtttagcatagattcaacataagcattaggtgttcttttgacatttgggaatcagccaatcaacaggaggaatagtaaattgaatacgaacttgaaagagaccatgtctttttttcatccaactgtgaaaaactttctttgtacaattgttaaacttaagaaacagatggtagatctgtatcagtcagtgaggggtttctgaagtacttttctggatgaatgccaagaaaatgggtttctgagacttgcatggctctggatttgttctgagctgtttagtgaagtgagggctggcattcagaacccaggggagggggagtagtcattcccattgccttgcatagagatagaatcacaggtgacaggtcattggaaaatcacttcttgagagtgggtatctttattttgagttggtatctttttgagagttggccactcataagccttgcttttgataacatttctttaaattcctccaaggaacaaggggaagtgcaaaaggaatacgataaagtgcagcattgaatgagataagcatattcaacttaaggggcacactaaatactgtaatctgggagcataactcagatttcttttcttctttgctcagtataagttgcatgatcatagaagatttatgtagaagtcagaaatcaaggtcaagagggtaggcatatttagattcttaccctattcataattaacaataaaataagattttgtgtcctgattcagagaatggatggctcagtccttataacctcttaaattagttttatctataactggatttctgaatctcttttgaaaattactaccattgatggtcactgagtgaaaaaagcagaaggatagactggtgttaactgtaatgaacatttatccaacattacccgtgggcctgctatccattttaaattctaaaagcactttacagcttgctaatacatagcctcatctccaaccttgcattcctaagttccactctgcattccacaaatgggattaatcacctactgaaagctctataataattcctgtcacctggggataatgttaaaacttctcagtttgtgagagagggccttcattatcagtgtcacatttattttccagaaagatttctagcacccctctaccttacatcttgcttttcagccaggaagaacaacttttactttctgaaatgtactagattctcaatgttgggccacattgctattttttttttttctaaaagactcatcatcttcctttcctacctaactcaaacatatccctcttaacttagacattacttattttgggggagtcttccatgattaccctaagaatagggtaagcattcttcctccctgcttccatagaaagtaggaaactattgcacttacacattgtaatgtggctatagtatgatcaaaataattaaatctaaacaatactgtgtggattcaaatttttctcagctactcacaagctgctatccattttaccaagcctcctgcatgtattactatgtctaatcctcatatcaactcatatataaactagattttatgattatggctctaaaaacaaggagactaaacctcggaaatatcatttaacctgtacaagaccttacttggctgagctaggattcaaaactaggtcattccgaggagaatataaagtccagcttttttttttccacacagggatgtatatttccaggtacagttttacattttgttctttattgtatgaacataaatatagatacatatgaaaattcgaaagcacatgaaagtgccaagaggaaatgcaataccatcttatgaaatgagaaattacacatatcttacagtgagtttcaaaattatattgctcaaagtatttttactgtggaaccataggcacaaactatagcaagagtaaatccaaaaatgtttattgttcttctataaactaactactgtgtaggatacaagggatgctgatttcaccagtgcctttaagaaggacaaatcaaattaaaaagtcaaaatgactgaaggtgataatccagatggtggtaacaataatgactaccatttatagaactttttgatgttgttcactcaacgtttctatttttattcaattataagcaaacagcagaattaacccaacattcagcaactccagatcagcttttcttacccccatgaagagctatcaatttaacaaccacagttgtaaggattcttaataagctgtcaatgagcactgctgccggtctagatggccatgccccaacaaaagcaaagccactctccctaatgctttttccaggattgctttttaaaggcaccagagcgagatactgacgcctattaaggcatctgagatgcaccgtgttggggtttagcctccatgccagccagcctctggttgtctaggtgagcgacagcaccataaaaacacgctgcgtacaattctggtattaggatcacaaaggcagagaggtgacaaatcctttttctttttctttttttttttgtaacctcccttaaagattctttgatgctttgctctattactgtgggcctggtctttttttcccccccagttttttcttctttaaactctggattgctattttcatattaatttgatgaccccatcacagtaccagaatattcctgaaaatagagttccaatttgatcaaaacataaaccagagtgagtgagtgagtgactagaattataaaggccaggcagcaggaaaagttaccctaaaccatctgactgctcaggtcttgcatgtgcaaaggggagccggaagaggagaaatctattatacatgcaacactgaactggagaacacggcttggggcctctgggacagttcargtccctgagctgccccctacttcccagacagctgctcctgcagtttgggcacatagtcgtcccactcagcctggtaacgctttctggccactggggccacgagcacgagctcgtacttttttttttttttttttgagacggagtctcgccttgtcgccaggctggagtgcagtggcctgatctcgcctcactgcaacctctgcctcccgggttcaagcaattctcctgcttcagcctcccgagtagctgggactaaagccgtgccaccacgcccagctattttttttttttttttttttgtatttttgtatttttagtagagacggggttttaccatgttggccagcatggtcttgatttcctgacctcgtgatccacccgcccccgtgatccacccgccccagcctcccaaagtgctgggattacaggagtgagccaccttgcccggccaagctcgaacttttgacagaaggatgccattttgaatttgccactgtggcctccagatccattgctgaggatgggctcgtcacacttcagcagcctgtcctgtttgtaaaccagccagacatagcggtggagatctgtgccctccggaggcccgagcccacgtaatggagatgactgggccactgctaacgtcattacccttcatgttgaccaccaggaaatgacgccattcagtgtattggggcttcttcctgccgggagcgtccgggtctgttaggaccaaggtgtagagtttccttgactcaagatcatcccatgaaatgctggtgggtctgttaacctaggtgggcgtcagcactttgcccagctcgtccaccgtcgccctggcgtaggcgacatgcagcgagtgctgcggctgcccgtccacttcctgcaggctcaagggcctggaccgcttgctgaggtccctggcatggctgtgcaagaacgcagcgcgcagctgggagtgccactaggcaaggcgcaggcgcagcggcgactcggcagcctctgaaaactagccagggaagccggggctcatttataggattttaaaaatattattaaaggcttcacaaactgtcttgtttaatagccacaacattgggaggccgaggcaggcggattacctaaggacggagttcgagaccagcctggacaacatggtgaagccccgtctctactgaaaatacaaatattagccgggtgtagtggcgcatgtttgtaatcccatatactcaggaggctgaggcaggagaaccgcgtgaacccggcaggcggaggttgcagtgagctgagatagtgccacggcactccagcctgggccacagagcaaaactctctcagaaaaaaaaaaaaaaatagatacaacaatctccttttaactgaagaggaatgatgtaaagttatataaagttcagaggaattgatgtaaagtgaatcgtaaagactttggaatctcctactaaaatattttaacaggaaagagacacatcagtgcattttacaagcagatcaatgtggcggtatctagcatgcatggggaagggatggaggaagttgtcagtttagaaactgagtataaacattattgaaataggacatgataagtacctggaccagggtaaaggcaatggaaaggaaaaggaagccacagaccacagataggaggaattcaaggactgtgtaccgaaattcaggagaatgatgtgaaatagatgctctgaatcctctattcccaggaggcagcattatggagttaggagaaaatgcaggagctttggattctagtagacctgggattgagtttttacactgttactctatattcgaagcaatatatttaaaccagctgtgtcttccttttgtcctttataaaacaagaataataatgcttatcacatagagatattatgaggattgtataagacaatgtatcaaatagtaggtattcggtaaatgttccttctttactaaagatagagaaaccattttctgatgtacaaagggatgaagagctggcccaatatgaattttcccaaagaagttaaatgaaaaggatctcatgatccttttcaggatttattatttacgaatgttaatatattattttaatattttctatcttatgaaataattatttggtcaaaacataagacaattgataggaatatacagcatggaaaatggttaccaactagagctgcagggtatcagggaatgtgacaaggcagcaaaatgtttctacacatgtctgttttttcargcattatctttcwtgagactatcaagtgtgtatttaaggagccattcaacttacttcagtgcatttgcttgcaaagggtgcaatgtgatgtttcctactggtagggtcgtatttcatatgtggtgatagtgttgctgaacaaataggaaatatccttgcctagactatattttatcatttcattatctagtggtaaaggaatgtgagttctatttacaaataaacattttgtcttacttttttctttgtgatctattttctccaagttgcataatgtaatgaattaataaagcttagttgctggccaaatcaatggtgactttttatgtttttaaatataatattaggtttaacttatttttgtcattaaaatatcatttgtgagtgcttttcaaaatgaagtgcttctgaaataaatcacataataaaactaaccttacttttgaaatacatttttattgaagcaaacacaaatcaatctgaaattcagcattttgtagcagttaaatgtatagtcaggcagcttcaacgtcaactagagaagttgtggttttaaccccgagatagggctgattatgctggtgctatggcaacctattgcaccatttggtagcgcctgtgtgcttaaccgcatgagctgcgcctcttcctttcctataaagactcagaataagaaaaacagaagtacaccgaagagaagaaaccacaagagcagtaaagacactgctgttagcttttagctgtgcaaacagcagtcttatgagaacaacacattgaaaacctcttctatttgaaagtgtagcttttcccattatgcctgggttcctttaatgattttgaaagtaagccaagtgtttctgttcagagttttcattaaagggaaataagaagaaataagcagtgcatttatcagcctttgcttttattgtcctcagctttaggagtgggaggcttttgtgcagcctcagcagacattttattctgtttgtgagatgggagattagtttctattaggtggactccctataatctagcatttattttctgcttttttttattatattgtagttagttcacaaaaaaaagtacaattttaattcatctcctggctcatttagaaagggttgtggttggtgctgtaaacacgtttctacataactagattaaattcacagacactcactgtcctagcactgtttattttctatggggagcttcatttacctattctttccctcaccccacttcttttacaaggtataggttgatcagcaaaggcttttgtatgttttcctttgtttcaaagtacagacataatataatcataacttttttttgcatgttctactatttttccttccttaaagatttgggtaaaaatactgaaggacagacaagttcatgctaccatttttgttaggcataggcctgttcacttttcttcccatttttctgaaaaataagaatctaccccttttgtagtcattgtccagcaatttacactttttaacaataagttttaatgtgtggtactctgaatcccattttgatggttatacataatatttactcatttttgagtccctaatagctctttagcacaaatactggatttagcattaaatattttttccttacagtgcaatgcagttgaacaagcatgggggtttttacagtcagacagatctgcatttaaatctagactcattttgctacaagttctttatttagccttgcatacacgtttttatgattttgagctttcatctgtgaaaagaagagaataccatctactttgtaggatttctataatgattagataaaataatatgtaacagtatttaggacagtgccattcacatagtacccgcttattaaatagtaaacactgttgatagcaccaaatacactaataaaagatttcaccacttatgcaaacatcttttgatgattctttgttctttaatgatgatcgtaacctatcctagaggaagcaaagagctacaaaaacatacacttactaagggattaatataattaaatggtttttgctatctgaagtatattgcataaatcaggtatatatccctggatttaggtaaatgaaaacagacattttcataagaagcaaaaagataattaatatgggaacaaacctattctggaaaatgtttaaaaagagaatatgggtaaggaagcatctttctcagttgttcttaacccttgtttccatcataatcaccatcagagctttaagaaaataccagtrcacagatcacgttaccccacaaacctactaaatcagattttccagcgctggagcccagaaatagtcacctttaatctaattcccagtcaggattaatacaaataaaggattgatattttttcttcctcaggataataatactggttacacacacataaatatacataactgataacaagccagaattttgtaaactatgttctcagaaacattgcagttacattgtacaaatgtcctatagtatgtccatgggaaaaaaatgggtttgtggcaaatacttttaggagatcttgagctaaacgaagtgacataagtttctatgcttttaatatattaacacactttataaatatctcaaaagggcatgtagcatgaattacttctgaaacaaatttgactatgggacatttaaaggcacacaaatctaaatcaaagacttcaatttgaccatcattgcacaggaagcgataaaattttccccctgacttgtagataaatagtttaagacagaaaaaaagcagtgtaactgattgttcttaaatggttatctagtagcctttattaatttttttgtcattaattgtttcgttaatcaacatgcctgaaatatataacatgatgttttaaaccaaatataaaatacctacaaatgcattcctagttttgaggtgtgtgtttgcaaagtcatatgtattcacaagcaaaaaacattattgtaaatattggacaccataagtcattgggagacagctagatatggttgctatctttaaaattttttaattatttgattttattcctctcatggccacaaaaatttgccttctttatcctcaatactgctttacatactgatatttttctttattatttgcattattatttaaaagtgtgtatataatttgaaagtttaaatagtaccataaggcctagagtaagtaagaacagtcttttgctcccacgactctcccctcccttgatattttgtgatttttaaatgttatcttttattgtagtgctgtttctttaaaacaaaaaaaaagatttttgccagtatctattgacttcttctcttgatcttgagatgttgctttttataacctcttgctctttgttcatgggtgcaatgttttctcatttctgaaaatatgaattgtagttggttatcctctcttttgctccttgcattgcctcattctcccaagtgcctcttttgtttatttgagctctatctttctttcttattagaggctttgttctagtgtttcttggatgtccatttgtatttaataaaaggcctcaataaagggatgttgaaattctttggacattggtggagctcataaattcatgtgctttaactagattgaatgaaatcagaaaggcactacactcactgagtcttagtttccttatatatcaaatgaactgcatgtcaataatcactaaaatcctttgcttctgtctgagtagaaatctttggaattattttctgatgataagcagaaagtcctttactcatgagattccaaaaataatattaatatacccaatattttaacataacgtctacataaagaataagaaaattattaaatagacactatttcaaatctagcactttcctcgtgtgtgcctgtgagcaatttactaaactcttttaggtcccagtttcattccctataaaaaaggataaataatgctaactcattggcttactgggatgcttaaaagaaaaaaaatacatatatattatataaagaggtgtgcatagtgtctgctacataacatttcagtaaactgttgccatcattattatatttactgataagctaatggagggtagaaaagactgtttcctgtggttctctgaaatcataatacctggcttgtcgctgcccagagtgcttactccataaatacttaataatttaatatgatttgttagatttattgtctgtggaccatatagcagatttctagcataaaaaaagtgcaattctcttatttttattgtgcactttattattatcatgcattgctaagaaaggaaagccatacatatctgttttagctgacccttattttttgtcttgatttgcttttttccacttttgtacaggctttatgtttatggaggtcaagtatgcattctcaaccttcaaaacatgctatcattcattttagggcagatgctgagaataagtatttatttaatctattctattttacccttctgcccttgtacttttcccagatttgcagaactagacaggtttaaattccctaggaaatagcatcccatttttttttcttttttttttagcggggagggagaacgggtgatatttaaagcccaagtatgtcttttgaaatgccgttttcactcaaattgattcctagtttttgctgaaatctctgatcagggacttaggggtgtgacttcaaggtaactttgatttgtgatcatttaaacattttgagttgtaaaagaaacatattgggaaaggtaaattcagtaacaatacatgtgttagaataacacagctttgaagatcaagtgttctgttatctacattttcatctgtttaatgtatctagtcaattccattggtgattcacaacaggattataatgggaaaaagagctcttagataatttacagttttttagtgctatggtgccacctactgaaatattactaaatactcctttgactaaataatgaaaacacaagacatttaagttttaaaaaatgtagaaaatttcatccctagaagataaaagtcaaagtgtagaatgtagtaactgtaatatgtggaacactagatatattactgtgttttattttatatttatttgatgtgtttatagaatttgagagaaagctcaatgcagttcttactttgagaaatagtgatgccttctctttattgtcacacacctacacatgtgccctcttaatttccattgctatgtcacatattttgctttacctattttccacactttcccagtattgttcataaagaatgtttacatatattgtagtgtaatttgtattaaacaatctccaaatattaaatatttattgtgcactggttataaaatactttatgcaaaaattttgtttgcttttcccagatctatttgactccactaagaatatattgttgcttttaagtaatacaggaaatagggtagagtacaaggctgtctacatacataaaacaacttaggtaactacatcagttcatttgttttgcattggacaagcacagtaatatttaaccatatactccagtctaaatggataggtcatgaagtagttaaatatgttatacaaccaatcttttgttgttgttgttgttgttgttgtttttgagtcagggtctcaccctgtcacccaggctggagtacagtggcaccatcacatctcactacagcctcaacacacactcatgggcgtagcctcccaagtagctgggactataggtgtgcaccaccytacccggataatttttgtattttaagtagagacgaggttttgcatgtttcccagactggattgcttggttcaagcgatccagctgcctctccctcccaaagttctgggattacaggtgtgaaccattgcrcctggccacaaccaatctcatcaggtcttttttttctatcagtgaagattcagcacagtggcttctatctatgattttggtaatgtttaataatgtttgcacatatgaagtgcaacagacaattgaagtcattgctcatgtaatttaggaagaattaaaatatgatagagaattaataaattattgcagatatttggttttatagttttctctaaatagttaagtaccttcacctactccctaccttgtttcatatataaaggcattctccaccaaagtatttgttagtgttctgctaacgttgatgtaaaaatcattagatgactgggggggcggggtgtggggaatgtcctttagatgttacgtaggtgttttaactaagctattttatataggtcacatttagcgtgttcctactttaagactggtaaaatgtttaacattaaaaagactgaaaaatagatttatgtaatctagtgcacatggcttattaaaattgatatgttgctttaagttgcatcactctagtgcataccttatttccttaggggcattggcttaaattttaaagtagtttttaatttaaaatttttattttaaatagattctatgtgtttttttcaggcacgaaaacatttttatgtcatttatcatgttgactaaaagtgttaccaaaactaaaaatctgtttatagggattttatgaccatgagaacaagcaagttgagtcttacactaagtctaaacagtgatgctgaagtcttggaattttcttttaaaaagataaaatggtgtgtggggtgtgtgtgtgtgtgtgtgtctgtgtgtgtgtgcacgcacatatttgaaatagtatataaaaatgaaataaaacatagattacaatgttttagtgtcacctaaaaatcactcagtggaggaatttagaatcatatccagtgataaatcagtgtacaagcaaacacatattcaattcaagaggcctttatgggaagtaagcatgaacatagaagaaaggaaaatgttggctctttagatattatactgttttccaggatattaaattttgctgcattaaagatgaaaagattcgaggaaattttgaatatggagcgatgatgagatcagaaaaaaatgtatatgtatgcccattattctgtcctctagctccagaaacctcttaacatctaaacaaaaggtctgtaaattttaataattgtgcttgatattagtgtagtttggttgactttcctgtcaaaatagtattctgtaataaattaacttgacacacctctaaattttctctaatatttgtttgtaccattatagagcattcactcagcacattgtgatttaatctgcatatctatttttagggtcaaggttattttagcatttgtagcactactagtaatttacttgcagccaaattatgattaagatgcatttttacttagctcatgagtttttaataaacaccttctgtaaaagaattctcatgcttaaaatttcatatgaagaggaaaggctgtaaggacaagttgatgggaaaaggggacgcctgatgaatgagagcatggcctgtaaagtcagacaggctcaggttcaagtctggctcacatatactagactggccttgtgaacttggccaagacacttgacttttctaagcttcttagggtttttgtggtgcttaagaaagaaaacataagcaaaagacttagtatagtgcctggcacccagtaaacactcaataaatattaacaattaataacaataaaatattatttctaaattattctttaaaaaagtaaatcattagaaacagtcttctccgttttggtaatttacctcttgtccttcttttcagaagttagattaaaataatatacatcatgtatttcttttaaaaaacgtattgcctttggaccacttggaagtttattaatctctctgagacatggaacatatacgtagtctgatgaatagtgtactggttggaaacagttctagtatatttactcaggcattcacagttcttttgttaaaaaacaaatagcttcacatagtgtcccagcatttttcttctcatttctgtggtaaacagatgatgaattataattttcttttatgaaactctatctatagttggtgctacacattttggtgacaacaaagtagtaaatcagaacaacagaatataggggtctgtggaattagtggtgcaggtaacattaagatttctcttttctctgtcatcaaatttgctttctgatttctcctctgtattaactgatccaatggcttccgtcattctgaggaaaaagttcaagctccttttcaaggcctacagtgcttgctccttggctcttctcctaaagctgttatcatcagatctgtttgatttctcctttgcacttactcatgcttaaaagaatccagcaattacttatcaatcacttcttatacacaagactctttgctacagctatttctctttcttctcctcctcttcctcatcttattatgtgattcatgctgatgttgatgcgagaaattttgattattagtcttaatcaggtgtatccatgactaaaatgtcattgcagatgactagatatatgtgttttatgggttataagcttatccagggcaagggtcatgcttttatcatgtttgaacctagtctccaacagcataccagcaaaacaatgtatgtttcttgaacctaagtgaactaaattaacttgtttcaagttccaaggaatgaggtgcttgcatgagaaggggcatatcaacctaattttagatatgtaagagctcatgtatttctcagataaagaagagatatgtgttgtataaagtatgttcacacactcaaaaacaatttgaatattttaaatttggtgatatgttttgttcttcacaaacaatgaaggacacttttcctttcacttcaaacatgagagctattagttattgctatactaatatttttttcttattacctcttttgcaaatcaacacaattctaagactgtaatttacaaggaaataagaacaaataaggagagcggaatgctgttaatgggaacataaacataacaatagtttacatgaaacagaaagataaaagctaactagataagaaaagggacaaaagtacaaacaatatcaattaaaaacaatatttaagtatgaattattaagaaaaagagaaatgtaatgagaaaacaagaaagtcattatgttaataattatgtatcacccatcaatgatataaaaatatatatatcaaaaatgcattttacttcaaggaataagccagggaatgtcattgaagaatacggggtgatgctccttggatggcaactctgaaggaagaaaatgttttcacatcagtttgttctcagaagataaaatataaaggcagaaagtcaccttaagtaccagctaattcactttcccatctgatctctgattctctttaacaacctgagtttacagtcatttggaaaagaactttacaatcttttaaataggcatttactaagatgagggatgaaaacattgcacttcactgtagactgaatctagttcccatcatgccaagaaagctgctcttttcaacatttccacaaacccagatgataaatccagttgacccatgttaatgcaccatgtttatcctgcatgtgaatccccatattatttgacttcaaccatttccttctcraaacaccctctactctttattcttgtttgctacagttttcctcttacttggaaaatttgattacctatgctggctctctccttaatattcactgaacttcaggattctatcctggacacttctcttttatgtagttcggtgatctccttcacctctgtagctgcaaaatgtatctatatgctgatctatagcatcagcccagatgtatgtcatgagctacaaacctctatattcaaatgctattatacattttcacatgaaatctcaagcaaattctgattcacctctctactcactgtttattactctcaagttcagtgaaactataactcactagcatgttaaactatcaatctagatattttccttattactctttctcctttattctcacttgaaaggatttacaaagtcttggtgattcttgagtgtttcataggtccttttcccccaacctttcttttggggtatactcttcctacgtaggacatcatctctgtctgttttgctttggttttggtctcctgattttcctgcccccacctttgctctttaataatccattttccatttcctgaaaggttgatctaaaattcaaatgtttctcctttaggcctccctttaaagacatccctttaatggatatctaaagcctgtaagataaatcccagcttcttattcttctgggaccaagctagctatatgcaatcctttaggttgtagcttaaatacatccaagaaaccctctgtatcaactcctttaccagccaaccaccaactctggaaatataaataagatgatcctgttatgttctcctttagcacattctgtatcacctgtcatcacactgtattgattgattgtttttgtttatatctcacactaaattgagctcattgagggcagggaatttttatatgttggtcatattatatccctagcatgtggcataatgtctagcacaaaataggtgctcaattaatcatcattatctaaataaataatgcatttgggaaaaaaaagtttcaaaagtttttcaaaagtcttttgcaggcttgaaattaatcccaatagtgatcctttagtctgttatgtttctgatttagcctggggattcaaaaaataaataacataattttgatatatttgggctttgtaaacatggtactaagagaggaaatatagtttcattagggtaaaagctactgaaaattgccacttggtgaatgttctatcatagacttgaggtacatataaaaatctaatatatgtttacattaatatgaatgaaatttgaaattttctaagagatttttgtttcttctttgcagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatgctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtccaaatgaagaaaacaaataaccatgaaaatagtaacaaaaacacttctgaatctgcataagaactatatttccttatttttaaagaaggtctaacacaattttacagcgtttagcatggcagtgatgttttataaataaataaaagtcattcttgcatagtagattgtgattggtttatgccagctactcaaatgcaacttagtatctccaacttttacagaagatagattcatctcaaccataccagatggttatttttgcaggaaagggataggtataaggtagaatggggagtgattctttaaaatgacacatgactcatcaccttattgagggagtttctgttatctctgaattgactctattatgacaagcctccaagtgatgaaaccaggtaagttaaaactgttaaccaaaatgcaaaggaaaatggtctctcccaaatattggccacaacaatgtcatcaatggaaaccaggagaatttgcaaagtggaggttcaagaacaatgtggaattggcaattgagtcaggttttctaattttaaattcttatttgtgaaagggaatgtgaactgaacttaagatgtgtgcaaagatatgaaggagagtagttctctgaaaacctttctccctacccctgggactgaatttgcttggctagaagtaatctttaggaatgctactcatcaaaatagcgtggtactatgtattagtctgggttctctagagggacagaactaataggttagatgtgtatatgaggggtagtttatgtgattgacacacaatcacgaggtgaattcccacaataggccatctgcaagctgaggagcaaggaagccaatccaagtcaccaaacctcaaaagtagggaagctgacagttcagccttcagttggtggccaaaggcccgagagcccctcacaaaccactggagtaagtccaagagtccaaaagctgaggaacttggagtctgatgttcaagagcaggaagcagccagcacgagagaaagatgaagaccagaagactcagcaagctcacttctcctaccttcttgtgcctgctttttctagccgtgctggcagttgcttggatgatgcccactcatattgggtgggggtgggggggttggggagggtctgcctcccccagtccactgactcaaatgttaatctcccttggcaatacgctcacaggcacacccaggaacaatactttgcatccttcaatccaatcaagttgacactcaatattaaccatcaaatactattataaggagaatgttgcatgattttccttctagtctgtttgtaattcacatctaatgaaagagtgagagtggacgataaagggaacttgttgaaacatttctctcaaagcaaaagggatcattggaagcaggcagacaccagaattggtttaacctaaaaataacaaattaataattatcaagtctataatgatgacagtgacttaatgtgaatagaaagaattctaaactctctccttccttcctccctcccttctttcctactttctttccactccctttctcccacccccttttcttttcctttcttttctcccaccctctctccctccctttcttttattcaatgcatagtagttgaaaaaatctaaagttagacctgattttacactgaagactagaggtagttactatcctattactgtacttagttggctatgctggcatgtcattatgggtaaaagtttgatggatttatttgtgagttatttggttatgaaaatctagagattgaagtttttcattagaaaataacacacataacaagtctatgatcattttgcatttctgtaatcacagaatagttctgcaatatttcatgtatattggaattgaagttcaattgaattttatctgtatttagtaaaaattaactttagctttgatactaatgaataaagctgggttttttatttatcatactatttccattttcttctctagtaatattgcaattttcattcttaactctttcctgtcctatcatttctactccttttctagtttctctcattctctccctttttccatatttgtgccattgtcttttgcccaatcttgttgaactgatttaattattttttgttgtgtgatatagttcagtttttacctaattaaatatttaaatttttttttttgcttttcaaaaagtaaatatatgttaagcaaaaaaaaaaaaaaaattaaatacatctttataattccaacctccagagatcacatgagcttttttttttttaacacatttggtatatttttctattcttttattaagaaaatcacttttttcagtaaaagagcattaaaaaaactttaaaggactttaatcaacagtgctgatttgccctgcagaattttttttaccattgtacactcatgtcaactgtgcataaacttatttcactactactttgtcacatattttcctcttcttaaagtaaacttgagctgtggatattatttcagtattttaaattgtatctctttgttatcatgacgtcaaagacatttttgtagactttggttgtttgtaaacctagttgtgagttttgtttttcagtcctttacacacattttcattgctttgtttgcttttaatttattttttaaaaaatccatgaataggccaggcgtggtggctcacgcctgtaatcccagcactttgggaggccgaggcgggtggatcacgaggtcaggagatcgagaccatcctggccaacatggtgaaaccccatctctactaaaagtacaaaaattagctggatgtggtggtgtatgcctgtaatcccagctacttgggtggctgaggcaagagaatcgcttgaaccagggagtcggaggttgcagtgagccaagatcgtgccactgcactccagcctggtgacagagtgagactctgtctcaaaaagaaaatatatatatatatatatagatagatattttttcatggatatatatatatccatgagtaaatggaagttttgtcttttttttcccctggaaccctagccctgctaaaaaccttctaactttacctttctctatccttttctttatctacaactttttaatttttttaatcatctttaccattatgcttcatccttctgaactcaattgctttggataggcgagaagctgctttcaatttcatttccccatttttatctttagctaatgttctgtagcttgttttagatctgtgtctacatattatatgtatctctgtatgcatcaatatttgtatatatgcatgcatatatgtgtatgtatatttatgaatacatatacacaccatatacatacacttatgtatggtgtgtgcatatgtatgtgtagatatatgtacatacacactatagtggactggggagttagtatactgggaggagcatacatttagggtatgattcacatatttattttgtccttctcccattttccattaattaacaggattgactacagcaaagatgcccagtgttccactttcaagtgaccccttacctrctcacaccactgcattctcaccsgcaagcacctttgaaagagaaaatgacttctcagagaccacaacttctcttagtccagacaatacttccacccaagtatccccggactctttggataatgctagtgcttttaataccacaggttggcacacaaaagttgttaacttaaatatcagggaatgtcatttagaarattctacagttatcagtacaacttgtctttaaattatttgcacagtttctaagtawgtgattttattcaagtgcagaaattgcaggaaattagtatctgtgaaatayagatcgactgaagtaattaatgcatgttgttagggrgtggagagagaaaagaagggaagcaagatctccaaggacaatcaggaggggaaatttgttctagtatcctctgatctatacacactcgccatgattctcccgcttggcttcccgccacctggacagatgagaatttccctagttcagagattatcagttctactctccttggaaggtgtcttaaatgggagtcttcccatttctttgtttcactctagattctctttatccaaaaattgttgaagatagagaatgtattatttttaaatccactctgagaatcgacaacccaattttgttatttgagtttcttttaagagcatttgcatcattgaaaacatttttaattaaggttgtgagttctactggtaaattaaaggcaatgtagccatgttcccgggaaaaatcagattgatgcaagagatatttttgccaaggaggggcactatgctccttagaatactgatatatgtatatgctcatttaatgtttagcaataggtctgccagtgtattcagactcagatttaccatcagtagagtgttcatgcttttctgaaataatgtgttatgttgacttttttgtgggcaaacaggtttatagacatactctgataaaagatactaagctatttgaactgtttaacaatgccatttatcttcgtttgaaaaacaagcatatataataccatcacagaaattttgtttagggtacatcaaagtattttgagtaccttamtgatgaagtttattggatatagtaagcagttaaataaatggtcagtgccttcctacagcaagtacaagactgtgtatttaatcttccatttgtttccctgtcaccatagcagagtagtaactaggacctgtctaaacactgtaaaaatttgaacacattgcccaaaatttttacaaaaggaatgcaaggatgaaggtgctgatgactaggtggaacatctcatgctattttattattttgtttattgcctgagtagtgtcacattgagttttccttttgaaggttctgtatttcacgtcacatgcacaaataaaaacatgcaacattcttttcattcccacatttttaaaacctaaaaccacttaagccataaatttacaggtagagcaaagtatgagaaaggtttaaagttgaatagattgaaaataaggatgaataattttaaaatactgatttgttctagcaaaataatactgatgttgaaattaccttgaaaagttcatgctttcaaataaaaacacactttcttttctagaaaataatcttttcatcaggtgatacttcaattatctattggaataaagtctatatgagttatttaatttatgattatgattgatttatactgctgaatgcagtcaatttttttcatttactgatataattgggggaaaatcctttaatctgcatttctaagaatattattacacactattcaaaattgttcatttttgaaaatggctacaatgaccatccatgtgcataacattaaatttaattatgtaattttattttataaagatagtttatgactatttcaaagcattttcaatatagatgggtatgtgtgtatatatatatttgtatatactgttaagtatatataaagtatatgtatgtgttgtgtgtatatattttaatcctatgtatacatacatatacatatatacatataggattaaagtatataaaatgtatactttatatgtacttaaaagacacacaatgaaaataccctttaaattctgttccttaaagatacctttttaaccattgttgtatatcctccaggctctcaacatatgattttgtgagtatgcaagagaccgtgtatgtaagcatggacatgtgagattgtttccacatgttttcaaacactagatattatcaaccttttaaaactctgccagtatgctagttagaaatatttcatgttgatttacatttaaaaaattgttcttaacactgaacactttttcatataccttttggcccttctgtatattaggtagatgtctgtcacatctcttgtccatttttaaatttcttcttttctttgtaatttgtaagagatactagtacattggaagattcctttcttattctccctacaaagaaatgtcccatctgtcagtttgtagagttgatggagaattcagaaagctcatagtgatgtgaaagtcaataaagccacctggaaacacgaattctctatggctgcatccagctcaggaaacctcccaaggctatgtaaatagaggactcaggtgcctgtcactttccagccaagcaaatttaaatactgacagacacattttaacagattcagttacttcacagtttggtaaactataatcgcaatttgctccttataacctcttagtaaattattcatctccagtgggggaagactgatgtaatgatctcactttcctaccttaggtgtttcatcagtacagacgcctcaccttcccacgcacgcagactcgcagacgccctctgctggaactsacacgcagacattcagcggctccgccgccaatgcaaaactcaaccctaccccaggcagcaatgctatctcaggtttgcgggtcctttagacttgtgcaaatatgaaaagtacatgacgactacctgtatttaagaatggtgtgaggaaatctaaccacttattcaatgtgcagctattgctagttgatgaatttggaatttcagtcactcttaggaatatgaaaccacagaacaaatgtccttttaacagagatgaaataatagtgagaattgtgagactacagcaaaaatctgctcaggaggaaagagttattcagaatagtctattttttatatatttcaggcaattaccattctacagggaaaactttttgttagaagtaagaaataatatgcataaatctttacttaaagactttgtaccaacaaacaaaagggtgaagagtgattcctattatcagtgaagggcagtgagaaattgtaaccacaatgaaactgttatttaaagaatgagaaaaaaagaaaggaatgggtttatttcccattcaaacattaagaatctttcaggatggcatctctgtgtttataacaacaatgcagaatatttcctcccttttcttttcaaaattagtgtccaaatcacttcttggtgtccttttatatgcaagaaaaacaagtatgtcttttgtcagatcacaaatccacacagtctcgtatataatttcagtgatctgagtgcttgaaagttaaagatataaatggtagacctatgtagctggtaggaacatggtcttgctttaggtaggaatcaaacacatcaaatagaataattattattttgcagtattaaaactgtgcccttggcataaaaatcattccaggcaatccacactctttaaacaagtgggagaagagccgccctcaccttcctcattccatctagtccagctgccatgggaaccacaataaaaatatttggagcttttagcaaacccacagatccagaaatagtggaggggcagaaactgtaaaacaacaaaaggggactgacccctggggctggttgtcacacagactagtctgctctgtcctgatcaaggaattcttcttctcaaagaagtggctaattccactgatgaaaaatctattaggattaatcaacctaattaaaattgtaaatgccgtccataaccaccactgagagtacctacataacaagggaaacgaagttttcaagtgaggaggagggaaggtaggaagtttcgggaggttgagagtggaagcctcaaaacagcttgggagcagggtctgctagagaggggagaacagatcaagtgagtgagaggagtgtggaaaagaaggtggaaaaaagctgatttcaaaactctgcagagggccagttctatgtctgaatgagttttttaaaggatgaataaatgagctttcctcactcttctacatattctgctggagccctcctctggggatccagagtggaaaacctcatgtttatgttgtttattctattctatggtttagttaaatttcgtggtttagtggcttttgaagactgagctgagaacccatgctcaattatttggaagatgcattttcaattctaatggaatgtatgtgtgaaattatagactgtactgcatttgtaattggtagacacctgcaagctcaaatcaaagccatgttcagaacrtgcatgcatgtatcactgcagaaatacagactctgcctgcaaatgtgagactaatctcacatcattgaactgatgaccccagggatcttgacagaaaataacccaacaagctcttgaatagagggcagctcatatttcttttgctttttccatggcaactagcatagtgctagtcatctagtaggaaccaaatgaatatacattgattgcctgtgctgtaattctggatgtgatgttgggcaaaggtgtaaaatacattaggtaatttgaagcctgaaaatggaaagttctaacctagtacaatgtgcagtttctttggctacaacactagattctataccaattagcaactatgtgattgaaaaataagagaatgatgccactgtaatgtggagtttgttggatttcaagccaatttgatttttcctggccagggaagcctgaattgtgaaagtagaattgtaaccttcagctggaaaggaagaaaaagaaaacctttgagctcatgctgtggcccaggcaggatcccattcagctctattttaagaaaattaaaactgagcacctgcacccagggatccctccccagagaggtgtgtgcctgcaaggctctcagcatgtatcaagttgcacttcctcctgtgccaaccttttacactcagagctctacctccatctacatggtctcagcaccactaagacagcaccagtctctactgctttgatgcattttttatattgcctaaggcagcctgcagcccagagtcttaggcttcttgggctgtccaaactatatatttttttaagttgtgctctgattatgaagctgcataggtttccagttgtctgcccctaaatgcatctttcccataagccctggtatttttggtacagttctgtagaatgcatgtgtcrtggtatagcagaagtgcttgaagatttgtttctctgccttatctttagtaattgtgtttatgttggctatctggctattgcccttgcgtgacagacacaagtgacagtgctgatggcccttctgattgcagatgtcccaggagagaggagtacagccagcacctttcctacagacccagtttccccattgacaaccaccctcagccttgcacaccacagctctgctgccttacctgcacgcacctccaacaccaccatcacagcgaacrcctcaggtctgactatgctgctctagtagtgtcttcagttatagataatgaaatggaaactcaaaactttaatgtagctcttttattttgtgccagatattatttgtaggtttcccattttacaaatgttcacgtatcaacaccaaattatgcaaaagaaacttgccagtaagctttttctgggcatattttattttactattaatattataaaagtccatggcaaagaagaatcaataataggccttaatgtcatatagctctgggatcaaatccaatttcttcaacttcgtagctgattacagggcaaattactaatactttctgcatatcagatttgctttctgtaaaaatggacataataacactccttttttaattatgtcaaaataattaacgtgatgtctgaatatgtaaaaatctggtatgtaataaatattttaaaagagtaattgtgacgcttattagaatccaagtatggaaagccgtgaatgaaagggaaatgaatagtytgaggaagattgcatatcatcaactaagaattatatcaaggaatgaatagttttccctcaatttatacaatgtttagtttaaataacttgaaataaatctttgattcactttattattttaaaaacaagcgaaygtcaaatcaaacgmggactcctagagcaaagatgccaataggaaattatctttgctaaagagtttttctttcaccttttaatataacgaattaattagcttttattcttctattcattttcttgcagatgcctaccttaatgcctctgaaacaaccactctgagcccttctggaagcgctgtcatttcaaccacaacaataggtgatattaccctcagtcaggcagccacaccatccccatgtgcctggtgatgtgctctcacaagggccttccacccactctacctcgggctcctttctttaagttgcattaagtgtttgaatcctgagggtgatggaacagcaggaagatatttctctgcttagcagtgcaacagctgatgagatcaggatgtaattgttactgtcataattcatcagaaagcatgtgtgagaaacaaccacatctactagaactttttctcacaggggtttaggtcttagtaaggaaaagaacaagcccatcaaaggggctgtccattgcaagtggtgagcatcagacggctgatggcagagttcccgttaagcagtgagagggcgtggagataaaggaaagagaaactgaggaatggctgcagcaatggtggtatctgtgaatcagcaagtaagctgatcagagcttgcaagcccacaattctcctcaaattcttccaacccaaaatcaagatgagcagagatctcttagcttacacaaagcacatgttctcccaattattcaacttaaatgcctacactcacacaagatactgctaaatttgttgacagagcaatttgttaccctggatctagtagatgtgcaaagagcttacaaaagttaatctagagaatgaagcagtctttgcattttctctgacttttttttatgtaaatgaaaagtataaacttcgtactatgggggttataattatataaattaacattgagattaatcaaaatatgaagacctttaaaatatttttggctgtgtgaatcttcagccatgttgccataccgccaattagatgcgtacctaaaagtcttaatattgttaattgtatttattgggtatatttatgaaaaattttatagaattagctcattcctttataatgctttaagttttgaaatgaaaacctgtactaggcaaatccttcatattctgttaaatctaactagatagactttatgaagtagaagtattgtaaatcagctttcccaaaaatgacatggcagatattctaaagcaaaattttaataatttacattttttttctccattacagctactactccatctaagccaacatgtggtaagtttatttacttagaatcagcatacctcactttggaatagcactttaattacatctttctttattccaagctttcaggacccactagtaagctaaactcactggctctaatttctcaccgatgactagtctcaaattagtaaaaaattactagctacacatggacatagagttgggaatgatagacactgggaaatacaagagcgatgatggagggaggaagacaagggttgggaaactacctatattgggaactgtgcctayttgctgggcgtcgaattcaattttactgcaaacctcagcatcctgcaatatacctttgtaacaaacttgcacatataaccctggaatccaaaataaaagttgaaaactaagttttccagttagacaactttggtaaagccacttaatttaatttaggtatttgaaaaaaaaatggaataacagcaagtttgttggtgagggggagggggacaaggattcagtgtgatgataaatataaaatgtggataataccttcaaagcttatcaagaagaaaaatctctctttttctctctctttctgtcttgcttgttaggggctggctcaaagcagatacttgaaaacagtttgtctctctttttttttttctcattttcttccttgattctcagttgaagcaaagcggttcttcatggtcagggcttattcctccattcatttctaagtctaaccactggagtcactgccttcagtagctttccatacatttagtgtaaagagtggccttcatatgtctgtttaattaatatgatcttttgtaatccggttgtcattcatctctcctcccgcctcttgaatcattgcctccttatgttcttcacttaagtaatatggaaccactttcagttttcttttctttctttctttcattcgttagttctttctttcttttttttttttttttctcactctgttgcccgggctggagtgcagtggtacaatctcagcttactgcaacctctgcctcctgggttcaagtgattctcctgcctcagcctcccaagtagctgggactataggcacatgccaccgagcccagctgatttttgtatttttagtagagattgggattcaccatgttgcccacgctggtcttgaactcctgacctcaggtgatcaacctgactcggccttccaaaatgctaggattacaggcatgatccaccacgcctggcccacttacagatttgtaaacacatactgttccttcctgcctctgtggccactcctgctcttcctctacaattggaattctgctccaacctcatcccccaaaccccatgtctatttttctatttcctgctcatattttaaaacacaaactaagtcactttctctggaaatcctgtcctatacctccaaatggaacagatctctctctttctagtgccacattatttcctgcataatcttattttagaggtttgtatgtctcctgcaattcatgcttgtgtctgcctccacactggattatacatttctaaaagctgattatatctaacttgcctttgaattcctagtattggtgaccatgtcttacatatgacaagggcttaataatttttgttgaataaaaacaaatgaataaatttatatttgttgtaaagatatttttatcagtcagcagaaattgttgacactaaacaaaggtgctttggaggtatattatcaatcataattttacscaagttaaggaaagaatgagggcttctgatccctgagtaattaatgccccacatatatcaagaaacaggtggttaataactacgttttagaaaacaagaaaattataaagcaagaataaatttctcaaatgcatcatttatttgtgcatcaagtcaacaagtaactagtgagttcccattaatgatacatattatgcatactcctgaatttacagtgataataaaaatagcctagactttgctctcatggaagttccaagtccagctaggaagacagacacttatctggtaatcatccaaatataaatttacaagctgaggtccttgttagggcagtaaagcacagataattacgaaaaaaatgatatggaggcacctaatgtgttttttctttttcatgttttttggggatatttggttagttgatttgatattttkgcatttgcattaatgtagttttatttattctggaaaaataacactcaatgttctattttcttttagatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattamtattagatgtgccaccaggtaaatatcaatttatttcttttaataaatttataaaaacagtacacttttgtgtgtggtgttctccagtggtcacaggagctagtctggtgagagaacagggctgagggaaaggaaattccttggaaacaagtgggtgaactttctgctgtcttaaccaagtaaaaatgatagagtcaaataagccttctgtttacatccattaatcaccacttctacttatttaacagggagatgtttatgtgcactaaatatagtttatcctgctaagtgattgtctgcaagctttctttattctcctctacttaaatgaagtattaattatatatgtacatatatttattcttttaagtacaaatttatctgaaatatattagggagaaacataaaggatttgatgtgtatgggaagaaccaaaatacattcataaaaaggaaggttatggtcatgttagtgagatcaagttggttttgtcagctaagctactgcttggaaagaggagggggtgacaggcgtcgggcagactctggggaagcatctcttagccaaatgcattctggaaaagggattccagagccgtgtaatttttttaaaaagtcatatcatttaataattcaagactattaataaatttgttaacatttaaatatgttaacatcaaatgtattttgaaaataaaatccatttaatttattcattttccctaaatattactgagataaattaccaattaaacacagaagatgacaatacttaaaaatgcatttcccaatagggaaactcccaatacactttataataatcattcaattaaaagtaagtaaagagtaaacaaaaaatttaagataaaaacaaaaatacaaaatggaatgagtgttttttaaaatgtgcgaaagctacaattttatcaatatgtttgcttgcatttcattttttaacgtggtataacttataaatgaaacactaccaaaatatatggtgctaaaaataataaagtaaataataaaagaaacaaatccctagagttattagacttttcccatagcaatctcaatccttgccaaattctatgtcattagcataatttcagtggctttaactgacatgttaggaatgaatgagggcttaggatacacattatgaaatactaatcaagtttatttctgtatcttcttgtcaggggttgaaaagtttcagttacatgattgtacacaagttgaaaaagcagatactactatttgtttaaaatggaaaaatattgaaacctttacttgtgatacacagaatattacctacagatttcartgtggtaagaatataacattgaccagagaatttwtttttgtggcacaatgttgttctagatattatttaatcttactctctgccctttctctcttcctccctgcctctcttgttctccctctgtttgtcttttttctttcttgtctttttcttggtctgtggtatatttagagtcaaataattaaattacctatacaattcaaacaaattcacaaaataaatgaatacttttcatgaaaaataaatatctaaaaattgaaagtcaattaatttacaataattttcttggcaattgttatacacaggcattgttgaagagatcatgaaagaagggtgttataaggaaatgataatacacaaactctgttatgaagtaaggaaaaaaaatacaggattgtatggttcaagagtttactttttccatcctgcatcaacaaaattcatacacaagttcaagaacacttaaataagaagaaagcagaaaaagaacagcaagtgcatctagggatatgtttggatttgaattgaggcaactaataattgagatagtatttttaaagtgtatttgaatttaatgaggtgaactctcccaccctttgacttaaagccatctgccaggccatagctggcatgacagacagatgtgctcaggtgtgcatgcgcatgcacgcatatccacagctacacacatagaggatggagcattgcgctgggtgtaatcatcacctaatcaccatagtatagattcatggccatcaggcaagcagacaaggaaaggaagagcaatcatgacagaccaatgataaaatgttctctctagacaatctattagatgaagactaggtgaggtgcaatttcaactttaagttgtatttgctatatacagattgggcatccctaatctgaaaatccagaatccaaaatgttctcagaatccagtactttttgagtgccaacatgatgcggctcaaacaagtgaaaaattttacacgtgacctaaagtgactggtcatagtcaaaatgcagaaacataacacagaatttagtcagcatccccagagaaaaataaatgacctcaagctatgtatatgaggtatatatgaaacataaatgaattttgcatttgaacttgtgtcctcttcccaatatattgtatcatctaaatgcaaatattccaaaatctgaaaaaaaaaactaaatccaaaacacttctggtgccaggaattttgaataagggaaactcagcctgtattttcataaaagttgaatgtaaaaattatttttagggttttttattattttggtaatttccacagatgtttcaatctgataaatattaaatagagaattataaatgtgaaattagaaaataaatgtgtgcgtgaaatattgcatcgatatattcattygaaatatttctttatttcaggtaatatgatatttgataataaagaaattaaattagaaaaccttgaacccgaacatgagtataagtgtgactcagaaatactctataataaccacaagtttactaacgcaagtaaaattattaaaacagattttgggagtgagtatgttacttgcatttatatgtaaaattgcttctctcttcatgttcttataattatttgagaatcataggaaatgaattgtctttttgctgtttttgatactttttaagcatatgctttttatttcaatgaagckcaatttatctatttttacttmttttgcttatgtttttggtgtcgtatatgaaagtccattgccaagtcatgcagatttatccatatgttttgttctaaaaattttatagcattggctcttaaatttagctctgttacccactttgagttaatatttgtatatggtgtgaggtaacagtctaatttcattttgttgcatatggccatctaatttttccagcgccatttgctgaaaatactatttattcccccactgaatagtcttgccattcttatcaaaaattagttgaccataatgatgggtttatttctgaactttcagttttattttattgatttatatgtcatacttacactgtcgattactgctgctttgtagtaaattttgaaactggaaactgtaagttcccccaaattgttacttttcctcaagattgtttagaatatctaagggaacttggaattctgtatgaattttaggatcaacttttcaatttttataaagaagccatctgggattctttcagggattgcattgaatctgtggataaatttgggaaatattgccatcttaaccatgttagtcttccagttcatgaacacaagatatctttccattaatttatgtcttctttaatttattttcaaaatgttttgtagttttcagtgcattagtgttataattcttctgttaaatttatttctagtttaagtttattcctggttataatgctgttgttttcttaatcacattttcaggtttgttactaatgtacaaaagtacaattgatttttctgtattgatcttgcagtctgtcacattactgaatttgtttattaatgataatattgagaaatttttgacaaaacttataaatgtaattctaaattttgttttgttttgattttgagacggagtctcrctctgttgcccaggctggagtgcagtggcgtgatctcggctcactgcaacctctgactcctgggttcaagcaattctcctgcctcggcctcccaagtagctgggactacaggtgcgtgccaccacgccctgctaattttctgtatttttagtagagatcaatctcctgacctcatgatccgcccaccttggcctcccaaagtgctggaattacaggcatgagccaccatgcccggcccgtgattctaagttttatgtaaaaaggatagttgaaggctaaagaggctgcctaaatccttgtctcctcatacttctccaaaataatatatagctacaagaacagcaaataaaactatgtaaaaactatatcctcagcataactagaaaattttaatgtatttttattagtaccacaattattacattctttataatcaatgcaacaaaatagaaatcccagaaaactatgttttatatttgaaaacagcacaaaatgttttcagtgggggaaaaatagtcttttcaactaatgatcctggtatctctgtagaaaaaaaatgaacatcagctctcacctctcaacaaacacaaaaattaattcaaaatggattccagacctaaatactaaagctataatttaaaaaattctaatcaaagacataggagaaaatgtgtagctttagcaaagatttcctagggcacaaaagcaagaaacataaaacttttttgatgaattggagtgcataaaaattgaatattcctgctctttggatgaggccactaaggaaataaaaaagcaataaatagtttgtaaaaaatcaaaattaattttttcaacaacagaagtttttccagaatatacagagagctctttcagctgcaaaataaggactaaaacagctcaattgaaaatggacaaacatttttaatatatacttcacaaaagaggatacacaggtggttaataagcacattaaatgatgctcagcatcattagttaactgagaaatacaaattaaaacaacactgagatgataatactatacatccattaaaatggctaaacttaagaatacggatactactaactattggtcaggatgtgcagccatgacccaggaatttcactccaggtatttaccaaagaggaaacatgacaaagcagatgcattcatagtagccaaaacctggaaacagcccaaatgtgtattcactgttgaatcctaggtaaaatgtggtgtatctttacaataactactgataattttttaaaattctaactatgacacatgcaactaagtgaatgaatcttcagaacattacattgagtgcaatatgttaggagtgaaaaagtacttactgtttgtttcattttatttacatgcaatgggtaaaaagacaaacttaatctgtagttaacagaaagttgatcagaaggtacgtgagtctggtcaaaggagctgagttgactgggaagtaccacagaaggacattttgggatcacagaaattttctttatcttgattgtggtgttggttatgtggatgtatacatttgttaaaaatgcattaaactgtatctcaaatgggtacattttaatgtaaattttacttcagacattttatttaaacatttatcagtttttctcagtttcaaatgactagttactggaagcaatgacaagtgctactcaatgactgctaaatttattggtgctatgaatgccagatttttagcacagcaaaatctacaaattccaggatttttaggtagtatctgggcaagaatatatatgaataatgtatatgaaaggaagagggggttcttagatatcttcaagtcagtggaatgcttaggtttcacagtgccaatctggtgtgacatttactttgttaaaggaatttactctaaaacaaattaaatgagcccagatgcatttctttaaattttattttgaattcatcatttgtcaaaatatggttatcaataatgcatgcttataatatgaagaatgctttatccatgtcttatttttcatattacataacattcttattcttttaacaggtccaggagagcctcagattattttttgtagaagtgaagctgcacatcaaggagtaattacctggaatccccctcaaagatcatttcataattttaycctctgttatataaaagagacaggtaatttgtgtagaatttaatttcatcagaaaagagaaatcaagaatttgaaagtactagaaatttttattgagccagtgagtcacaaagctctctgcttagagactgcataggcatagtatactccctgatcttagaattgcttccactcattcaaagctttccagccccagaaatgactaaaatccagaacattctaaatatttgcttgtccttcttggtcttagtttaaatctttgtgctccaaagcctagagacagaaaacctctggatgacaacactcatttctgtcttgcaagtattatgtaagtgatttgactcactttgaactcatcattcagcctcctaaacaaaccaacaaacaagcaaaccccttgtaaaacttgtttcagctaataatacagacaaaatgttgggtgaataaaaatgaacatgggcccatgtagccgctggggccagtttggtgtaatcttgggagcatagttctaagtttagaattagacttctgyagaagtaatgcaattaaaaaaaaaaagaagaagaaagaaatgtgctatgactagttcactcatgaaatgttcaaatgagatgctatttaagagaacaaatatcttctggacaatttaaagtatctaaattgtttgtagaaagtaacatcagtggagtatctcagagcagcctcaatgcctgggatagccctttctctattcttttatccataggttaaaataggaatgaagtgaacctcatagaattctgtcactctgtgctgtggggaaggaaccagacatacacttcaaaacttgaaaagtgaaaggctatttttcttcattatgttattttatattttaatggccttttcttgctagtgtctttaggtcttaataatcagactactaaagcaaagttaaatatgcatgtagttttcaaattaacattcaaaggccaaggaaaataaatatatactatatatttgaggttatgataaatttaaaagttaagtctatgtggaaggaaaaatggaaattccaggaagataaaacagcagaggtactgtctgcctcattggacacctcttttacaaacactttgtgtagcttctatgggaacacattgttcattttttttttctcttctctgaatcttctattcactatccctttctgcattcctcaatgtctacactctctctactagagagtattgtcgatgtcagagtatatggtagacattttatgcatttatggctcttttatatttttacagtttttttaaactgtatttccactgtatttgcataattagggtaaaaaggatgtaatgagttagtagcaactcattacagcaactagcatgggtccttcttattgggcaactaaatagtgttacccaaatttaacagctgtccacatagaacacttaaacgggattgaatggctgagaaggggaggctagctatcaggctgtgtgttttcttttctccaaagctgccgattggtgactgaatgcagctttggaccatgccctgacactgcataaagggctctttggagccagctctactctaaacagcgtgctccgcttttgttttctccttcatctcaaacatatacctgtctcctctcccatgttacctaaggcaaagagagttgataggattatagtatcgttaaggcaacttaacttttctcaccattttaaataaaattactattaaaaatccacaggaagaaagtctatgaaatttgcagtttactttttaatcagatattaaatttcacttcattacttcacaatttaattttttcagtgtctctaaaagagagggattaaaagaggagaaaaaatgcaattgacattaatttagttttattggtttagcaggtttttttaattatgtattatttaaagattttatcaactattttaataactcagtggagatgtgcatacatatcttcatagttcatatgatgaaactgaggttaacagaaaatgtgatagatgttcaagttcagtagcttgatctgtttcctttctgctcttggttttgtttgtttgtttgtttgagagggagtctccctctgtcgcccaggctggagtgcagtcatgcgatctcggctcactgcaagctccgcctcccaggttcacgccattctcccgcctcagcctccctagtagctgggactacaggcgcccgccaccacgcccggctaatttttttgtatttttagtagagacggggtttcactgtgttagccaggatagtctggatctcctgatctcgtgtgatccgatccgcccgcctcggcctcccaaagtgtgtttgtttatttttcctcacatttttagcttaagatattttggagaactgcagttttatctcgttaacttaatgatggcaagtgacagtgaagcttcttggtaattggggaattggggaagagatcttttgtgctttattggatttaaaggattatttttcaaaagttactgaaagcaataggcacctttcaagaccaccatgatgttgctggaaattattttgtgtaatgccttttatttttttaagaaaaaaaaaacagaacaaattgcttaatctctctgtggctcagttttgtcatctgtaaaatcagatgatagtgagtaccaactaatagttgcagtgatggttaaattaattatttcatgtataccccttgaaacagtgcttggcacatacagtgagttattatttttaaaaatcgttattgatattattattactgttgctgctatccagaaacatgttgccactctaatcatcctctttcctgatgtcacttggctactcaaaaatagcagcagctggtgatttttttacttaacaagtgctaagtcttctgcctgagtgtgaaaacacacttagacactgtcctacctctcatatgcctccccagccagagctgttgtcctgatcaggtttgtcactaaactcaaaaacattccttcttccgtttgtaatattttcttttctcccttacatgtattcagttccacttacctttcaatgaacagctgaattccacttccggcatgaaactccctcattctcacagctcccgttaattactgtagtgtccaaattactatgatagaatcaacccaatgactgatgatcaaatggattctgcatctaacattcaaaacagtagctaataccgatgttcaaagtttggaggttacatatcagaaaaggttttctaaaaaagaatcattctgaaacatgcaactcaagacttacagtatacactgggggctgtgttttctcagaaacaaaagagatcgtcttcacaaatgaatctgaacttattaaatattttatgtaccaaattaatgatataaaaccataatttttcaatatttaattttaccaatgataattgagtttgttcaatacactggctgataattgtaggtacttttgagtatcaaggatgtacttatttttcaatcactcaatagtttggagttcacttggaacaatgtgatgtagagaccaaattaattaggtacgtggtagtactgacttttaacgacttactaattttttttcacatttttcctcagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcgtaagttatatgttttaatgcttctttccataaatggtaaaaagcaaggtatgaactttttagcctacaatatttctatctttattctagcaagcacatttacctggcacatttgttaacatctagggcttataaacaygtaaaatctaaaagtttaaaaaccgttatcctggattctctctcttcttcagatatagtcatagaattttaaggacaaagcataaaagcatcttaattggcatcagtttgtgcaatttcatgcagttaagtacttaaccaacttagattaaaacattcactgtttgctgttgtctttactatctggaaatattaattgtaatcagaaacctaacaatgtctcataaagcattagcctactaacctctgttcatctgataaaacatttcataaaatgtaatattttattagcattttcttctcttcgttaccctcaactacttactattctattttatgtcacattatccatttaaggtttcctttcaatggcatttggctcttgccactagtataatctctccatagtttccaggcccaaagttagatctgcttctggggcacatgttaacctccatcgaggacagggaagaagaaatgccgtgttttaaggcagcatctatagctccagagaccctaacgggcactagacttgtgaagaaatattgtgctatttggggctgaatataagacacttttaaggtcatttaggttttggtttgaaaagttctggtcctggagctctatgcttttgttgttttcctgagtttctgtatcacagaaaaagaagacaatttgtttctgttcctgaagaacccatctaggtgtttaccaggataacattagcactccgggaaagaagggtctagattgtgtaataggacttggaggtttcccaatcaacaacatttttcctctcctctccccaaacttccccctcttccccactcccttccctttttctctattctctaattctacacagtctccttcagggattgcaataactctcatggcttcatgtacaacctatatgctaatacttactgaataaatgagtgatttattcttcagggttttgatattgttttttaatttatgtactatcataacttccttatttataacccccaagctracacttaaaatactttatactatatccaagtatygtcaagtaatttacatatgcatctattaaattattaataacaaatctttcttcattttgatagctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggtaaaagtatgctctctacattactatagtaccaactacattataatgattgattcatagtacttaaataactttaagaccactgctcacatgagattgagaagctctgatgtgtaatggaatcacacttaaagagtctcaaatatttgactctaaaatttttattcctatagctcaagtcagtggtttaaagcaaatgtttcattggaatattttagaacttcaatatgacttaattatagctaaattattgcttctgtgttaagaagcacaacactttatgcacaacagattattactttaccaaatctaccttttctttactttggctttttatctttattaatgtggaatttttcaattgcaaaatttcacaggtaccttgaggttaggaaatatttgaaataaacactagacaatactagtgagcatacagaatttaaaacactcattatctcactgtctactgatcgtattttgtacatgtaacttcataatatacacatttatatgcayttaacacgtattatcaacattctgagtacacagttttcaaaatacagttttaaaactgtatttttaatatatcactatatcacacacacctttctatgttaaatatttaactactatgtagtttttaatgcctgtataatattctatgtatggctttatcacattctattaactataactatgttggtctctaatataaacaacattccgataacacacttattggtaaagcaaaatttttgaatgtctttaataatttatgtttcataaattcctaaaaatgcatttattgggtcaaaatgtattttgaggctttttggatatgtaactttttttttctataaaatttaccaaattgccctggtgtatcagtgtatgaaatgactgcttcttgagaggctcaccaacactgaatacgcctttctttttctttatttggtggttgaaatatggtattgatatctttcttttaatgaagtttctttacttattgttctttgtgttattctttgcctcttttatccagttttctccggagaaatgccttgaatattaatgatattaaactctttgtcacatgcgtaaaaatgttatcagtttataatttgccttttagttttcttcacagcactttgtcttacataattcccctttttatttttaaacaaatgtatctgtcacttttattcctgttaaatagaaatttccatagttaattttttaatatgatgttgacaaacggcctcatattctttttttgttttgttttgttttgttttgtttgtttgttttgttgttgttttttgttttgagagggagtcctgctctgtcacccaggctggagtgtggtggcgtgatctcggctcactgcaacctccgcctcccgggttcaaatgattctcctgcctcagcctcctgagtagctgggattacaggcacctgccaccacacctggcaaatttttgtattttcagtagagataggttttcaccatgttggccaggctggtctggaactcctgacctcaagtaatccgcctgcctcagcctcccaaattgttgggattacaggtgtgagccaccgtgcccggcccatattctttatcacttaaagaagtgttttcatatttataaactttttgattttgtttttgaactggaaatgtcggttggattttatcgatttttagggcattatgatagatgatgccatagttgtgatgccctggtgtgattagtttaaatgatgcaaaaccattgtcacattctaagagaaaaacccctgctctgtcattgtgtgttattctctcagagtattattgaaatcaacagcctattattgtctttattagtagatattcaaaaaggagatcattcagtgagtagagacggtgttggcataggcgttggatgacatcattcttattaaatttggtataaaggttacactgatctgataaaacacattgcttatatgttcctgtttttctgtatcatataactttttaaaaaaattttattattattttttgagaaagagtctcgctttgtcacccaggctggagtgaagtggcgtgatctcggctcctgcaacctccgcctcccaggttcaagcgattctcctgcctcagcctcccaagaagctgggattacaggcatgcaccaccatgcctggctaatttttgtatttttagtagagacgggggttcaccatgttggccaggctggcctagaactcctgatctcaagtgatctgcccaccttacctcccaaagtgctgggattacaggcgtgagctactgtgccaggcctatattatataactttaaatagtataggagtgatttgttcctgaaaaatttgtcttcattcctttcatgcagagaaattctttaagactcatttatatcttctttcaataggattagtcttttcagatattttactctttttgagtgagtgtgctatatatattttttcaaagaatagtcaacctaaaagaaatattttcttattgtcacatcattgtgtattatacttcattccccactgcttctccagtgcccattaagctccaggtgcactggtttctctataatttctcagaggcacctaggtgttactctttttagccacctccctccacgctcttcccacttcctagaatatgcctctcccactcttcaaatcgtataagttactatggaaaaatataggtgtacatcatattaaaatacaaccttaacgttcaaagtaggagataattattcagtttcgaattctcttcccccaatcttcaaaagatggtttttgttttctttattatacttgccataccttcttattatgcttatttctgtctccactatcatgttttgtgttcactccttcatgagagagcagtcatttcagctttttcaccattgtgatctctggttaataaattaatgaagttgatttattagtattacttttccatagatttattttgatgctcttcaggtggctttcggattaaaagtgttttcttccttgtaattttttttcatttttataaactaaagggaaaaaaaaggctatggattgtactttggtaaaattttgactgtaacccatgtctatatcgtttgtcactaatttctgaaggccttcacatgaaatgtaatcaatgattcttaaagtaaaacattttgattattgatgatttctaatgagtctgtagttataatttggaagagtttttaatatatccattatttaagagagtttttctacatttctggtgctttaatttcttattgctactaattattagctgataaaagttaattggcttttacaatttctgccttttaggatttgtagaataatttttacagctctatgtgtgatatttatgaatattctgtgaatattgggtaaattatatattctccataggataaaagcttagatatatatttgtcagatttattatatttattattattctcttttaatgatattattcaaatatattttacttaaatttttttggtcaaggattcttactgctcttttgctcttttcattttccctgtatatgtaaattgttttcacttcatttgtattacattttatgagacacaggtgtttatgcattatgcctatatagtaaattttactatatatccatttgcccttaaaaaaatgtatgtgcattttatgcataattctagtaaacagcttatggttgaatttccttttttaattaaatattagcctattaatagggaattttaactttatgaatattttgatgtattggattttatttcttcatccagtttcattattttaaataattatttaataattgtttaataactataaatatttttattgctaagtgagataagatatctttttgattgtcttttcaaatatatttgacaacatactgacataaccttgaagtttaaagcaaatcagcatacttttattgtatgcatggtatgaaagataatataaatgttttacattgtgatatataatatatatatatatataaattcacattagcaaactaattattttattttttgttactgaaattcaggcctattttcacaatggagactatcctggagaaccctttattttacatcattcaacatcttgtaagttatcactgggctatttattatatatattaagatatatattaatgcttataaagctatattattttacacttataatcacatttgattgttaaatgcttaaataatatctcttccgtaaatgtaatatttttaattgtcagtaaaaccatacatatatatgtaaatatatttaaatacaatatcttaaattcaagttaggagattcaattattaaaggtttgttgaattcataagaggatttatatacccaaactattaaattatgtttatgtttatgaaatatcgtcatgttagtaacatttttcgtgtactattttagattatctattttattctgtctcttcagcatatgtttagcagaagtgggccttagatacaagtctgtcttgatttacttaatggaagctaatataagcactccctaataacaatatacttatgtaaatatttatcactgatatttaaaatattttcatcaaagtaaaggtgtacatgaaaaattacttagaattaaatttcattataataatgaaaataacagctgcatgttacattccccacccacaattctgtttgccaggcaaccacttttaaccatttctatttttgggtctccttatagtttccttcatatatatatatatatatataaacaatattgtatactgctctttctagagttactaacattaccaattgatctgagcctatggaggaaggagacctagtactctactttgggctttctctacyggttaacattgtaaatagaattatttaagcctgtatgtactttgttgtcagcaacttctaggtctttctatctttgccacttctagttcttcctctcttacatatgttacatatgcacatatgcatgtgcacaatcactggtatgaatgcaaagtcaaaagagaaaatataaaaacagcttattttccaaactgctttactaagccctctgcaaagttttagttctttctgctcagatttatgaaataaaaactccctgtgttaaatgtcaaaaaagtccagcaagatagctttgattttatttccacattacctttttcttttataatatctttataataaaaatgacttcattgactctttcctattaaattgtaaataatttatagcagtcatagactcagctgaacattcacactcacatcttaataggccagatctgaaacatttcacctggaaagacacagaacaaaaagcacagcatgctagcaagggagcctggcagtgggaatccttgcagcgggaatccttgcagcagtgcacacagcaatccagctacttttcttatgacactctcaaagacaactgagatatgagagaatgagaccacatgtgtaggtgtaggagctgcattccaaaaggaatcagtatctcttatactatttccatgggcatagcttccagacatgccaacaggggtgtgctcagttatgagcgggcactgcactcagggaaacccaaagctggtacttcccatgaggacaatagagttcacatatagcactccctgttcaggtgtagtttagcaatcaagggtcattttgccattagcaatgttgtctggtaaccagctaatattccacttttatcaggtttccaggtcaacggagccaaaaaattagccctcatctttttccacaaaggagacaacattgtattcactctctgctcacaatatcattatcctaagagataaataatatagtttcttttaaaatagtgatatctgttccaggaaaggacttgggctgtgaattgctagggtacagctactagggatgtgttgttgggtttccccggcataatattccaccacctgtactttgacatcattgtcaattgaactcctggggaccctttcttcttgctctgatctggactctcacatgccatcttgaaatattcccccatcagttttctggtttagatttgctgtatcacacatagttatttttttttctgtctgagttcactgatatatgttctctagtgtaagaaaaataattctaattctcccatacaaaaaaaatttttattctgctctggcacttgttcagtgtatcgacttggtataaaattctaagttaaaaattttagaatttaaaaattatttctgtcttattttcctgaatccaattttactttctaattccatcctgattctctctctctctctctctctctctctttttttggtctgttcccaagttttcctcccctggaaatgctaggtttctgtctttattcttggtcttacctgaattttttgtttgttttgttttgtttgtttttgtttttgtttttagagggagtttcgctcttgttgcccaggctggagtgcagtggcataatctcggctcactgcaacttctgcctcctgggttcaagtgattctcctgcttcagcttcctgagtagctgggattacaggcaggcaccaccacacctggctaatttttgtatttttagtagagaagggatttcaccatgttggttaggctagtcttgaactcttgatctcaaatgatccacctgccttggcctcccaaagtgctgggattacaggtgtgatccactgtgcctggccctgaatctttttcattcattttttctggatgctattgacctttgtaacctgaagatttatatatctgagaattctttgctccattttcttcccatagtctttggttgagtctattagtcataaaactcataagttgacttattattttggcattcccctttggtgttgatgttttccttaaaagcttggttcttattggtagtctagtcatagtcacagtgagacaacaggaaaggttgattagatgttctgtggtccttagaagatcttggtgactgaggagatttcctatgatattgctgatttatttttttctgatatcattcattatcaccaaaaactaattaatccccagaaattaatctccagaattaccctactccttgttgtgtggtaaagtgtgaaaaagtggttcttctcacagtaggacaggaagataggtgtccaactattgcatatgtggacaattacattgtcctcctaattttagtcctgtgcctcatcccttycctgtactgagcctgactttattctcagtctctcactgctttcatttaattttccttttgtcttctcctccctggtagtattttttcaagaagatattttttgttattgttgttgttgttgttattgtttttgtaaatagacatttgacttccatgttctgacccatgattcacatttactgcatatgtcactttcaaacctgagactcaggcattctgagtaaatggaatctattcctttgatttaggctgtggcctcctttcttttgttttctaccttctacaacttgttgaaattgctctacttctaatttcccttctctcattttcactgtcattataaatctatggcattttcagttttttaatattagcagggttcctggaaagaagggggaaacacatgtgtgcttagaatgcaagctttatctgaagacttggctattttattaagtttgttgagaaaagtctgatgctgcttaatatttttgtagaacttaatctaattattatggattggaatgctaacttacagtcatttgcagtttcttgcaaaatcttacttcagagtattctagaagttagatgttgcctctgatgaggtttttattcacaaaatctggaaacaatcatgctgattgatatatgtatactagtaatcactggtatggattgacaatttcagtgaaaggaatttcagatagagataagacaaggaacactttgggtcattttargagcctattgcaataagaacttcttccctaaaaatgttcactgcaatccacctatatattcacattcatstatcccatccatttttatatatgccggcagtataaatacccctttaaaggagataaaattatttctattttatatatgaggaaactcaagtttggataatttaatctatttgccctatgagtcaaagaaatgacagagcctgaattcaagctcaggtcttacagtctgtatctgaaattactttcaatattcctgtttgtatgagtttccagttacagaaattttgatcatgagatgaactgtttctggcagctgtttgcttgatagagtcatttccttctttccagttgtagaaaaactgtctcatgctcaaggcctccacttgccatacagaaaatacatcccctctacttccttatcaccctacttatttttttcagagtatatgaaaaaatgcataattatttcatttgttcacttacctttcttttttcttttcttttctttcctttttttttttttcttgacagagtcttgctctgtcgtccaggttggagtacagtggtgcaatcttggctcactgcaacctctgcctcctcggttcaagtgattctcatcccttagcctcccaagtagttggcattacagacacacaccatgcctggctaattttttgtatatttagtagagatgaggtttcaccatgttggccaggctgctctcaaactcctggcctcaagtgatccacacgcctcggcctcccaaagtgctggggttacaggggtaagccactgcgcctgtctgttcagttacctttctagtgtctgtttcccccaaagagaatgcaaatttcctgaaaactaatattatctctgccttatattctatagcatttccacggactgtcttcctttttatcttcacagcccttatatcttctcacctacatgaccatttacttatttcttctgttcattattaattatctatttttcttcactagagagtaagttccatgaggacaggacccttgtttttctttatgtagatatcctaagtacctagagctgagtttggcagatgaccaaaagccaaaaatattttttttgtgaatagtgaataattagtacttactacttcccagccaccgtgctacgtgtttactgtgaatcaacacctttagccacattttaggattttgggaaaggagggacaaagataataaggaatctggccaagttcccaactaagaagtggtagagctaggattggaagctaagcagtcgggctctggagctgaggctcttaagtcaccgcattattttgctgcattttcactacataagaaaaggtgaatatactggagatatttccaacacaccctctcttctatgccctttccctaggaaagggcaggatttcacattaaacttagtgaatatttaagtcagggtaagtcttatcctaactatagaatgaaaccatttttgtctcttagtgaatggattttacacctcagtgaacaggtaagagggtttatctttgtgaagtagaagtctttctcatccccttaagaggctacccacttctgcatataaagttaaactatatgagtttgtctccaaaatttataataactggattacctccttgatcccttcaaaatgaagtgtctgataaaaaaagagaattaaatttaaatgtgtcttatgaaagaacattatttaatcaaaagaaagataattattcttctattcttactctccttaaatataaaatgttttcattggttcagaacaatatagccaaaatcacagaattagaaatttattgtatttgaccttattctaaaatgtttattttttaaaacctcacaataaatttaaaaatattaaaatataaatactttggaggtgattattcaaccagtctagcaagttatttgacaatcgttctctgaatgtattatttttcatttctagataattctaaggcactgatagcatttctggcatttctgattattgtgacatcaatagccctgcttgttgttctctacaaaatctatgatctacataagaaaagatcctggtaagagttgattwtaaawttttaaataataatggtattagtaatggtgcaaacgcatatccatatggcagtgatggaaccagttaaatgaaatatgtgaactagagagaagacagcatacagcccacttcatgacacaacttttaatcaaaaacttttagtatggttttattggtttgaattaaacattaatattattttctaaatttactaataatgttgtggacttgtttaataataaccagtgaaaagaatrtgtgtggtttttagtacaaagtgggtcagagggatctaggagtgtcaaaagaaaaagaaaggagggagatgtctggggaagttaatgtgtttctttggtcagaaacaaccacatcttatgaaaaacagaagatttaaaataaaatcatttagctacttatgtgagtttagcagacaattcttggttgttttctttcctccctcaccctcctctctcctctctgactctgctttctcccatccttctgtcctccctctgctcaaggctcttcctcccttccctcctttcctcttctcctctcctctcttccccttttcttatccctgacttccttcctttgttccttcaatatattcattaaatataagtaaaataccaattgaattttgtgcttcttgagaatatagaaacttatttttcctattttcacagcaatttagatgaacagcaggagcttgttgaaaggggtaagtatgtatatttttgctgatgactattccttcccctgcatttgaatccattcattttatttatttatttatttatatttattttaagacagagtctcattctgtctcccaggctgaagtgtggtggtgcaatctctgcttattgcagcctccgcctccctgttgaagcaattctcatgtgcctcagcttcccaagtatctgggattacagacacacatcaccaggcccagctaatttttgtatttttagtagagatgggatatcaccatgctgcccaagctggtcttgaactgctggtctcaagtaatccacccaccttggcctcccaaagtgctgggattataggcatgaaccattgcgcccgtccccattcattttaaataagaattgggcatttttagtttaacttggacttttgttgatacagtgataaaacttaaattcctttactcactcagcacctgtgaagttcccagtgtacgccaagcattgtgccaggtactgagagtactacagtgacaggcacagactctgcccttaaagggtttagaatctaatagaggaaagcagatatctcaacaaatatgacggtaatttgatacatgccctagtagttgaatgtgtatagttctatagatatatggaagatagaaaactgtgtgcaagggcagaaatctggtctgttaagattgtggggaaccaatggacaaatgagggagtggtggagggacgagtggatggaagtcacagagatggggagatgggatgtctcctcaagtccctgccagggtggaatggtggctgctcccactaaagacacatttatggattggacaaagaacagcaatttgacttgggagaagaaaacacatttgtttatcttttttttcaacatttatattctttaattttttaaaaatgtgatttctgatccagtaaaaggggacaaagtttcagaaattgaacctttgtttacaataaagaaatgtacttgctttctcatgcttaagacaggaataatttcagaactcctttgtctgtgttaatctgtgttggaagtgtttccctctggtaatagcaggtaccaggtctctatgcagaaactttagggctgaatctttggagctccttaaaaggctttatttttctttgcagaatgtaacactatctgatcccttattacatatttattcatttggtcattgactatcctctcctaactagaatgtaagctttgtgaaagcgtggaggcttttttcttattcactgctttatgcccagtaccaaagtgagtacctaggatttgataaatattagtgaataaataacactgacatagggtatcgtgaggattcattttgataggctgagggaggaatgaagagtacaatcagtaataaacacctgagcagaacaggaaaatccatctcaaggagttaaggtggacttggaaagtgtcaatgaaatattttatctcaaaattggtacygattgcaccttggaacgcagtagaatttactcactcagaccccatgaaaccctgaatgtggccctcagttcagaatgaatgaataccaggcattcccaacaacctaaagaaacaattgcacatagccagtttgagagctgtgattgtatagaaagtttccatgggcaataagataaatgggtcaccctcatggataacttctttctttatctgataaactggtaaaattaatatgattactgaaagaaacactatcagtagtacatggaagagtaggagaaacataattttacatatgcgacagcttaaattctcttacctttctaaagctgttggttttcaagttccatatgcaattgtagctttttatggttagtatactttttaatcttcagtaagttatttcacaaacatggtatataatgtgtttcatatacttgaagcataacaaattaatacaacttgtttcaccatttagtgtaaacagatgatcaaattaagctgagtcatgggtataagggtattaatcatattgtcttatttcatttgcatgtttacagtatttcacaagttgaaaatgaaaatacaaagaaaaataatattgtattataaataaataattatagtaattgctataaaatgcatatagtcaaacgtgaatgtccttataatggtgatgtttggtctgggatcccttctcttaagcatagaaaatggggaagaacattctagtagagagaacaatataaagcccagaagagatctgaagtacaagattgaaaagtcattgatttataggtaaatgtttgtatgtgagtgagatttctcagatgaaatgtgtaygaggaggaaagaagctaaaggattgagtacacggtgtaaatttaatgaaatgtgtatgcccacctgaaagacacatgtaactagtattgaatctttaatatgtttccagatgatgaaaaacaactgatgaatgtggagccaatccatgcagatattttgttggaaacttataagaggaagattgctgatgaaggaagactttttctggctgaatttcaggtgtgtgttgcttttgttatatgatgataaattcgacatcaagacagttccactttaagtgtatttatattgccatttgcctttataatttatcccacttgatattgcaacataagcaaagtagatattattagcagatctctatgaaccagaagagagactcatagaggttgacgggattatagtgtagagctagtaaatattttaatgtagtgctttattgtattatgaagttgtgtcacaaaatgtatttggctgattttgtagttgtactctagatactcatccaagtatctgtttttaaatgaatttgatagtgacacaacaactaatcctaaatttgtccccactcaagagatttgttctgaaagttgtcaatcattaatttgtaagaaaaaagttttttttttaacataattcctgatcttaatttygattactctaagcaaatttttttatcaatatgaagaaaatattttacaggatatctcatttactcaaaacggtcattggtaagggggaaattatttttcctgaatctgctgtgatccaagaaatcgttgtttctttcagagcatcccgcgggtgttcagcaagtttcctataaaggaagctcgaaagccctttaaccagaataaaaaccgttatgttgacattcttccttgtgagtatttattgagtgctgaattcccatatattaggctacttgattattcactatttcacttgtttatttttcttttccttaaacagatgattataaccgtgttgaactctctgagataaacggagatgcagggtcaaactacataaatgccagctatattgatgtgagtaaaaatttgcatttttcttatacctacatatttcattcagctccttgtttgtcttggtaaaattttagaaatattattaaaaatattttgaagtgagcccatatgtcactgatataaacaaaaaattatcaatattagcaaggatagttatttattatgtgactattggtattaggtataacatagaattttcctctacaaacaaaattatattaagaattaatttaatatactctggtgtctattatgtgctagatattagactaaatattctatgcatatatttctcacaagaagtccacatttgcctcagccatgtgccgtataggtgaggactgggaggctcagtttagttaattaccttgttgttgttcacacaattggtaaatatttgagttgaaattcaaccagagtctgactgactccaaaatgttatgctttaatttcatcacactaaatttcagcagacattcctcatcaacatgatcatctatccattggatttatgcagaaatgtaaatgtccgtacgtggttaatttatttaaaatattttaaaatttaatttattatacaaatgttaattaatgtattacataggttaaataattttaaacagtataaaaatatatacagactgaaaaaattctttttgtctccccaaatctgccattttcccagtgtcctcacctaccagaaataactatattttctattcaaatatatatggtaattatggtatcaggttacttatgtttccccaatggaacttagagctccctgaaagcatgtgtcttctgcttttagataggtgattgacatattgtagctattcaataaatacttattaaataaatgaatgtatgcgcaataatgtgtcatgagatagaagtttcaggaagttacttaaattaatgttgaattcttgtgacccatgtttcaaatttaatccaatggcaaaggtcatccctytctgaagagctcctttagttactgaggtgaatttaggagtctgagataattctggaagaagccagtataatattttatctgcctctgtactcctttatcttggtaacaggagcagagaaagcagacatagtaggtaatgaaatgaaagttattatatctcttatctgaaatggcaaagaagtctagggaatcatattccagcagaagttaagaggtgaaaatgcgggtaaaatctaagaatgatttgtttaaagaaattgagtaaaaatcccaaaagtaactacatggctggtgagcttgtttaaatagtggtagatgatcctataagagttggcaggatataaaatgttgaaatgtctagagcactcttgtaaattaccacagcatcgcagatgaagatgaaacctagtattaaaattgtttgaagtttacagcaaagatacatgaaagtcatgaatattctttgcaaatgctaacatgtttagcacaattaaatgcctgaccaccaattaataagattcccttaatactttgaaactgcccagagaaattcacaatcacaaaatgatggatctgaagcaattcctctaactcacaatttttcctgttaatgagtaattgaatgttyagcaaatgacatatctytgcatgtgttttcaatagggtttcaaagaacccaggaaatacattgctgcacaaggtaatttctttgataatccaatattctttttgaaaaatttttatagcacttttaagaaaatttttcttatcagcttttatttgtttacctcctaggtcccagggatgaaactgttgatgatttctggaggatgatttgggaacagaaagccacagttattgtcatggtcactcgatgtgaagaaggaaacagggtaagaaccaagaagattcatagtgtgggtcttggggttaggaaaacaaggtgttgaatggcattttgaaaagccacatgtatctgcctgatgactaaaacagagagttctctattttaatcagtgttaacatttaatttaaaattttcatacatgtagaaaactaaaacttttaacatacaaatatatgtctatatgcataaaatttcaatgcttctgattaattgctagactcttaacttgattcctgtttctttgcagtattgttataagttcagtatatttcactgttttaacttcacaagaccttaatactcgaaacaaaactgaccttgggcagataggtggtgagtcatgtaatgtgactttaggaataaaagcctctctgtccccctacctaaaattaaccacaagcaatcatatcctttttgctgacaactgattatgtcctctcttaacatgcatctaagcctggaaagatcatcctgctaaaaagtatgaaggaaattcttcaggacacattagtgggaaatagaatatatttcaagcatcacagcttaaggtttatatgtgcttaaactatacaactgttttgagaatttcaaatgagtataggttttgttttcactgtttaaagaaagtttgataaaaaattggcttaaattaaaaattaaaatacttaataattttttaaaatgtagaacaagtgtgcagaatactggccgtcaatggaagagggyactcgggcttttggagatgttgttgtaaagatcaaccagcacaaaagatgtccagattacatcattcagaaattgaacattgtaaatgtgrgtttgctttttacataatttttgttttgatacttttttataaaaatataattatggaatattaaaagtgagaaaataaaatatatcaggaaaaattatttttgataacctttaggatgaaagctgtggttagaacaatgacaaaaatcaatagggtcaaatttaagtcactggtcaagacgtttttgtccaactcaaatcgaaagaattatactgtattaattaattatctgttttaattattaaaaaaagagggaaggtccattaaatgtgttgaaaatataatcaaattattaaaagaataagcaatttgtcttcattgtcagtgagttcctacttttatgaaaaaaaattatattatttccataagagaaatgacagcattagagaacactgtaagaagtataaagttctaactatgcagcagagatagaatgtttagttcagaaaataaggaggtcattgtggccttagataatagttaaaatagagatcgtcatgcatgttatataattccattatatgaaaaatccacaataggcaagtcaataaagacagaaagtagatcagtggttgcctggagctgaggaggtcaaacagaaatggggagtggctgcaaataagaacaggctttcattttgtgatggtgaaaatgttctataattagatattggtgatggttgtactatttagtgartgtaatatgaataccaaattgtacattttaaactggtgaactttatggtatgtaaaatgtgtatctcttatttccaacaaatgaattttatttttaattttttggggtacatggtaggtgtgtatattcatggggtaaatgagatgttttgattgaggcatacaatgcataacaatcacatcagggtaaatggggcatccatcatcccaagcatttatcttttctttgtgttacaaacaacccagttatactcttttggttattttgaaatgtataataaattattgttgaatagtcaccctgttgtgctatcaaatacaaggtcttattcattttatctaattatatttttgtacacattaaycatcaccatttccacccctgccatacccttccaatcctttggtaaccatcattctactctgtatatccaagagttcagttattttaaattttggctcccacaaataagtaacaacatatgaagtttgtatttctgtgtctggcttatttcacttaaygtaagtcctccaggtccatccatgttgttgcaaatgactagatcttacccctttttatggctgaataatacttcattgtatatatgtactacattttgtttatccattcatcagtcaactgatgcttaggttgtttccaaaagttgactactatgaatagtgctccaataaacgtgggagtgcagattatctcttcaatctactgtttcctttctttgcggtatatacctagcagtgggattgctggatcatatggtagtgctatttttagtttttttgagaaacctccaaacagttctacatagttgttgtactaatttactttctcaccaacattgtctgagggttttctttccttcacatccttgcaagcattcattcttggctatcttttatatataagttgttataactggagcatagtgataacttaatgtagttttgatttgcatttctctgatagtaaataatgttgaccacctttttatttatctgtttaccatttgtatgtcttcttttgagaaatgtctattcagatcttttgcctatttaaaaatcagattattagatttttcattataaagttctgtaagcttcttatgtattctggatattaatgctttgtcagatggatagttggcaaatattttccctcattctgtggcttgtctcttcactttgttgattgttttctttgctatacagaagctttctaacttgatgtaattctacttgttcatttttgctatggttgcctgtgcttgtggggtattgttgaataaaactttgcacaaaccaatgccctggagagtttccccaacattttcttttagtagtttcatagattaaggtcttagatctaagtctaatccattttttttatttaatgtttgtatacagcaagagatagggctttagtttcattcttccacatatgaatatccagttttcacagtacaatctattgtggagactgtcctttccccaatgcatattctgggtacctgtatcaaaaatgagtccactgtagagttgtttcattgctctatgtatgtttttatgccagtaccatgctgttctggttactatagctctgaagtataatttcaaattaggtattgtgattcctctagttttgttcttttcactcaggatggctttggctattctgggtcttttgtggtttcatataaatattaggattattttttctatttgtaaagaacattattggtattttgatagatattgcattgaatctgtagatagttttgagtagtatggacattttaayaatactgagtctttcaattcatgaacatggaatagctttccaktttttatgtcctcttcaatttcttgcatcaatgtttcatagttttcattgtagagatctttcacttctttggttaagtttattcctaggtatttatgttgtttttatctattgcaaacgagattactttcttgatttctttttcagattgttcaatgttagcatataaaaacactgcttgttttaatgttgattttatatctcatgaccttactgaatttgttaatcagttctaatagttttttggtggagtatttaggtttttccaaatataagatmatggaatgtgcaaacaagtataattggacttcttcctttccaatttggatgccttgtgtttctttctcttgtctgatggctctagctgggacttccagttgaacaacagtggtgaaagtgggcatccttgtctttatccagatcttagaagaaaggctttcagttttttctcatttaatatgatgctagctgtgggtgtgtcatatatgactttcattctgttgaggtatattccttcgttaccctgttttttgaggtttcttattatgaagagatgttgaattttatggcataatttttcagcatcaattgaaatgatcatgtcttttgtccttcattctgttgatataatgtatcacaataattgatttgtgtatgttgaaccatccttgcatcccttggataaatgccacttgatcaggatgaatgatctttttaaagtgttgttgaattcagtttgctagtattttgttgaggatttttgcatcagtattcatcagggatattgaccrgtagttttcttttttttgatgtgtctttgtctggttttggtatcagagtaatactggccttgcagaatgagtttggaagaattcctttctcttccattttttggaatagttagagtagaattggtactagttcttctttaaatgtttggtaaaatgtggtagtgaagccattaggtcccgggcttttctttgctgggaaacttttcatgacaacctccgtttcattacttgttgtctgttcaggttttgggtaccaaaaataatggcaacaacaacttttcaagacatggagagcaaaataacacatgaattgaaacaagaaaatggcaaaatgtggaggaatgaagttaaaatatagcattttcattatattacactttgcttgttagtttgtttacacaatgtctgttgtcttcagtgtaaaataatgcattataagatatgataaccccaaatccaaaagcattcaacagatacataaaaataaaaagcaagaaattaaaacagaccaccagagaaaatcaccttcacttaaaggaagacaggaagaaaagaaagaaggaagaggaggccacaaaacaaccataaaagacataacaaaatggcaggagtaagtctttatttatcagtaataacattgaatatcagtagactaaactctctaaacaaaatacatagagtggctgaatagatattaataaaacaagacccaacaatctgttgcttacaagaaacattcttcacctgtaaagacacaaatagacttaaaataagagatggaaaattatattctttgtaaatggaaacctaaaaagagaaggagtacctatacttatataacacaggtatatttcaacacaaaaactaataaaagagacaccgattgtctctacataatgataaaggagtcaattcagcaagaggatataacaattgtaaatatatatgcaactaatactggagcacacagatatataaagcaaatattgttagagctaaagagagagatagactccaatacaataatagttggagacttcaacactctactttcagcattaggcagatcacccaggaagaaaatcaacaaagaaacattggtcttaatgtgcattgtagaccaaatgaacctaatagacatttatagaacacttcaaccaatggctgaagaatacacattcttctcctcagcccatggatcattctcagggacataccttatgttatgctacaaaacaagtcttacaaaattaaaaaaaaattatataaacttttctttgactacagtagaactagaaatcaataacaagaataagtttggaaactatacaaactcatggagagtgaacaatatattcctcaatgaccactgattcaatgaggaaatcactaaggaaattttaaaatttttcaaaacaaatgaaaatggaaacacaacaaaccaaatcctgtgtgatacagtgaaagcagtactaagagaaaagtttgtaagagtaagcacctacattaaaaaagaaaaatttcaaataaacaacataatgatacatttcaaagaactagaaaagcaagagcaaactgaactgtaaattagaagaaaaaataataaagatcaaagtagaaataaatgaaactgaaataaaaaaatacaaagcatcaatgaaataaaatgttgtttttaaaaagagaaaattgacaggccaggtgcagtggctcatgcctgtaatcccagtactttaagaggacaagtcgggtgtatcatttgaggtcaggagtttgagaccagcctggccaatatggtgaaaccccgtctctactaaaaatacaaaaaaatrttagccaggtgtggtggcatgcacctgtaatcccagttacttgggagactgaggcagtagaatcacttgaacctgggaagccgaggttgcagtgagccaagattgcatcattacactcaagcctgggctttgcagtgagactttatctcaaaaaaaaagataaaattgacaaacctttagtcagactaaggaaaaaagagtggagactcaaatgcgtacagtcagagatgaaaaaagagacattgccactgatacttcagaaatttaaaagattatgagatgctactatgagcagttatatgctaatgaattggaaaacttagaagaaatggataaattcctagatacatgcaacctatcaagattgtaaaatgtctcttgatagagctgtttaaaaaactacaagtctttacatgggggttaagattttctcttaatttcatttattgtagggcttttagtaatctaaattttatttttgtatagtctagctatattttctacaggagaaacagacttagtctatatatctccgtaggtcttcttaggtttccatggtattactaattgttatgtctatagagtgctgtgaaacaatcctatcaatagtttctggccaaacacttgtttgactaagccacaaaggcacctgctccatagatatgaggatatatttctagattgatgcctatctggctacattctgtagtctgggtttactggtgttaattaactcagtttgtgtgtttcttttgttatctaaatgtagatggttctttatacctggccatagaattatgacttatgcatcttatggtggttaccttgaaattagaacaaacctgagctctaatctggggctgactttcctcagtcgtctctctacattctgtgttgacaatgctaccatgtgaaggcctaaggaatacaatgttcatcaaataattaatcagactttgctcacatatgaattagttctgtttgctggcctatcaagcagaagtattttaaacagttgtgagaatgacctttaccaaatcattttaaacacaaatccaaaaagcttccacccatgcaccccacttttatggtgtatgtttattttgggttttttttgcttgacagcatgcaagttcctagaaattttggttatacttttaaagaaagtattaccttacttaccttactgttaagttattgcttacagggtagtacatgcaagtcctgcacaatatcttaactactagttattgattagaaaggaaaacacaaccatggttgagaaaatatataagacacctgaggaaactatgaactcttttgagtagtttatgtttacacgaggagactttgtactggtactcccttccacttatttatgtttcatagtttgctttaaaaaaatcatctcaaagaaaatattatctcttgactagaaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcaggtaggaaaaacgaacaaaaaaaaaaaacaacaacaaaaaaactccaacagaatccacctgcctagggctgttagagacatctttccctttggcaattgctattttgggaaacaacctatgggagaagcttagattcttatattggcttcacacctgacagcttttccatgatcatgcctctgcttttttttgcttggtttgccagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggtatgttctaacctttagtgattattctcactttggttttttggacttaaatcttttccaagtgataataatgatattttttaaaaatccaaattcttcacaacctcaaacagtagatgatttcctgaaaactaaaacgtggtaatcaccagaaatacttagaagcatttttcattagtgcctaaaagtactgtggaagaaagatgaccacaaaatatataatttttaaaataatgaactactgttaacatatatcagattggcaaaaaaagtaaaaatgctgaaaatagatttggcatcatctcataaaattaaactgaagagacagaatagtatagtaatcaacagctggttttagaaactacacttacaggtttcaaatcttgcttttaattattaatacgagggtgagtggtattgtttattaagtaattttagtctgactgcacctcagttaagtcatctgtaaaatggagacaatgataatacctcacagacttataaccacaaaagtaatacaaataaagcacttaaacaagtccctggcccatgctatgcatttggtgattgtaagtgatggtaattactgaaaatgtctgtatttgacccagcaaaatcacatatatgcatatacccaagagaagcatcaactagaaacatttgcaagaatgtgcattgcattcagcattgtcaaaatagcaaaaaaaaaaaaaaaaaaaaagtgaaatacatatcaatgaaagaatggaaacaccgtaaatatgtatcaataggggaataggaagacaaaatgtggacatgtgaactctctgtacaacaaatgctatgttgtggtagaaagcaatgatctaggtttgtgtctgtctgtttggagagatgctcagatgaaaacaatgagtgagtaaagctgccatacgaaacattcaagatataatttatgtgatttaaaaaaaacatgaaaatgtacaatgcktgtgattacagatacatagatagcagtgtagaaacataaaaacaaattgttaaccaggtaaaaagaaattatttacagtggaaaataaagtacagtggaaagacagtgccaaactcagggaactaaaggtggcggttaaagaggattatcagaagtataccatttccttgaaaatactggattcaaacaaaataagcagtaaagagtagttaaatctgggtttggcccattggattacaaaaaaataattttcttattaaaagaatacttttcttattttaagttctaaaaactataaaaaaaggttttctaaggaataacaacttgcttttttatctcttgaatatactgtgaaatttattatagttttacattcagtaatttggcttactgacccaataatcactaaaggaagtaacatacaatgttctttagtttttaggaataaaagttgtgcaatacagagtacatggataatctatttgcaaagtaattcttttctgaaaaaataatctgaaaatagaatttgctcatattccagaaaactctgagagtgaacttccagaatatttaaatattatagatatcaatttactttgccatgaattgttccaatatgagcaaatttatggggaatgtatattttatttaaatatgacttggaggactctagattatcagttaactatctgtatttgttcttgaaattgtaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccaggtaatgatagtgacaacaataataataattacagataacttttattcagtgtcatctactttctaggtgtttgctatgcacttgacatagtgcttgcatttagtcttcaccagaaccaaaggagcacagatgagaaaactaggacacagtgagttaagagaaatgcctgaatctacacaactattacataggagatttctttagacccagaaatctgattctattgctaatacttttagccattcctcattaagctggtataaaatgaagtgtcaaaataatagtatatagccacaaaactggtctgccaaaggcaatacagcatatcacctttaaaaatcgtatctggttttggtttgtaaaggaaatcattagaagagtttatgactgcttaggaagttgaactggctggagctggtagacacacagtaaaggataagtacatgtgtcttaacctatttattaggcaattattctcacagctaacctagcatgtagttcactataatttcagagagtttgcatagctgtcctcaaattgctcagttgtcaaaaaaatgttttgtgttttttttgttccacctatgatttccaggttactgagtcattccataatctaccaaactggtaaattcagagtttctaaagaccaggagtgtgcttttaatcacatgcagaaccatttaatgtttaggatcaaagtggggttaaggtgggggtggaggtggagcatgcaataatgaccaagtgactcaatcccccagaagacctgtacttataatggaagaactagcagacacagggtagtctcaaacagagtagtgttttattgttgttttcttgcttttctagctgataaattaaccttattcaatatacctgccctactaatccacataaacacataagctgttagagacagttatacatttaagttaaacattcttatgaatgtttatttactatagaaaagacagacaatttttttcactaaataaatgtgcttgagtttctgctatgtgccaagtacaattctaggcacaagagtcaaaatgatctgcaagtggacatgggaagaaggatgagaggatgtgatccagatcacagatggaagctgtgaaattattccatttaagcagacagtaagacagaagatgagagtagaaatgcaagtcggttggtaaatttggtattgggaagttgaggcagctcttgcctgatgatctttcatttttcaagaaaatgtgaggctaggtcatcagttgagagttgagagatacaagggcgagtagggcaaagaagagctcaatgcttgaagggtataaactagttacctcaaagtataaaaacaatctccctaggcagaggcagtaagattgccagaagttatcatttgatcacctgaaatttatgattataagtttaaagaggaattagtcagttggttgtattgttttctatggcagcattgagctctttgggggtagaggctgtgtatgcagatagttgagttaaacctatctaggttttgaaaagtgactatttgaaaatagtgaggcaaacgagttgagggtgtttacaaatgaatgatgactgaggtggaaaataaaaagcaaattggccacatgagggaggtgagagaaagtagtaaggataataagttggagactttgatagaattacagattgctaggttgaacatatcagaataaatgactaggaataataggggtaattttcaatagcacagatagttgaacttatgattttagaggtgatgtaatatttggaatgaaacctacaaaggtggaatgatgaaagtggatgactgggaagtggagggaaagtcatgggaggtgaagaagctaagaaatgaagagactagagtcttggatagattattcttgtcaatgttgaattaaccaaaaatgatgacagaccttggaaagaagagaatatacttagccaagcctaaaactaaatgaggtggagtgattcagaaatcaatacctgacacttcccagtgaagccggtggatagaagctagtatagtatgatggcaggaatatcaaagtgcttggttgatttgaaagcaaatgagtagaaatggtttgcaagtagaatcagggatcaaggagaacacgtatcttttcttgaagctgtgaggtaaatggggtgtgaggaggaaagtcaactttttcttaaaagggctgctgagttattggtggtgtccttagctgacatccaggttttaattggtggaaagaaaaaaaaaagggtgaagtgactgttgggagaagatgattaagataaatgggagttcacagatgacagacgatgggcatcakagggcagggaggaaggcactgatgggttagatgtaagagactgggttgtatctgaggatacaaataaccattcaggaataaaaatctggggaatgtggatgcactgggaagcttagacttgtgatggcaagtgaaacaggtagagatttaagagtgacagatcctttgtgtcttagatgaaggtgagccattaattccacctataatcctgagtattgctacagggcataggctgcctcggtgactacactcacaagagcacaaggtgttgtaacagtttccaaaacatctggtccttcatgcagctcatggtggtgttcaagtggcctaaaattcagtgatgatattttctttcactcaattacgtagcaaagaatgaggtttgaaacagggtgccataattagtttgaatgagggtactatgctgaaaaaatatatgtctatatacacacacgtatctacatgcgtgtgtgtgtatataaaatcttaccgaattgtacatgaggagccttctcagtttcagttatttgtaacattatctattatcattaaatattattcacttgacaaatacttatttaaggactagtggaaagactgtaggcaggggtgtcttccagaagaaattggtatttaaactgatacctagagggtaagaaaagttattagagcaaccaaaaggggaaagggtagttcaagcaagaaaaaaaaaaaaagtgtttatgtgccaagagttgaagaacagcttggcccttccaagaattgaggaagctggtttggtagaagtattgagggacccagtaaggtgtaaggctggagaaayagtcaggggcgtatcaataaagactttttatgctattttgaggaggtttgttgtcctcttatagtgatggaaagctgttcatcttcagaagagcatcttctgttttgtgttttagaaggattagagcaggcgagattgaagacaaagaggccagttaggaaattgttgatgttttacaagcgagaaatgaaggcagactggattaagtaggaagaaagaaaactaaaaggatttgtgtatagaaatgatggatcttttctgactaattaggaactgtgggtgagaggaaagcaatctggaaggtgtaaacaaattaagaatgaactttcaaaacatgtgccaagtctcctaagaatgtgttgtctccaaagtttatttctgatcatttaaaataacttaccattgcttttgcaatatagatcaacatcggtctagtggtttcaatttatataagaacaaactatattatttttctatcaagcagctctgaagaaggagacatagtctgttacatatatatctttagtgcatactagccctgtcaaaaggactaaatgcctgagcaatttaaagaaaaaaaatcagaggcaaaccgaaaaattatggcctatagggagcatatgcaaatttcacaaaaattaatgaaatgcttttccttagggagcatcttatgatgcaataagccaatatttacattttaaaggagtttttctgtttttttttttttttttcagagacttccttcatataggagctggaggacacagcacattggaaatcaagaagaaaataaaagtaaaaacaggaattctaatgtcatcccatgtatgtagtttatttttttattttttgtatcagataaagttaagctcttttggatttgtttaatgtgggacacacagtcatataaattatcttgaagcaagttttcaacatttggttgttaatagggaagaagttactaggtattaaaatactagttattgcaagaacttataatcctgaacatttacaatgggctttggagggtagactgtattcagtgttttctttttaccaattatttcagaaatgggttgtcataaaagagaaatatataaagctgggagaaaaaagagcaagtctcttttacccattttctttcatttttagtttatttcagttatttactccagggtaattgacaaatagtaaaaattacatccatttgttctctatatgtttcctttttatcccttataactgggaggttgaaagtaaggggaaaatactctataaattctaaatcttcaaatttaacagatcaaaatatgcacagtttcaatacttgaattctactatttaagcatattaaaatgatcacatatggtaattttattcagctgcataaactaaaattagcatggataaaatataacacaagttgataaattagatgaccaaataaatcagatcagtgcatggttgacctagttaattttcataggagtccttatgaatgtagtttaaaatatggaattgatggtgatatggttaatcaaatcatttgaccaagttattataaattatagaaattaagaaacagtgagaaattataggtcaaataattttctgggctaaataattaatcaaagctacccatataagattgttaatttaatattactggagtataattgagggaaaaaatctacgctatgtattttgtaaacttatatcaagcagaattataatagtccatgggaaattaaagtatatgtatcaaagattaaataatcatatataatgatatgatatctctttgttgtttgacatggaattatgttccatgttttttcctggaatcctttttcttagacttttgttgtataatttgtttatcgacaagtactgaattttatataggatcttatttcatgtagatcagtaagttttcataatacaatctgtccctttttaaatactttcaaatttccacatgacaatgaagaagaaatttaattttttcaaggaagacttactactgatttatttcacatagatgactataacagagtgccacttaaacatgagctggaaatgagtaaagagagtgagcatgattcagatgaatcctctgatgatgacagtgattcagaggaaccaagcaaatacatcaatgcatcttttataatggtaggtacttaaaytgccaaaacccaagatccaaacattttaaaataatatctatgttattagggccattcattaagcgattttataaaagaataatgagcttggtcataactacatatagattgacatgagagtttcaatttcaatgctacaatttaacttaatgaaagatttaaaaatactataacctaataacctgagacaaaataagataatgctattggttatattttatgacaaatatagctataatcacatcaattttaaaaatagtaaaatttgagcaaatacaagtatttgaaaatgtttatacatactcagatacccaaattgtaggcaatgacaaatttgtatatttgtatggttagaaacttttcattcagataaactgaattattaggtgagtctgtgtcatatccccccacttttttaattaactgagaattcaaacaatgaaactttagtcatttattaaatatttattatttatacactgttggatttacttattttccaaagtttcctaaagcacacattcayagaatattagtttaattaggaaatataataagaatgtaaagacactaattaaaattagtatagacacgatgaaggtaatttgaaatgcttaagtaattcctttttacaatcacattaacctttatagagaaacaaaaatgtgtgtcttttgtggaaaggaaaatttgtttcgcaagatatgttgtaatcttgatttcacattattagctaagaattactattatctgtataattattttacatatagctattacattgtttcttgtaagaaacataagaatattactatttgtatgtaacagcattgatatcaaactgactatatttccaaatggttactttaagaatctactgagctctcttctgtagtaacgaagtcccaccctttttttgtctaaaaagagctactggaaacctgaagtgatgattgctgctcagggaccactgaaggagaccattggtgacttttggcagatgatcttccaaagaaaagtcaaagttattgttatgctgacagaactgaaacatggagaccaggtttgtacttttgaggattttcttttaagcctttctgtcataaaacgtcattctctagtcttggattgcttgcttcatcgccatacccacgtctttttttatccctccatcacataattctgtctgctcagtcttacccctttcaccctggtgttggcctccatcagctgtgtctggattctgacagtctctcctgtttgtcccctccagtcttgcaygctgctcacagattagccaggatgcagcaatgtcagcgtcacagcaaataacagctacattttcacgctgttttcctcattttctcaagataaaagccaagatctttttgtgatatccagcaccctggacaatcaccccctcatgtgtctttcatcttcctcccatttttatgttttccatcctctccactctggacaagcaggtttcatgcccaagcctaaacacgccatttgcattgtcatcactgagtctaaacttattgatattccatgtaactaaatgtgtgctgtcttccagttttgaccctattcttttaacaagaccaaactcctgaaaaatgtatctatatcatcctttctttattcccatataatatttattgccataaaagtctatagttgaaggtgaatctaagctataatttgatttttttacttaatgcttgtgacagatattttatccttttcttaatgtcttcagttattattaaaatttccctggtggtagatctcactcagctttagcaccaaccacattatctgacatatgttcaagcctattcagtgaataaccttataagtatgcaaaagatttatgcttttttatgcccctctctctcccctaaatctcactctttctcaccctcacctggtccccttcccctgtacatggaaagttgctttttatgttttttgttttaaaggaatataagtccagatttctagcatggaattcccacaatcctttccttcatataaattgtgaaagctgggaaacaggatggaagtaccggcaggactccctgtctttgtcagaaattgtggggttgtagttggtagacaacagtttgtagtaagaagaaacacttttgtggttcatctactcttcaatctggccctttccttagctatgtagacaaaatatataaagctgcttatggtgttggtcaacaagatgacagagacaaagctccaaaagatgcagcctccttcctcaagaaccactgaagggacagtgggacctgagttattgaaagggtcatgaataacattgactcatgccagccataaatattgaagaggtcatgataagcatgtggaaaagaggagcaaacctcaaagacctacactaaggaaaacagctgttccgggggtgtcccagtcacctcgattgtgctcagcttcccttttcttacacaaggaaacaccacatatttaytaaatgggtcgccagcacttaaatagattctggatttttataagtaggtttcaattttagaacacaataattttcatttaatagaaaagaggcacagacagagaaagaaagggagaaagagggagactgatcctttgcatatttcaaataggaaacaaattgttgaattgtcttcttttatctaggaaatctgtgctcagtactggggagaaggaaagcaaacatatggagatattgaagttgacctgaaagacacagacaaatcttcaacttatacccttcgtgtctttgaactgagacattccaaggtatggaaacaatttggggagtatatttctttgatataatggatctggtagcaaaatgaatataaattactctatgcaggcaaggccatcatataaataatgtttcagaataacattttaaaattatttaaatagaagtaactgtgaagaaaatatgactatcaaattagaaaataagctgaacttcactccagttaatgctctcttcaattctgattttagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcaggtgcgtgggatttggtagaatgtgctctcaaaatcataatgcttgacttctcggttcacatgttgtcttatctagttatcctcatatatgaaacacataaccacagtaaaaacttcttatggagtcggtcactctcttggttgtttccacaacacaactattgtagaaatataatagaagtgattatattatagtgcaataattttaagttgtgttttttaatacttggtgtcatgtcatctttgattccttggtagctaacattgagccaggaatgtcatttgtgtgaatgaattaatgaatggaagggtgtgtgaacagataggtagatgggtatcaccttacacatatacccatatacattgatctactctattaggtgtcacaaagacacctaatatgtttaatgaacacaaagtttattaaacatattttaagttaaatattaactgaaatcacaaagcttagcaattttgatttgaaactcattatttaattttctaaactgaaccaaaggcaaagattgtggtaatatcaataatactactagattttattagtttcttcatctgtgataggtgcttacatattcaccttaaataagcaatataattgaaagaaagatatataatataaaagtttacatgaaaaagaatattgaagtaaatgagaaacgaaaaatagtaaagtaaaatgagaaatgtttatctagtgaaaaacttttggaatttttgaaaaagtctaattgttattattggaattgcatatactagaatcaagccttaagaaatatatgaattttcagcatttatgtggaaagaaagctgaggaagggaagtttacactgtaaaactatatatgtttcttagaatatgatttatgtacaataactaaagtgtcctgctgataacatattgtttaaattgaatctttatgatartgctttatacttctcattgtttggtaaactatttgattgccctctttttagtgaataattctactaggtattacttttctactgatgcagaagtgaaaacatttgtgaaacgtggtagagaggcagaagagtgaagaagagcatgtgttctagtaatttacaaaatattaggtctaatatttctgattacatcagctttctcttctccaaatcttggtttccttatctatcatactggcattctgatattggtttcaacaacttcagatgtaaataaaaatgcattaaaatccataaaatactaaataaaagaaaatatatttgtaaagtcgaagacaaataagttttcaattccaggattatcacactcttaaattgaaaaatttgcctaaaaatgcatttagcgtaaataatttggttcttgaaagaggttggaataagataattatgataaacatgaagcaaaaaatatattctctctcttcctgtttttattctaatatcaccctttttggtgagaagtaggattattttctatcttttctttcttttatagggatggatctcagcaaacgggaatattttgtgctttgttaaatctcttagaaagtgcggaaacagaagaggtagtggatatttttcaagtggtaaaagctctacgcaaagctaggccaggcatggtttccacattcgtaagtatccttcaccattgcttttaacatgctcggaattttttttttctttttgacggtttccttttttcttttctcctctcctttcctctcgtttgttcttttttcccctttccttttctcttctctattttctttcctattcttttagcttttctacttttacatgataattcacattaaattattadaagtctaaataagagcctaaagtttactagcactttgttgtgacagttcatgaagagcctttccctaaatgctcatgaatttcttaattttctttccttcactcctgtatcgatttgtgttgtgtaacaaaccacccccaaatttgggagcctaaacaaataacatttattatggttcagtagtctaatgatatgctggaatgttctgctggtgccctcaggctcaggcaatagagaccaggctgactcatgtgtctgccttcagctgatgtgtgccctacagtttggctggtctaaagtgacctacactgccagtaggctggcatgtggctgccatttagctatggcaacaacagtgagtgggccacatgtccctcctcatccagaagactagcccaggcctattcacattaaagcagcaagttccacaagggaaagaagacttgtgtgagaccacttgaggcccaggcttaaaagtgacacacatgtcttcttctgtatgttattagccaaataaataagtcataaagcctgcccagattcaaggggtagggaaatagactccacttcttgagagggcctgcaaattcacattgcaaagaaatgtggatacaggaaggaaaataagttttatattcttgtaatcgatctatcgtgtataccctctatgtggtagtaactgtagatggtcatctgggaattaatccttattcacagtgtaaacttaattactcactaaaatatataaagcttttaatcatgtatgatattgagatttcatatcttggtacttaaaaatgtatcaaatgcttgctatgtgctcttgctataaagagctaattggtatgagggaaagccaggtatttactaatcaatgtagtgagtaaaatgacagaaaaattataagaagaacatgaatgagggcatttaatttaaactttaggaatcaagaaacgcttctcgaagcagtgattcctgccctgattcttaaataatgtgtaggcattagacaggaggataagtacaaaacgtggcatcatgagcaaaggcatggaaatggcccatgagcggagtgaacactggtttggggttgctccaaggtaaagttcaaaaagtatcctgcagtcaaccctttagcaccataaagaaactaaattatttagatgtttttatgagaacatatcaaaaagtacttttctgtcatccaatacttccacaaataaatcattagttcttgctaatcttcatctggcataaaaataatgacatcaactttcttcatgtaatttcccacttaattcctttactaggagcaatatcaattcctatatgacgtcattgccagcacctaccctgctcagaatggacaagtaaagaaaaacaaccatcaagaagataaaattgaatttgataatgaagtggacaaagtaaagcaggatgctaaytgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaamcctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaattctgtaatagcttmtcatgaaggtcaaacacaacctttagattggtttggttttctatatctttactcttttgtctgattttatatgtcttaactatacagcaccgattattgtccattcaactcacatttattttgtgtccctacttctaattatttcactattgtaacatataaaattaacaattaacccttatagtagtatatagatccttgtgcttatttaacagatgaaaagaagtaaattttacaatgaagccacagtttctaatttatattaaggttacttattacatctttacttattaatgagaaaaggggattagaatcaccaattatgggcacaaaaaataaagtttgctttcacttacctcttcagtcactcaaactattatgcattcttttcttttattgaaacttgatcagttgccattttctagataatgtagttaaaatttgcagttctcatgttcaatagaacattatgatgtatgcctactttatctgttaattgcttcaaaatacaaatagcagaaagtctaaataatctacaagcaaagtttttcttcagaagtttcaattgcaagtaacatcttccaaatgtagttgtgtgttttaaatgtgttttccacctgacactatcttttgaaagattaaaaactacttagaaaatagagcaataataatttctattagtttaagaatcaagcttgagactttttttctacatatgggaatttgttgtaaagaaagagatgaaatagtggctcagaaagcccactactttgtgagaacatatactaaaccgaaggtgagacccatggcactagaacatggaattatatgtctatgatttttacctgtagaaagaaataatatgtgaattataggtctatgtctatggccatgggttgcattaatggggatctgttacaaggtataaaagatttatttgctaaagtttggcactgccattattaattctaggatccagtcagaaatattaagcaaaaagttttgacttacaaaagcctggtacactgtagggataatgttatgaatccagaacattacatttattgggcaaaaagaaacttctaggtttcttttaaagttgtttgctttattcctggtattagaattcaatgggaataaaagatacatttagtaagcctaaacttcaggtcccaagctattaattgtgtacataagtgacaaataaatattttcatttaagagatatatatattttaatattttcttgcaagaggaaaactgtgtaaagtgattagctgaacatctgtctttgcaaagataattttaaatgcgttaagcttcccctcagaattcttatatttgtacagagaaattttcctgtttttttccctctaaaatattaaacataaaatttatttttacaactaactaggactgatcttaattttagatttataccagatattggttataagatgatttcataacaccatattagatctgaataagtgaatgctatttgctcctagctaattgcagcatgtttcttgatatgaagaccttaaaatatatcacttcaaaggaaatgaatatctgttaaaatgagtagaaaaggctatgctttcaatctcctacacaaattttacatctggaatgatctgaaggttcttcaaagacattcaaaattaggcttttttatgtcctgttttaagtgaaaatatttattcttctaagggtccattttatttgtattcattcttttgtaaacctctttacatttctctttacattttattctttgcccaaatcaaaagtgattcctaaattttaattatatttgtaggacaattaaaagcttttgataacttacaacaaatgaattcttgttttttgctaagatcccgtaaagaaaactcttcttctttattcaaactatccatgattactttcttcaaaatgacatgaaatttgattgtcagataaaatacaaggcattgggttacattcgaattttaaatgaaacaagaatagttttttagtgcaagtatgtctcatgcagtatttgggacatatttgcaccaaaaattgtttcttgtttattagaaatttaaatttaacttggcatcctattttttttaatctcgcagctttaacatgaaagaatcaactatatctacttcacttaaaagaacatttgtagttctccttgcagagagagacttcacctctctagttagctgtattcctaagcattttattatttttgtggcaattgtgaatgggagtttgcctctcagcttggctattgttggttatagcaatgctagtgatttttgcacattgattttgtatcctgagactttgctaaagttattcattatcctgagaagcttttgggctgagactataggattttctagatacaggatcatgacggctacaagcaggaatagtttgacttcctctcttcctatttgcatgcccttgctttctttctcttgcctgattgccctggccagaacttccaatactatgttggacagtagtggcgagagagggcatccttgtcttgtggcggttttcaatgggaatacttccagcttttactcatttagtatgatggtagctgtgggtttatcatatgtggcrctcattattttgaggtatgtttcttcaatacctagattatcaagagatttcaacatgaatggatgttgaatttgatcaaaaatcttttctgcagctattgagataatcatgtagtttttgtctttagttctgtttctgtgatgaatcacatttattgatttgtgtttgttgaaccaaccttgcatcccagggataaagtctacttgatcatggtggataagctttttgatgtactgctggatttggtttgctagtattttgttgagaatttttgcatcaacatttgtcaaggatattggcctgatgttttctttttttgttgtatctccgtcaggttttggtatcaagatgatgctggcctcactgaatgagttaaaaaggagttccaccttttcagtttttttttggaatagtttcaataggaatggtaccagctattctttgtacatatggtagaattcagctgtgaatccactgggtcctgggctttttttattgttggtggtggtggtaggcttttattactgcctcaatttcagaatttattattgttttgttcagggattcattttcttcctgcttcagtcttgggagggtgtatgtgtccaggaatttatcgatttcttttaaattttctagttaatgtgcataggggtgtttataatattctgtaatagttatttgtatttctgtggggtcaatggtaatatcccccttatcgtttctgaccgtgtttatttgaatcttctctcttttcttctttattagtctagctagtagcctattttattaatttttttttcaaaaatccagctcctgaattcattgatcttttgaattttttcatgtgtttcaatatccttcagttcagctctgattttggttatttcttgtcttctgctagctttgggatttgtttgctcttggttctctagttgttttagtacaaatcactgctcaaagaaatcagagatgacataaataaatggaaaaacagtccatgctcttggacaggaagaagcaatattgttaaaatggccatactgcccaaagcaatttatagattcagtgctattccttattaaactaccattgatattcttcacataactaaaaaacaaacaaacaaacaaacaaacaaaaaagccattctaaaattcacagaaaaccaaaaaaaaaaaaaagcctgaatagccaaggcaatcctaagcaaaaagaacacacttgtaggcatcatgctacaccacttcgaactatgccacagggccacagtaaccaaaacagcatggtacagatacaaaaacagacacatagaccaattgaacggaatagagaacccataagtaagattgcacagctacaactgtctgatcttcaacaaatctgacaaaaaacaacaatgggaaaaaggttcccttttcaataaatggtgctgggataactggctagccatatgcagaagattaaaactggactctttccttataccatatacaaaaattgacttgagatggattaaagacttaaatgtaaaactcaaaactataaaaactctggaaagcaacctaggtaatacctaccattcaggacataggaactggcaaaggttttatgatgaagatgccaaaagcaatagcaacaaaagtacaaattgacaaatggtatctaattaaactaaggagcttctgcacagcaaaagaaactatcaacagagcaaacaggcagcttacagaatgggagaaaatgtttgcaaactatgaatctgacaaatgtctaatatccagaatctatatggaacttaaatttacaagaaaaaaaaaacccttaaacagtgtacaaaggacatgaaaagatatttttcaaaagaagacatacatgtggccaataatcatgtgacaaaaagctcagcatcactgatcattagagaagtgcaaatcaaaaccacaatgagataatatctcatgccaatcagaaaggctgttactaaaaagtcaaaaaacaacagacgctggcaaggttgtggcaaaaaaggagcacttatacactgttggtgggagtgtaaattagttcaactattgtggaagacagtgtagagattcctcaaagacctaaagatggaattaccattcgacccagcaatcctactagtgggtatacacccaaagggatataaatcattctattataaagatacatggacacatgcagcactattcacaatagcaaagacatggaatcaacttaaatgcccatcagttatagactgggcaaagaaaatgtggtatatatacaccatgatatactatgcagccataaaaagaatgagatcatatcttctgcagggacacgggtggagctggaggccattatccttagcaaactaatgcaggaacagaaaatcaaatatcacatgttctcacttataagtgggagataaatgatgagaacacgtggacacatagaggggaacaacacactggggcctactggagggagagagaacagagaggatccggaaaaataactaatggatactaggctcaatgcctgaatgatgaaataatctgtacaaaaaacccgcacaacaaaagttttcctatgtaacaaacctgcacatgtacccctgaacttaaaagttaaagatatttagaagaacatttgagagttcagctttgtaagatcctgagatgaaaagattaaatgaaactatttacattagtgtgcaaataggaactttaaaaatactgactcaatcaagaatatgtatctcatatcattacttataaataaaaaataattattataattaacatttattgagataaacacatgccaggtatttatcccttgttttatacctgcattggtttcataagacaaatcctatgccacatatattcttttttccattttatatggggtagagggttagaaaagttcagtatctggtctgttacagcaagtgacagagccaggacttgaaccagctcttacaaacactgtaggctgtgctcctaatccaccttgcaaatatcagtgtcatgtgctttgaaaaactggtgaagaaaacaacctgaaattgttttctgtctcttctttatttcatgattaaaacaaaaacaaaaccgtgtgtaatatatgctctcaacaacactgcacaacatagtgagcttagatgaactcacagcattgaagttattatataaaaataaacacactcttaaacacccatgggaaaggattgttctcataatttgtatgagcaaagatcacctcattgctgaagtgagtgccaggaaataaaacactacaataaataacaaatgtcattgttccattgtcccacaattt

SEQ ID NO: 17620 - DNA, 105550 bp, Homo sapiens
caagtttgtgtcttaaaccttcagccatgctctaatcccaaatgtcaggaacaaagactctgactgatcaggattgctttaggtgtctactacggggtcgaatcagtcctgggcatgggaagtaggggtcacatagtacaactgtggctgccagaagctgctcttcacaatctggatgaaatattcagagaaggaactataacttgtgggttgggccacaaatccaaaaagggtcttgtgagtattatcgtcactgaataaactctcaggtgctgcaaagagaaaatggtgttatttctagtcagaatatacaaccatctcacaatgatactctaaggaatcaaggcatagtcctatgcaaatctaaaattgtccattgaatagccacggtccgagtctacacatttaaagttgtcttattctaggattctaatttgtcagagggctgtgagagtcaacattctccattctctaccttagcaatactcttttcacctcctccactccaacaaaagcttccaaaggaaatcttccttcttaaaagaaactgatttccatgattcagaataaaatttagtaaagactgatgaattaggactccattaatttagcatttttgctacatcaagaatcaaaaagggattaaacttttctatccccatatctcttaaagccaggaaagatttgctaagtgaaataaaaatgtgactttggacaagttttgtaacctctctaagactttgtttccttatctgtaaaatagaaattaacttttcataggattgttgtgacaattaaatgacattaggcttgacatgtagaaagtactggctattagctatgatgttgaagataatgttggttgtagtgatggtagtaataactctagtggtgatggtggataatggtagtggtggtggtgatgatcgtggtgatgatagtggcagtggtgatggtggaggtggtagtggtgatgatggcaatagtggcagtgaaggagtggtgatgattaattatgacagaaccaagaatgtataaattgttctcagcacatagtagtcacatagtaaatgagtgcagagaacaagcaatttttagataattacaaggctcttagttaccatttacataccaaccatggatatgtccaaaacaaatcatgcttaaatgttcatcaaaacagattcctaaagccttccaatagatgtttaaccactttgtatgaagtggagagaagaggaataaatatgaattttagttactacatgaacataaaataaatataattaaaaataaatataattacattcccttaagtaatagtgcataaaatatagactgttttgcttgtgttccttccagttagcttgctacataaagccacataccattaattcaaatttcatcgtcaaaaattcacatttctaagtttgttatcatccaagtctaggaattgtcctatctgcatactattttaacctccaaaggtctgcgtaaaacccattttgtggctaacatggatctatctaaaaaatccagttgcatctctccccttgggacttccagggtgcagcagccacaccaatttctttatttaccataatttgaaagccttattaatcctaaaggctcagctctataatcacatttggttagcttgagactaatccttagaggttatttatttttcatgaagattgcttcccagctactggtttatttagactttactaataattatttcgcaagagcttttttcaccactgctcatttatatgtgtagaattcacactgtgaatatgaactaaggatgaatttttttaagagttaaggtttaactggaatgtcattttttctttactgtgccagatcattccttttctgggaagctgtcccgtgaaataattaaatattgtccctttaaaagagtctgtgacctgctgcatttgtaatccttgaattccatgattcagcccaagatctcccagctttccatttcacactcctgctcacatttggtttagatttggcttttctttgctcgagaggaacaggatttattactaccagtcagaagccatcagtccccaatatttcagcaaagaaccctagtctgccagagtgagtaatgctctgtttgcactcaagtctccctgaaccagtcaccccaaataggatgtcactgcttgcatttatttagaaactgtcaagttgtctatgtgtttcctcccaccagttcatgtgattcctgaaacacccctatgcgctttgatgggagggaaaaaaaataacagtccctcatacatttatgtaatgcttatttatggagcacagtgtatatgttagggactgagagctgagtatgtgctggcaccccagaaggacatgtccctgttctcaggtagcttagaggtcattgagtcccaccatgaggcaggcacaccaggaaatggtcttgatgtcttctttcactgactactcataataaactatgggaaaggtctgattacccttgttttgtggctgggattaccgaaactcccagaggttaagtcatcctctgataagggggaaagccaatgctcagacctggactttctyggtccaaggctgctgattgaattctggattcttcccaaatagtgtaatctcgtgtcaactcaaatcaattcaagtttcctttccagtttcccacatcccatggtttggcttagaaagaaagatggtgcaacacacaacagatatcaagcatctaagagtttgggaagggtttgtgtgaccagtggtgtgggcagggtgtctttagaatggaaagtggatgagaggggagctcaaagaggtgatccaggaattcccaaaggtggaccttgactcagtaagtcaccaggtctgttatttgaaatgagtcatttgtggtatgggggcaaatgacctcagtccctcaccaaactatcgggaagcaagcaaacaaaataatccccgcttctggggagaataatcctaattacagcccctagaatttgcatgcccttctacagtttgcaaagcactttcacacctatattttccttggtggaattgtttactgcactaatggagaagggaccaggacttgatatggcctagtttgttggtttttatatattttttaagaataatcatctgtcaaaatgtaatttcatgcaatagtctggtatataaaactgatgcaagtggaacttctgtggttgggatggggcctggggagggagaggcacagcttactcctcagcttttactctgaccactaggtctgcttctgaggggtctctaaggaacctccaggttccatgaaacacagtaagacagacattgttcctagtgactccccacgtcacttcactttcttgctccaagaaaaggaagctgaaatccctggaggttgcatgaggtgaaaaaagctgctccttgtcctgtattcttgtgcatggaacctaccagggctggtttcctcacatgagtagggactgaagccttatctgggagccagtttgcccccagttgtttcaagaaataaagtgtcctcttggtcacagacagcagcagtaacaactttttcctgcggactggcagcattttccaagcacctgctcttcaggtgggagttacgggtcactgtcttcattccagacgggcggctctttgagtcatggcatgccagcttctgagtggctgaggactagatccagacaaggatttttcagtcccaaacactcttcctgaaaatgcaagaggagtagtctttagtcaaacagaatctccacaactgaaaaatttataccggactagacagtggtagtggttgcacaatattgttaaagtactacacgtcactgctataaacacttttaaatgggtgaaatggtaaattttatgttatgcatattttaacataacaatgataataattttaactaagtacgttgcctccttatttcctacagggycaagttcaaactccctggcatagcttacaccttgtagtccccatacctgtaacctcatgtctgctatcttcccccagccccttcatctgatctatgttcagatcagctcacattgctctctattctctggacaagccatgttctttcacttttctatgctcaaacacaattttgcttttagtaatgatagcaaacacttatttaaagtgcttactgcatgcatatgtagacataaatctacggcttaatacatgcagggcttttgagtcatttaatcctcaccaattctatgaagtaatagaattgtaatagtaataatagatactattattaagcccattttatacttgagcaaattgagctaattgccttaggcaaggtcacacaactaagaagcagccataatagggtttggatctaggtgttctagctcctgaatccatgctgttcgtcactacactgtactgcctgtggatgacttacttgtccctgtagtttcatctgaagaattcctcctccttttcctttgaggcctgcctcaaatatcacttcccctgtgaagactgcctggtgttctccaggagagagtgtgactcccttctctaggaatggtagcaccccaaacacacacattttgcagcatatttcaccttgcatggtaatggcctgcttgtgagttttattccgtaccagagggtgagggctctgaagatagcgccaggtcttatttacctcgataccccacaacactcattacatgtctgatgaatgaatgcatagggggatggctgggtgcatttctctcaacttttcaatttcttgaaataaataacaaaatcttaccttccctcagaagtcctggcrtggttcctttcatcttgccacagccactgataatcactttcattttctgtgtaactcaccaggcaagaagtccatgcagatttacttttagtagttcacatgacaaataaatactgcgtttgatttccaaacattaaaccatagtatattatagatagatatagagttatcattcaaagtatgatatttcaatctcaaaaggcttcccctgaagaatattacaaactcttcctctctttaagatctgctgggtaggaaagatgggagaaaatgaattaatgtttacacagaaaggaggataatgggggcaaaaataatagatgaacgtatgggtggatgagagaatggataaaatgataggtggatatgttgatcttggacagatgggaaatgagtggatatatcaataaacagatatgtgggtggatgggtggagaagaggatggtggatggttgtggttttatgaagagatgtgaaaaaggaagtgtggaatgatggatgagaagttgtatgggaagatgaatagaagaataggtggttgaataaattaaaaggtgtgtggttggatgaatgaatgagtgggatgatagatggacctaagtggttagtggatggacaggaggatggatggatgtgagagccccagaaggacataaggaaagatgggtggatagatggatgggcggatggaaggatatttaggaggatgaatgagcatgtgtgtggagagaggtgcccattcacactggcttgaacacatgggttagctgagccaaatgccagccctatgacaggccatcagtagctttccctgagctgttctgccaagaagctaaaattcattcaagccatgtggacttgttattgaggggaaaaagaatgagctctccctctttccacttggaagattcaccaactccccacccctcactccccactgtgggcacggaggcactgcgccacccagggcaagacctcgccctctctccagctcctctcccaggatatccaacatcctgtgaaacccagagatcttgctccagccggattcagagaaatttagcgggaaaggagaggccaaaggctgaacccaatggtgcaaggttttacggttcggtcatcctctgtcctgacgccgcggggccagcgggagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgckggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcggtgagtgcccgccgcagcctgggcagcaagatgggtgcggggtgctcagcgcggacccggcggcagcccctccggctgagtcggccctgggggactggagtcaagtgagctgtctgcgaagtgcattgggctccggaaagcagggctgggatttgcgcyaaaccgttggagaatgtgtctgtggaagcaccatttggttgaaagaaaaagagaaagagaagaaagtttgttgggcaggctgccggcgcgcagttttgggcgaggtcgctagagctgcagcacatggcagaaagtaaccgttctcccggatgcgcacagtcgttgtctggactaacaggctcctgtgcccaagggctcgccaagccccaccrggctgtgtctaggcagggcagagctgggcggggcagagactggggctggaacagggcgagtggctgttatcaaggtggtcacagaagggatcacaattccaagtgtgagactagctggcaatgggttttccagaraggggtcctgggttctcccagctccccactgagccttgttccaaagcttacagtccgcagtgtcactgccaccttagcgctgtggaagcttgaaccagctctgcggtgaggtcttgggtctccatgagattccagcctgggatagggagcatgaatatgagaggcaaccactggaccagctgcttggtcctcaccacctcctgcttctgccaatcagtgtggggaaatctcaacagtaaggtggctyatattccctgcctggcagcctcagagcagagagaagagccttgataccagggcaacatcagggaccctggagctagggctccaatatctcatccaaacagggtcagtgctttgtggtggctatggaggggaggggctgcgtgtaaggtatattctagcacggctcaactccaagcattctctttctttgtctatgtatgtacagataattacatggccgatttgcttatcgctggccaaaattaatctttcttttaagaagtgccagctgggtcattaagacagctcagcctgcatgcagtaaattctactcagcaaatatttattaacccagttccacgggagtactgagaaattgaaacacayagtctcacccaggtagtttagattgagtacccagtataaagtatcttgaattactttctgctttctctatcttcctactttctgcagtaggaagaaagtgaccctaggtggaggctaggcaggatgagttctctgtgcatatgcatctccctttctgtgtgagtgagaggtctttgctaggtggggatttggggatctaggatttatactactgaagctgaaataataataataatgatagcaacaacacagcctgtcatggtggcccatgcctgtaatcctaggactttgggaggctgaggcagcaaattacccaaggtcaggagtttgagaccagccttggccaacatggtgaaaccccatctttacaaaaaatacaaaaattagcagggtgtggtggtgcacacctgtagtcccagctgcttgggacgctgaggcaggagaattgcttgaacctaggaggtgaaggttgcagtgaaccaagattatgccattgcactccagcctgggtgacaaagcgtgactctgttaaaaaaaaaaaaatgaatacagtgctagctaccatttactgtatattttcactgtgccaggcattatgttaaatattttccatgtgttatctcattctaccctcacaatggcctagtaagaagcttcctgttatcaggcctgtttgacaggaggaaaactgatgcttagagacgttaagtgacttgctggcattcacatagccaggagcagtgctggatggaaacccagctccacygagctccaaagcctaggcttagaatatgttagactgtataagatggacgaacttggaaggatttcagggagggaaggattttggtggactctaggccttagggaaagttccaaaagggactggagctcaaataagcccttgaaaagtggaaacattcaggatgggagagaagagtcaagctggagatcagggagagccctgggcctggcctgaaagaagagggccctggtggtttccctatagtctctagggaagtttatttgtatgttacctaccagtgccatcttctgctttgtctttgggcattctgactcctgactccttccaacctgtctccccgttccttctaaaaggccccacttccaaatatttggcactgtcctaacccttgaggttctcccagagacccgcagtctccctcctgccccgtgtttccacggcccctttgcgcagcatcatttagaggaagtacaatgaagtgccagtagcaataactgccccggccctcgctttcatgtgcttgtaaagttgtttggcaggaactgggacttggaaaggagacatgactttgtcagagggcttggggctgggcatggtgtgrgtggcgaaggggagaaggaggaaaggggaaggaaaggagctcttgttgccccattctggrgagtggtggactctggacaaccaygaggaaactttggaaaggagcaaggctttgaggaggagtccagtctttgtatgggaaagcaaaaagtggagaaatggccaaatgtagttaagtgacattggacccagaaactctgagttggggaacagatatcttgaattcggggtcttgtgcaggaggaagaaagtggcccttggtggaggccaggggggatgagtccttcatgcacatgcatctccttgtctctgtgggtgaggggatctttttttttaattattattatactttaagttttagggttcaaccattgtggaagtcagtgtggcgattcctcagggatctagaactagaaataccatttgacccagccatcccattactgggtatatacccaaaggactacaaatcatgctgctataaagacacatgcacatgtatgtttattgtggcattattcacaatagcaaagacttggaaccaacccaaatgtccaacaatgatagactgggtgaggggatctttgcttgggaattgcatgcctggtgttgagaaagaggagagcgtctgagagccctgggtcttagggctggcacacacctttctgctcccttctctctaattgagcattagagactccgccccytgctgggagttagaactttagctgtgttttcccatgtgaaggagcaaagaggcaaagcttcatctctgttggggctagcatcaactaattcaggtattccccatttacacattggacatctacttgctgcaaaggcatggtgacaagtccttgtgtgggaggctggcagccagtaggaaaatgttccatttgttttttcccaaatttccccacaaaggaggggatgctggacagcatgaaattcttagttcatgacagattcccttccattcattcaggaactatttcctgactcattgtcatagactcagagatgggaactctaaggatcatttagaaaatctgaaagagagggactagtgacttcccctctctgcgacttgttaagatattagggcagggcatttctctcatgtatctctatcatgaggactgtgggagcctcaaccccaccccctgcagtgggtggggagggtgtggtctactggggtaacaacatttgtttcacaccttaaatactaccttacagactcattacagttttatatattactctacaatatacccaatttgagtttaatacaataataatgatatatatttttgaccatatagcaatgttggtgttcgacaatgattctctgtattgtcctggggcttctagcacctcctggaacatcgctagatggtcaggagcaccaaagttttaaaaacctgatgctctgctgtggtaccatatggtcctgtgtaaagcagggtcctaagtcctgagtctctaggaaatactgctcagtgagcactgactctatactagatgtgaagccgggggtagcacaggatatcttatctaagcctcccaacagcccaatacacctagcactctctttaactccattttctagataaagagatcgagacttgtggagatggcatgacttgccccaggatccagtggtggagttgggatttccgcattatctaacatcctcccatgttagactccaatgcttatgctccttcaattcattaygtgtctggaggactttggaagctatacgtggctctcccacactacctgtcccctgtggccagcataagtgaactcttgcatgggtggcttctctctccatccccggcaggctgtggactcttggctgccctgccctggcctgtctctccccaggtttggccaggtttggccacagatatcagagatgccaaccaagttatttgtaactaaaataaatcacatcccttatcagagtccagctgccctcccagatatgctctgatttacaggcttggaataaagagagaggtggttgcttgtctacaggacaagttagggcaatgccctctgcctgaatattaggaaagcagcattacaggagctctcactctgaccaggcaagcatttcacatgcacagacccagagacccactcctcacatgctcattagtaggttgtgcgaccctgggtaggaggctgacatgggtcttgaactgaaacccagtgtgtggctctaggtgacatgtggccacccaagtgaggtttcggatccacctgcagtgtcagatgcttcaaggctggggtcccctgatggagagraggtggttggagatcacctgggcctcctcagcactgcctcctggctggggctggggctggggataagagagtaactgcaattgtgcttccccrgcaccttcgctttaggtcactccaccgaagagcctgaaagggaagtggttcttgcgaaagaatgagctgaagcaggtggcagatgctaccaggcaccgtgtagttttcaaaggggatctttttctgcctcagagagaaattctggggtttgcacagcaagaaaccgatgactcaatttcctttgtgtccctgctttaatgggaaggttgtaggcgttctttagaatggcagggtaggttgataccttctaccttaaatttgaatcccacttttcactcacttagcaggttgaattttttttaagtgtaccccccacagctgcccaactgggtttgcgaggcaagcccaacttgccagagtaaaccggaaggggtgctttctaaagtttgtggttctggagtctggccaggcatggatacagtcattgtgcgttccagattttctgggagagtcaggatctcaaatatgcaaacactctaccaattgatgtctagtgcatattttgactaaatgtttatatatttttccacaaataaatacatgacttaatgtaattgaaagtcaaacactttttaaaaatgctttttgcataaagaaattcacatctttacaactccttaactaggatggtgtcaattaaattaatgtttgattcaggacatgtgtactttggaggtaagtatttcatattcctcccctctccattgctcaattgccccactgggtgacgtaccaagataagccacatgtttgattcttgtttgctggatgtggacatatgcacattgcaggtatgcctataagtacatgcctgaaggatctatgtgtgtggtgggaattggtgatgccaaagaatgctaaagactttcatgccccttaaaggggaaaataaccacaacaaaacaaattccaatgtatcttctcctgtcttctgcagcactgggggagtcccctgataacagggatcatgtcacattcatttttgtgggcccagatcycagtaatattgacccataactgttgaactgcaatgaatgtctagaatataaaagtcatgatatctatatatatggaagcatgctgtcagtatgggctaaggtgcaaatacatttatgtgtaagtgagaaccatggtgatggctgtgttgctcaggacagggctgacttggctggctgactgcccaccacaggcctcatgtttggtctaccccaaacagtgagctcacccatctgtttgtttgcggctttggtggctgcctgctgtgaccgctggggacatctggctaaagacagggttactagatagttgggctgagaagggagtgggagccagtgagatgaggacaccaaccccaaatttaagcctcaaaacaaaaacactccccagcagcagccaccttggggttctagttattttggagatactgatacgaggttgagatccttgggtgagaggcccacactcctccaacccccatgtctgcttctggaaggtggtggcagaggagagaagtagaagtactatatgggagatgcgggagattcttgccttctctgtcggtctctttgggcaattatcaagctgtcatctgaccagatactaccatagcttcttcgggggcaaatccgtagggaatcctgacatccgacggggagccactttggcaatggcaaacggtgtctcctctccacagagcttgtgatgtcagaaattacccataactggggcaggttttgtcttyccaaagattgtctgcccagctagacctgagagacagggagacaaacacagaatgagggggtgggtcttgtgggggtggggaacgatggaaactcacagagccagatctccccgagtttgagttgcactggctgcctgggtgtgtcctcctgaggtaagtgtccctgcgaagtgcaagtgtgggcagacagatctcaggtgggtggggagggactgagtcaccaaggaggtgatttgcaaaactcaggtcccagaaactttcaggtcttcagcttttaaaagtaaaggttaattgcaaaactccggggttgagggaagagattattcacatagaccagtcattttgagcatctgctgttgtggcattgcaagtctccttcgcagtgcctgaaagttcatttgtttttgagagctcttacgctttttctgtttgcatctttgcacaagttctatgtttctgagaaccctcaccactattagtaataatagcaaacacttacagagtgttgaccatgtaccagcgccattctaattgtttcctatatactgccttgtttaatccaaacactgacttcatgaaggtggtgctgttattatctgtcttttacatatgaggaaactgaggcacagagaatttaagtagcttgcccaaggccatgcagctgataagtgatggcgctgggattcaaactcacatctggctacagagttcatgctctttgtcactatgttagagtgcttctcttggtatattaagatatcgaggcaccctagaaatccagacgattgtacctggaagtactgtagttgttttcaaaamyttcatttgggaatctagttgtgggtgaggtcataacatccactgagcttttaaacatgatgtcagaggaaggggttagaattgcaaaaatgaaggaggaggaagttgtaatggaaacttctgccaatgcatattctgagttgactcattcattctgatctctgaatagaagctctactctcttcyatgtgatggaaagttgaggatagggtagggctgagagggatgtgaattgagttgtttgttcattaggataggatagggctgaaagggatgtgaattgagttgtttgttcattatcacttcattatttgtcacctggatgaaaggtaaaggtggctgattagtgtttctccatcagctagaactttgactgggaaatgagccaatcaaatagcagcaaaatatttgccctcaccttacaggcccttggttccagggtcttctctccaccggctagaatggatgagggagggagagaaactctgagaaaagaggctgtcaggagtagggctgtacatatccagggcacaaggaatttggcaaaagctggaagtrtactatagcccttctctccagccctagcctaaaccagatgaccaggcttctatttggcccagcatgtgaccatcccatcagggagcaagagagtttcctctgggtacccctcactgagaaaaaagccacccaggaagggaggaggcaaggccccctgggaacatctggctcagtccacaggaagggatgcaggccttttcctgggaatgaggactcatcccatattccagcccccttcccccaacttttttttttttcaattttagtgcatctctttacacttaacaggtctgcagtgacttctaggaggatccacacaccaatcgtggaactaggcagcatctttttccacttcctttccaagatagtagcacgataacagtaaagcccctttgcaagtgttcactattatgcacattaagatgccagggagagggctgggaaaggtggctcacacctgtaatcccagcactttgggaggccgaggcaggcggatgacctgaggtcgggagttcgagaccagcctgaccaacatggagaaaccccgtctctactaaaaatacaaaaaaattagccgggcatggtggtgcatgcctgtaatctcagctacttgggaggctgaggcaggagaatcacttgaacccgggaggcagaggttgcagtgagccaagatcacgccattgcactccagcctgggcaacaagagcgaaactcggtctcaaaaaaaaaaaaggtgccagggagaaatgaacaattccatgcagccaacacctggtctcctgcgtttggcttagaagggcatttctgcccaagcccccagctctagtctttgcacactttaaatgagtagctactacatgccaatcacagatgttgcctctgctgagtatccagtcaaaaaaccagaatctaacagagctaactaagcaccatcttrcaggaaaccagctgacgtcagctccgcagccaccagtgagttactgggcccacatctgcctgcaagagggggaggggaattcaggtaacccacaagaggggataaaagttcggggaagaaatctcctgtcaaggagtttgtttttgcagtggatcctctgcagtgagactagttgtctttacaatatcattagaggtcaggtacattcctgtagactcccttaagtgacttgctttctcctattgttccccctgaaaattcataaaaacctcacaaacacatctccatttaaaaagagaaagtttaaaggatgccatgtaatggttatctcttttcttttgccagtgagcataaaagctccttagggaaaagcccaaaccctctatacattttcatattcatgatagccctgagcggtcagcacagttccccaattatagtgggtgctcaataaacacttggatggcttactgaattaataatgtttctagacttggctagcaaagccatctccgttacttatcttttgtgatttttataggttctgtctaattctttttcttcattttttttctttctggtctatacaaatcttctttcatttttctctattgctacttgtagcgatcctcaacccgcctcctcccttgaaatttctgttctctgcactctcttcagtctaaagagatctttcttgaggtttgaaatgttacacaaggcaggggaagtttagagctaattgtattttgtccagtagaacggggatctggatttcctataggtctggctgcctctttgtctacacctttacttccaaatctggcctcatgtataaaaagaccccaaaccttaaaatcatgttctcaacaatactcagagaaaaattgttggctttttggtcaccatgctagaggaataaaagggcagttgtttctttcggtcaatggtttgaaaacctcccagactaaaaatcacctccatataatcagatgcttggtgtggtgtaatgaagatgaggaggtctggctttgataagagtcatttagaaggtataaaggcagtggaacaagacgggaggacccatacaccagttgattcccctcttgccacttaacagcagcgtgagcttgggcagttgcacttgttaaatgtctggaacaatacttagcacgtaatttctaaagcttaatgtttagttcacagaaggtatcccaagaatagaaatgattattatattttagcttctctctattactgattcactatgtgctgctaggcaaagtatttcacccccatttacttctatttttccatgtgtaaaatgcgagggttggattctagttgatctgtcaagtcctttccaggcctcatgttctataaattcaccactctgtgggcttactaacacctgagcctcataaaacctaatggaaagaataacacaaaaccaccataaggcagtgtcaaaaaaaattgatgcctgatttgtattaaatgtcaaaagtgaattattaatccatgccagaaataaacatatggacccaattacactctaactccaatgggcaagagtgttgtagggacaaagtgctttgcccgtagtacttcatagaatcctctagaccatgtggaaggtgagcagatgaagcagctctggccagagaagttaggaacatgtcccagtcacacaactgaaactgcaggaagtcagtcctgggattaactgcaggatctgaacactgtactctttatattgtactttaaaaacattgcttcacatggccagaaaagccaacctctgaagaagagaaaaattgttcccttcactctcagagcttcatgagcaccttggacttgccagctttcctcaagcaacccctgtaacttgttggcacaaaattaaccacaatattcagacaaagcagtacttacagggtgagtgctagtatcctatgcaactagggtagcctgagaatctaggggaaaaaaagctagaccaaacaaaagattatatataatctttccccaaatcaaggcactgagcaaggcaggcctgagagatggtgaatttctgcttctactgagagtcctccagacccccagtaaaaatttcttttcatcataaaaccagagaaactcttgctcaggaaaaagaaagaaaaatggaaatcataaagattgcacgacttaggattttgtcaaaatgtgtcagaggctataatataaggctagtttttggcattctgtcagtcaytgaatgtccttcrtcagatcacagctccttttggttgtgctgactttatacccatctggaatccactgaccattagctgaaataaaatcccagatgtgctcagatctcacatcctgtgcaatgccctcagttattgctgatacggttcagtcatctgtctctccagctaatcatacagacacagtattctaggagaagtgagaacccactcatagccaggagagcttctccctctcagtcacagggtgactgtgggcaaggtccttcccctgttggttgcctctgtctccccagttataagatggtgacaaactgaccaacttaaaatttccttaaaatgtattggcactgtggacagaaatgaggaaagtggaagacctagtttctgtcctcagggagcttaccatttggtggaaataaagttaaacaggtgaaagaattatgcaagagagcataaccaagtgtcagaagacaggaaaaacagacatctcgattgcatgtgaaggcttcaaggaatttgaggatgagttgaatgtggaaaagaagayagacagagagaggggagaggagagaaacccagggaaaggcaaaacatgagccaggtgtttaaagtgggggaataagaatggcttgattggggccaggggaggggtcwgtctgcttggataagagaattcatgaaaagaacagtgagagatgaggtcggacagattccaggcaatcaagtaacagtggcactgtccactggcagaagatccaatttttctgccccagaaactcagaagttctcatgaatcaccctctcagacagtgctagacagagttcagaagcaggccagctccaacagtgagaaagaactttggcaactttgcctgggttagagagtggcaatttaagtgaatcccaaacaagacctactgtggcaatagcaaatagattttagctcaaggaacatttcccattgactcctagaggcttcccaaaatgctgtactaagaagtcaaaccttggctcaggtatggagagtgctgtgatccattagtgatgtctgctatgggcacaatatgaaggatttgacccccatgcatcacatggacatcaccgtagtggagcagcaggctttctttgttaatgtttctgagagttgtgtgtatagtcctctgggagtttagccattctagaatctgtccagctagccatactatagactctatctccttctagaacagtaaaaaagcagtctcttgcccagagggcagaggttagtcacttgagccttttgttaggattcactcccattctgtcttcccatttacccacatgaagttagatgctgggagccagatatttcctgtgtttgaacaagggccagacttcctggcaaagggtcccttcttcccatcagtttcttcaactgcaaactgagaagacaaaagtgatgcctcacccgtggtggcgacaggaggaataactagctaatgcgaggaaagcttttgaagatgaaagggtggtatgtgcatgttaattacaacttttatcagccctggagcctctgcattctcagctgccactggaagctcttctgtgcctcccaaatgcaaacagcagccacattccatgagctggcctcactaagtcctgcttagagcatccaagtcaagaaggttggattttgagctcaggctggccagctggctcactctgggccactcaagtttcccactactcatccccaagggaaaaagtaggctagctacctgggcaggtaagataagatagaaccaaggtataaacaaaaggctccatcaaaagtctaccagaaatagcccctgggtaagattaggacactctgctctaattcccaccctgtgaaagcctaattgtttgaccttgggctattggctttatctgtctaatggttcaatatactgtgtgaaccatttggggataataatccctctgcctcccctagacctctccacctttgcctgctggtgtgaaagtgttttgtgctagtaggcagaarcacgtgatataaaactacaaggtcctattattacctaggataactttcgcctctatctatgtctcctgttgctggttgaccccaatcattgaaactgtattctttggaatgctcagcagtctcctccaagctgccattccctccttatctaggtgggcccagtattggctcaggcttcttggttgtgccacttcctaaggcttgcaaatgcattcagcctgcccttgctctcagtgccagctctcagtgcccttgctgggataactcaataaagggctagaggtgggaatgggataatcatcagatgctttgctagtgctgacgggacagcttagaaggtataaactgagctgggcccatgcagcaacaccaaaatatgtgttcaaagagggagaagaggagaaaaagagaaaggaagttatcgtggtctgataacagggcatgtcagaatgggaaagrgtgttaggaattatgtagccaacttgtttgattggaaagataaggaagcctcaagggctgcaagtgactttcccaaggtcacaaaactaattggtggcaaaaccgtggtcttctgacttgtccggtttcctttcattttatcctttgagacgataaaggagaggacactaactaaacaagaagacaatgatctgatcaggacaagaagacttggagtacaaaatgagaagaagataatagggkaatggattttttagtggcacagtgggaaatggcgtaggtgtttacactgcactggagccctcactgtgcttggaactggttccctgtgcacagtcttgcacacccatatttggtatttttttatcctttttgacttaatgagcatttggaaaccataaggcccacagcaacctgacctttgacttgcccagactctctgagcaattytgtgagttgagtcaacaatcaatggttttcaaattattcaattgttcactcaacgcatactagttgaacaccaatatctgtgctctgctaggcactggggataccactgtagacaagagaggcatagtctcctctctcctggaacttacagtctatctggaagacagacagtaaacaactaatgatgcctttgtttaattacacttgtggtaagtgctatgaagragaagcactggatcttgtgagagcataatagggagatctcatctgatttaaagcaccagggaaagcctcccaggacctgttggatgaatagcagtaaccatgtctccaggatccccacarttccttgaggacccttgttgtcagacttctcagagctgtaccagccctctcactgtctcaccattgggtcttctgagtaagaaagcaagaaaaaaaattttactcctcaaaattctgaaagcaagtggtttatcatgtctgccctgtaatagtggtgggaagaaaatcatgagaacctctaagctgactcaggattttagaagcacacatttggggagaagggaaacaaaaattctggagaagcaaaaagtgtcatatggtatagaagttattttaagctactggggaaaattcataatttacttagggatcttgagtgtcaagcattggtttagagacaaatcttatccatttcgttgaaagttccttgatcttgtggctgaagcttgggcctagggttttattagtgtacatttaggggatggtttacagggtgtctttcaaggtcatacaggtgcctcttttggggtcaggcaggaggaataggacaaactctgggatacgaatgtacaaccatttggctcctagggcctcagtcctttagctccttgcttctggtgacttcttggagacaagagtagactttttcagaacagcgagatagttgtgctgacaaaacaaaaacaaaaacatcatttaagatgccttcagatgcaagtacatgtcataatagaaatattyaaaaattagtagagtataggcactagctaattcaaatgcttggttgtaaacaactatgtcttgtaaatgagaataaagtttattctcycaatgacgatgataacatctttctcactcacttttactcaaattggctttattgggcaggagagacagagatggagttataggtatcatgattgaacttaagctacaacccatctatgcatcaaaccatcatgtgtctcgtgtgattgttatctgttgtgtatattttggtatatccctatctgtacataccagctgaatatttctgtaagtaacagaacaatcagctctcataaaatattacctcccagggcaagaagtctgggatgattccaggaagtcaatgatattatcaagactcaggtttatttttccaactttcaattctgccactcccagtgtcttcctgcaatttagcacccctcatgttcctaaactaaatcccacagttccaggcatcctaggaaaaaaaaaatcmatatttagcagcagaagaaagagtgtatattcacaaacatctcttctaaaattggaggagcggctttttgggaagtccttaattgacctctccttatttctcattggatgaatggggtcacatgcccacacctaaccaatcactggcaagaagagcttggaccacagtgcttgacttagaccaatcatgatccacccactggagctgggatttgaggtctcacctgtcctgaagcacaaattcagggtttctgaataaaattgcacttcaggtagaatagaataactttttttgcattggtaacaatgtgggctacaatgagtaagggagtccatttacctgctagagttgtggtttgagactatttgggctaaggaaagaaggcaaagctaagtttttgtgcctctgtgccacaccctcaacctttttctgaaaagacatgcctcatgggtagagctcacatgggggacacactgcagtttgaggtttagatggtctgtggcttatactcaatgataatacctaaaactttatcctttcctgtcttctacaaaagagaattatatcagggaataatcttaaatctgttataatttacaagaaatagccagtcttctgcacacttgagtactttattattagaaactcattacttgcaacccatctcagcactgttggagctacaccatgcatgaggaccgctgctctagagtcatccattaaaaaagaattcctacgaacctgaatgagcatttctttctctaaattatgagatgatgaccctcaagggaaatggccgtcttcccttttctactgcactcttagagtgcattaatgtgtgtgaagtgttttcggttccattatctaaagcagccctcatattaacatcgtggttggcattaytggcctcctgtatgggatgaaagtttaatgacttctgcaaggttatgaaaggtcaagatcacagctaattagtgcaaattcaggatttgaattctagtttctaccccagagctgatgtccatgtcaccatggacatcatttgctcccaatatacctgatttactttcaaggggtctggaattgactattggattttatattaaaaattgctctttcataggcaggaaaaagtccttcctaatagtttgagtccaaagcttaagggtctagcatctcaactttttaatgaacccaaaaatgaacaggagggttttctgagccagtcccctgcctccacacagttagctcatgaatccaacatcatgggaggaagtcttcaggattttgtttcccattccttttttatcacctaaatatagttaaaggatttgtgatgactgcatccagagatgtttaaaaatggacctgaaggatgtgattgtgtcttaggcaggaagggtgccggttcttttcagtatctaatgatgaacgatctaaaggaaatggattctaaaccatttgattctaaaccaaaatggtgtatgtttcttttgagggtgaatttcctgatcatgagccttgttgagcattagactggccggctggttcctaatccatccttcagttctcagctgcagtgacatttccttagagagacagatctcctttggggacagcacaggacttgagaaaaaaggcttccctttccactgagcttggctccaactacacctcatgtgtctgttacatttatcatgctgtgttgtcaacttgtttaatgtctgtcagtggctcatgcctgtaattcagcactttgggagcctgaggcaaaagacttactttgacagcagaggtttgcagaggttgctgggcaacatagtgagaccctgtctctacaaaaatatatttttaattggctgtgcatggtggcatgcacctgtagtcccagctgctcaggaggctgaggtgggaggagtgcttgggcccaggagtttgaggttacactgagctargattgtgctactgcactccagcctgggtgatggagccagaccctgtctctaytaaaaattargaaaagaaatagcctgtctactctattggtccataacctctatcgagacagtgaccttgtctgctttattcaatgcctggatcttttcctagcacagtgcccagcacatggagacwctgaatttggattctcctttttgaagtccccatatccacttcagtattggggtgattttgatgggattgtgacttaccatggtggatgcakcctgtgagttccaaactcaacttcttaaaaaaccttgtctatcatctatccatctatctgtctgtctgtctrtctrtctatctatctatctatctatctatctatctatctatcatcygtctgtattctatgttccatctatcatctatctgtcatatatctatctctatctattaattatctctatctttatctatttatatctatcatctatctgccatatatctatctctatctcttaattgtctctatctttatctatttatatctatcatctatctatatctatcatcttttaacctatctgtttctattggaataagagacaagtgcttgaaaagcagaggagagtcaatacacaggccacatcttctctcactccctccttcctcctcatagctgtgagccaccccagtccctgtacctgcttccttggctggcatcatctaagaaatcatctcttccacagtttcctgcaagggcatcaccccaagggaagctgaacacatgcaacatctgcccactcaggataagtgtgagggataaggaggaaacatttttcctctagagacaggactgttggggcaagggctggggaagcaagacatggatactccaggctacttcttgctggggctgaggggagtgctcggtgtggctcccctctgggacgtgtttagggcagctctctcgcctctgaaacaagcctcatcagatcatccccaggcttccttccgcatagtttctgatgatataggaaaggagcccgattatctgtttgagcttcctgttctttgtattgtttggaaggctaaagtcaacagccacttttgtattctgcattgtttgcrttgttaaaaactctggaaaactcatctggtttcttctccaaaagtagcttcccagagccctgggagacactcagaaataagatccttttcaaataggccagcagggaccagggtctctcagaaccagctttcctatcttcttccaaaggccggaattgagaaggtttactccagcccacataattgagtctctgggctgtcaaggacgcattggggagtttgcttctggtgtgctgggtgcttagaaagccgtatgaattgcagagatagagttgggttccagttctgccagtcaccaattatgtggccttaagcagtttacttaacttttctgagcctcaattttctcttctctaaaatagagttgtaatatacctatggcttagagttgtgtaaggactgacgcgatcacagacttgaaacccttgatagaacgactggcatggagtaagcattcaacagtcataattaaggtcattgtgatgattacacttggggcctctccattcaccatttgccccaactgtgttcctgctgcacttgaaaatgattccagctgcctctggaagattttcatcccatttctgggaaaaacattagccaataaaytctcattgaatttggcagggcgggcacaccagcaagctgacactatgtgcatacaggcttcctggaacaactgttgctgagcaaatgaagcagcatggaatgttccgggaagcaggattattgctgtagctggtgaaagtgaactgggaaacgcactccaggtcctgtctttacttgcacaattacagtcaatccccaaggctgcttgtctcagcaggatcagcctcttcctgccttctgtcctggcagtgggtggtggggctggaggaagaaatggtgttttcctccctctcccattgcaattgtttccttacagtgctgttctctgaggccagagaacagaagggctctttccagaggcagtttaacagagtagcttccttttcattctgagaagtttggagtttcccagagtccacttcctccctagaagcgcaagcttggaatttcttggttgccaatgaggtgccagcttctgagtgcataaagtgtgtccatcgtttttaatcaattctctcatctccaaaaatacctttaattgcctttagctgcttagttctgctgtcctctaaagaaaacaagatctggccactcccagccacacctcagaagtgagtaaggcttttgcaccttttaataggagtatttacatgtgtgtcggtttctcatctgcttttaatttcattagagtgtgattttggactgttgtttgagatgaaagagcagattatcaaagtgcagatgattttttcatggtgcaaacacatcataaattagaaactatgagacccctttgcagcggggaagactggggccagtcatccaaggtttcatcttcctgtaggagaagggaaaaaaaacggacatttattaactatctgttatgatccagactctctactggtgctttttgtatatttattctctaactcccatcaacttctctttgagagaggcagcaaatgacaactgaataaatgaatggctgaatttcatcagagccagtttacaggcagagaaactgaggctcataaagcggacgtaacctgcctgagatgtctcagcttttatatggtggggctggaattcaattcagagctccttctcccttttaacactacactgcaagttcccattcagcttcatgggattaatcctgttcttctgtccctagaatggagccttgaaagttcaaggtgtctccttttcctaagaaactggatttttctggctccttgagaattgaggagctcaaaacaattgagaactcttgggaggcatcttcaggaaaggaggtggtggaaactttcctctcctcactctccccaggggcaatggggcctccaaggccaycaaagatcaaggtgccaggtgggggatgcctcccagcttcccattcatttttcagttgggggccastcagcagctcctcaggtgaggattgtctcagaactgaagaatggttcaaattggcccaagatgctgaaatttattgcagggatcactgggacagtgtgtagcaatttaggaggcttctctctaagggaatcagtagctgctgcatttctcttaattgaaaccactctttccctccagcttcgatggggcaggttctcatatctgcgtgctgaaaggcgtttatttggtgtattctgagagcaggatgctggtaacactttcttttgtgttttgccaattgtttctttttactggctagtccaccctgtctgacgcattcattataccataaccaccttgacaccagagtgaaatgccatttctctgcaggtaggagagagtcacacggattccttgagtgtttgtagcgtaagtgagaaagatatgtagccttcttctagaggcagagggatgggttggctgggacttagagatattcaaatccaactctgttcttgtctgataaagtaaacgaggcctctgaaggtaaagtgacttctgtaagtactcacagcttatcagtaagaagcctgatattaaaactccaggtcactagaccttcaacctaatgttcttcccactaaaccaagttaacatttattgtacaccatactaaatggcagacactggggacacaaagatgaataaggcatggtcccagtggaacccactttggttatatgggttaggacacttgaggcaggatcctccttagaatggtgttttataaagtctctctttctctttctctctctctcatctctctccaatctatcctctctatcaagagagaacacatgtaatgtagagtgagagcccatgtattggataattaggcttctggctcctaattatcaggaagcctggaggtcttgagtggttgtaaccaaggatactgaaagtggttgaccagttaataaagaattaagttagagtaagagrcactttacttttaagctgcctttaatacactttaatctttgagatgattggctaatatctgttaagtaccaggctctttgcagagagtcaggtcctttgctaaatgatttaggtatatttcttcatctaatactcaaaaagcaccccataaggaaggcattacttttattttactgatgaagagactgaggcttaaaggttaagaaaacatagcatgcataacatcccacaagagctcaagccaggacttggacccaagtctttcttggatctttccgatccaagccatatggttactgcaatctcacaatacaatgagggtaaatccttgcaatcaccagttaccagcaattgtgaarcaatggatggcatagatgtcagggggtcaggagagccttgcaagcrttcagagggcttgggagtggacacatcacagttgcactctgctgggcagcgctgtaagtctctgattggattttgccttgaattttttctggtcaagactcagaaaggatggatgtagcttcacttacaccaattctacccagcttgtgacccaaatggaactcttatcccttaagccaggtcattcagttgttgtagcctttgccttccaagtttcccttgtctaccctactgagtctgaattctaaggacatcttcttatggactgtgggaggcaaagatgaattccaaatcttatttaatctgtgtgctgggggggaagaggagtgtatttccttttgccaggtatctgagcctacaaaaagccccataaataagtaaaatgtgtccatgagttcataaaagagtgagccttagacatacagaccacctgtcaaaagagccctgtcattctctattatattatcctcttttattttctgtgtaacactatgagtatctgaaattaccgkattcatgtattaatcatttacctgtatactatatcctcactctagaggtaagctctttgagggcacagatcgtgtctgactccccagcccccaagattgtatctggcttgtatcaaccatatcatagggaaggtgctgtgaattgacaccttgcaccatgctttatggaaactaatggtgctttaagaggcacagatttcatagaaagagacccagttgttcccaccctgatggttctaggtctaggtctaggtcaccaaygtctatggtgaaagaatgggcttttgcgaggtatggtctcctgtcatgtatgagggtcatttatttaagggaaaaccaagaccttattttctttgacaactgcacacaagggtcatttgtaatgtccttcatttccaagcctctggatctttgcatggatcatgctccttaaaagaaggaagttatgtttggcctgcttcagctaagcatggaatggtaaagattttggtccaaaccctgtgacttgagttggatttaaaagcttgtcagaaatgagttctctggagcttggcatttgagactggcatccgttgttccagatgagatttcacggattgaaagctcaggaagaggtgtgaattacaagcaattagttcacagggcagttggaactgtagtaatcctggaaaccttttggcccacattttaaaaatatccccacaatccagcttctccctctgtagggcttctgcttgggaaagtttgtgtaactccccaaaacatctgaagagtgaatagcagtagkgttcttggactgcgaaggagaccctgcttcttatgtgcatgctcttgtgcacacagacagaaacacacacatacatgcacacacacacagacatgtacacccatgttcgctttagcatctgatagaaaaagaggaacatgaggaaagacagagattgagtcaycaacatgtgacctggtgatttctgwgtcctctgactttgaaatcagtggaaatttagagctctactttgtcacttgtaatgctttgttgttgcaaataaatatttttgcagctgcatcacttcattgctaatatatttgaagaaggcaagataacctaaaggcatgaatcttgttctgttttaatccacctgtaagtcagtgktggttgtaaggtaaattgtaagtaagagctattggccaccaagtgccaagggttatgaatgatttacctttttttttttttctaaactgaagsaaactcatggttgttcctagaaaaacatgcacactcacttgcttgcattcggataagcttctttgagtaacagggaagaggccactaggattacaaggcagttagtgcccattggagtgtgactggcattgtgcaccctgtgaatcatagtggtggtatggggaaaggggtaaaaaagcatcaatctatggagtatgcgaaccagatggcatctgtcctgggaagaacaaatrtccttcataggagaattagaggactatactagtcaggcagaaatccagtccattcatcaagcttttcctcttgctgtggtccctacagggtcagccctgtttaggctcaagcctcttaaatcccagtgcaagaccaatttctctatgaaattctccctgtcttctttggtctcatggctacttcctgggaggaaaaagtagtaatcagctccctccccccagctaaatgtgcatggtrttagcaaattctaacccaagatgttaaaactatctgagaagaggcatgattctgcttcttgtctgtaccctcctaaagtcaaggtgcagcaaggagagagacatttgcatgtggcccctgagaaagaagagatttgtctgcctcaccccctgctggtgcaaacttgcacctctctcagcctcagttttcttatrtgtatcaagtttcaatgatcgcaatagtacttatctcatgtgactactgtgggattgaaacgagatagttcatgtgaagtaccgagcacagagcctggcacasagtaggtactctattagtgttaatatcactggaaaacccagctgggggctcagcagtagaagctgccagagccttagtgttacagccacatccattaccccaccattcacatacatttcatgccccagggtgagaatccacatatcccaagcagagaggcacagctttggtaaactgagtcttagctaactcatgtcagaaaccaagtgttatcctggggtttgactcctggctcttgccacattcatagcaggatgctgagtggattgtactcagcctcacttgttgcatctgtgaaatgggggtgattttttgacttctcaaggtatagcatctattaaggcacatagactacaatctgacacaaattagcagctccatacattgcagaatcttttctttttcacttaaggagatgctaaaagaggcaagaggaaagaaaatcaaatttggagatgccgtgggctgtgtgttgaagttgggctctggtggaattggtggtgaccttttgcttctctccatctggatggctgtatcttcaaagacaacaagtcttaactgcagtttttgattgtataaatctggccaagtccactatttacccagcccagtctccttagagtaggattggaaactcaaactttgctatctcctctgcagagtgagcaagggacaatctttatgaaaaactttaagttgcaagatatttgtgttcttaataatgaagggaagaatacaaaaatgataatactaagcctggctcatggatagcatttttgcacaatatatttcatttgggctgcagcctttgagctgtactaattgctctgagcatctgtttgtatgtccgttgcatgggatgatttaccctcctaggtttccaaatgctttggagcccctggtttattgcaggacttactaagtggtggccatcgtcactttgattggcccctaccacagtattttccagacttttccaccaaggctcttagggctttgtggtgggtgccagaacaattgatggggtagggtgggtgctggaagagaatgagcatctggtagattgagtctctgggtctgcccttccaccctcactccagcccccattagctcagcttgattttcaaccacttgaaatactgtggttgtgcctaagacatcatgtcagggagagaaagaaacatctgaaaaccatcaatcttctctctgaatgcttccactggtcccatttgcctgttgacaacccaagttgaaaaggcagcaccagaggggaatggggaaaattagcagaactggaaaatctgagttgagatctgggtttaccaaactctccgtaagactttgagtctgtgaaacttatgtccattagtttcttcaccttttaaatgggtctgtagtacctaccctctgggcctcacaggctgcttttgggtgtgaaagtgctttataattggtgaaggaaactgctacgtggcaagaatagcaaagcctgatgtactttaatccattcggttctgctgagggtggagccccaatgtgtcttaattcatatgaggtttctgagaagctttttgagattttaatactgtcccaggtatgcacatcaaccttctcacttttatcccccaagctccaaaatttcataactttttatttcatcttgggtggcaggaaggcaaggtgtgcctgggggagctacagggagttattcaaggtcacataattagcttataattaacagagtttaggctagaacyagtgcatcccactcccagatgggggcccccggcttatctcagcatgtcagcaacccawgaatcagccctgaaatatagatattacctatgagtaacagtttctcatcctacctcaactgttacgaaagtcttccctcaaactaaagctaagcagttccacaaaatgccagctatagacattagcagaaactgtatattgattaggtgatgtatcagtcaytgtaactacccagaaaaaaaaatacaatgacaaaaccaagtggcccaaccttattttctacttgcaagaggaaaaaccctatttgggccccaagatgcttttttcatttcatttaccacatcctgggtttgtgctagtcaatctgctaaatcaataagatccgaaaaagcagaaaacaaagatcgtgaggccagaggatttcctgatcaccatggcaacacacaggggtgggtactgtggtttctctgcctgaagacgcactcgtcaaagactacttggtgttacagaattctggtgcagtgaagcaacagttctgggacatatactttcttttgccagaaagactctgttggatccaggaccaggagtggggggttaaacagttctccataccctcacctccaagtccccatcatcccattaggagacagggacagtactgttctccaaactctcaaaacaacccaagagctttctaggctgtgcattgggttgatcatttggtggccttggctgaagggccagggtaacagctaggagaacccttgggattcttctccaatgtgacaggcccctccatgttggttcagcgttgactgccatgacaggctccaggctccacrgaaaaaaggcagagaaatcagggggtccagccaggcgccaagacgttggggtgccttgcatttctaagtgccaagtgatgaatagctcagttgaaagyaacccagggcacattctggaggaaattctctgggtatgattgtgcatgactgttttctctgctcattaaaccctcatctgcctccagggcaattccgggagagactgagtcactcaagactcatggtctgcactgggcagccaaaggcgattcggccaccaagtgtgattctggcctcattcagaagtggatgctaaacaatacaccctttcaccagsagcccatcacatgggcatcaggagatgggggcgagtgatgtgccagccttctagactggcaggcctggggggcagcagagggcacaatagctagaaagactcccagatgaaaacttctgggctttgaagccttcgaacaaatgaagaagaaaatgacttcttcgtgtcctattaagacagtgagttgtggcttttttgagagcagcttgctcagacctcttatgaaagatagatcagtagcaasagcactggtgtaggagtcagaaatctgcaattatgaaccactgagttttgtgtgtgtgtgtgtgtgtttttgtttttgttttttgtttgttttgttttgttttttaacttgctggaggaccatactcggctatccttgattttattttctcctgtgtcacaagagaaattggttagaagcttcccattgtgcctcctggctttaaaaatagataatccaattaacaataatgctttaaaacaacaaaaccttgtccttttcccttcctacttctgatcagaaccagctcagtaagatttattagttgtgcaatctgttttggacwtgagctcagcaaatcagaggacagaaatagaatcctggctttttaatgataaacactgtaaaaataaaaaatttggagagcttaccagtgcttctggctgcccaagtggtttgtgtgtggttgactcccaggagctcaatcactttgggtgcagtccacccagagagcyatgttccagctacatcaacctggagccttagcttggtcagtctagatttttgggtttggctgcagacatctcgtaatgtcacaaggacagcctgtgtccttggtgacccaaccctgggccaaccccaagtcctggagtcctctcctaagagccctgcctaattgtagagagagcattcaggctgtaaagggcaggaggcctgggggctacgactaggtttgggctttctaaattcccaagagtatgatgggaagaccaacaggcagaatcagagagaagcagtcagcccactgctggggaaagccagtcaaggtcaagacttcagaatctcctctctggagagagagtgaaaattccattagtgaagtttgttccactgaagccttaccaggccttggtaaaggcccctatcttgtggtccagaatcaagggacttctgatcttaaaataatattcaataagctcaaattcttctctctagggctctcttttcatgatcacctctccacactttattaaaaaatcacatgaagggtaagtgggcttcctgtcatttcagtgtctgacctgtgcataagttggaatttaacactggaaaatgatcagccagattgcccagtctgaaacccaggtcccccagtgactagcacaagttacttacatcttctcaatgaatcagttacctcttgtgtaaaatggggataataaaaatgcctgccacacaggattgttaggaaaattaagtgaaatattaggtgtaaagtgctgaataccttgaacccagactaggcactcagtgagtgctcactgtggttatggaccaggagctgcaggaattagaacaccattgagtagcaggaactggctttattctcatcttcatgataaagcaacttctccttacatatagcttaatctggaaccaaaaatctaattctgcctcatccctcctgaggagatgacaaatagggatcaggcacacctgggtggctcaagttagaaaacaaattaactcattttgcagaatctggagacgtctggtckggagaactgayagtgccctctctttgggcatagyatgactgtaggttgtctttgggtggtcttcatatggaatgtactgtgtttgccatgttccctaggagatctggcctcagaaatggccctgtgatggtatgtgaacatactgtcctgtaactgagatgatagcttgcacattcagacagacaaagccagttacaaaactaaaagttggtctctgaaacatttgctttcggggaaaacagcaaatgttcacagaagcaaagttctgggttaaagacattttaagtatccaataaggaattctcagcaaacaccagctggtgattcctcagatatgatgtgggaaaggaacctgataggtgatctttttgcaccctataagactgcagcctgtcgggggttgggggcagaaagagagcatttattaattcattatttcattcaacatttgcctaccatgggaggctgtactaggtactgggaatataattgtgaagaagggagacaccatttctgttgtcaacgaagcccacagagaagttccaaaatttcagaatgctggaatttctggttactagagaccttgaagataataatttcttgtaattctttacctggttgtgtcacagactttgaaaaccaatgaaaaccagagatgttgccctacctaaacacacacacacacacacacacacacacatccatacacacaatcttgcatataatctcacaggtccatggatgtattgaccagctcctggattccatattgaaaatcccttgcagcccagctccaatactagtaccaggccactcacctctcaggaaagtttgggaagacgtagataatggcaacttgggtgaaaattacacagtgctctcttcccagcacatgttgtgattttctacaacttcagaaataactggggtggaccaagaagctattattcctcgcaggccctacaatctaggcaaagctttgaaatgtgctcggacaattttatcagagatctattttccttgatctgaggcttagggggcagtatagatgagattaatggcatttgggatcagtgatggtttatccaggagagaatgcatagtacctgtaaccaggagcctgaataggaggcaacatagcatagaggttagaatsctgactttcccacttggatgacattgggcaaaggacttcaccactttgtgcctcagtttcctcatctctaaaatgggtttagcaatagtgcctacctcatagcatttttatgagaattaaattagctgaagtacataaggcacctaataagtgtgcaatgctcattggctctgattattaagtgtcaaacaccatatcaagtgtttgacataccttatttcatgtaatagtcccataaaccctgacaggttcgcattgtcatcccatcaaggaagaggtggagagtcagagaggttaagtaattaacaacctgtgtcacctaaagtgagtggcaggktcaggaattgaaccaggtttgaggaggtcctaactaggttgaactactgaccttmataaaagtttggcactacagaccagctttataggacaaaaaaaccttctttcagagctcctttttctcgccttcctgacagctccctagcagacctcttcccatgygggtagggagataaggttcctagacactgggacactggtctccatgacccctctgtgctgcccacagccctatagtaatgagcgtgctaaaggcctggtggcatttctaccacgggaagtctcctctccaaatccaaaagtggcctcaaacagtcagtgttttcagttgarctcatttatcgctcagagggaggcacttgggacattttattcattacatgatgcaggagatttattggagaccagagggctcaacggaaaacattcttgrtttatttccagccagaaaggcttgtttgagagatgcaatcagccatttagtattagcttcttgartcaaagtggatcctgaatcacagagttctctgtttctcaggagagacacacagacatctgaggagtcttgcctctctatagtggtttgcagcatggctagcaccattgccagagacactggcactctgtcaagcaatgttctgtggtccatggctattcacatcttaaccttgccttaattctacttcattgtgagtttgggcatgtttctttatttcttcccctctctgtgtgttagtttctccatctggaaaatgaggatactaatattacccacctcataggaatgttttaaggataaaatgagtaaataattctaaagtgcctaaaatagagcctggcatatacayaatgaatgcacaataaatattagccactgctcttgctgttggcattattaatatcctcccgggtaataatttgggtttgcgttagtatcaaggaaacctgatgaaatgtcttcataaattatcagggtttgaatgacacacagccttgaaaatgttggctccttttaagtcaagagggacctagagtagaaggattgtgaacattcacaggatagttgaccagaaatgaagtatttgacaccattcttgcaactcctaagtagctaaatagcgtcagggttaggagttggactttctcatgagatcaagataaatgtaagctgtggaatttttactttgcataggatttcttcatccaatcagcagccctttgcagatacctacaatgtgtcagaacctgcttaagccttcacatctaggaaggctaaaggttgagtttgtctgtttcatcctgtcttggctgatcacatgcacatacaaccacacactcacttgcatacamacatataagtatgaggagaattcaaaatgttcatggaaaaatgagattaaaagataaaagtttaaagatgtaaactttacttctcaacataagcaccatcacattcaagatactgttataagctatgatagcggccatttagtccatccctaaagaactgagggtcctgggaatttaatcacatcaatgcaatctttcttacwttgttaactaaagaaaaatgggtgccctttgaagatttttaaagattaagtaacaaaaaaaaaaaagtcagaaggagtcaaatttggactataaggtggatgcctaatggcttctccatagaaattctcaaaaaaattgcctttgtttgatgagaataatgagcaggagcattgtcatgtcatgatggaggaagactctctggtgaagcttttcgatacattttttcttcaaaagcttgggctacctttctgaaaacactctcataattagcagatgttatcgttctttgaccttccagaaagttaacaaacaaaatgccttgagcatctcagacaacggctgccatgaccttggctctacactggtccacctgctttgactkgtccacttttgctttgactggaccacttccacctcttggtagctattcctttgattgtgctttgtcttcaggatcacacacataaggccatgtttcatctcctgttataattctcaaagaaatgcttcaggatcttgatcccacttgtttaaaatttccattgaaagctcagctcttggttgcagctgatctgggcacaatggttttggcaaccactgagtggaaagtttgctcaactttaatttttcagtcagatttgtgtaagctgaaccagttgagatgtctatgatgctggccattgtttctgctgttaatcattggtcctcttcatttaagtcacaaataagattaatttttttctcccaaattgatgtggatggcatatcgctgcaggcttcatcttcaacatcatcttgtcccttcttcaaacaagttatctgtttgtaagctgctgatttctttgggacattgtcctgatgaacttttcataaagcatcaatgattttttcattcttccacctaagcttcaccaaaaattttggtgtgtgttcttgcttcaattttagcagaattcatgttgctctgagagaggatcttttcaaacatgtcttatccttgttagtgcctcaaactagatcctgttcagatatatcaagttagtgagagtttattttggtgcaaaaaaaaaaatttgaaatctatgtatagttttttcatagcacgtatttttcatggaacttttggaagacccgtcatatagacacactcacacaatggatgcatgtattgtcagtgaagttatgttggcttctgaaactcaagggattttgctgaaactcatgaaactcaagggattttactgaaaagtctcagcctcaattggttcctcttacatttgcatattctgtctgccaggtggcaaggtagaattgactgtaataagaaagaaactaccattgagctccaattattgtccatgcctcagagttgatttttaacctgagagtgacagcagccacctgggccaggggcagacaggtagtttgcctcacctggaatcagaggctcccctatcagccttatcttcaagaagctgataggaatgctttgtttttcttttgtgtgctggacaaggagaggccccggaaggtctgtcatgtagattgacagtttccttttgtaagactggccaactgaggccaaagttgaaaatgtcagtaaaaacaaatagtattgcaaaagggccttatgcatttccttctctatcctctcattgccccatcagccgagtgctgcatgagtggcttaagagaacaccattaggcttgaaaaagagtgaactgcaaaaacacattttctccatttcacctagttgttattttccccccatgtgctaatgatgcaaacaaaagaaaataaaaataatagacattggcttaygtcttttcaagttccatttcttgtttcttcttttactattttcagaatcaaggaagataatacagaattttaacagttttcttacctcattttgcatttgttagacattgtttcctcgtggttgagacctgcttcctgctcaggaaagagaaagcagtggttgcccatacaattcaataataatgactctttgtcattatttaacagttgtttaggtgtgcctctctcctttcttcagttgcactaatgatagaaaaggatccttgggcacatagtaaagtggttcaaatcatgggtttgggtggtaaacaggtctgagatagatttcctgctctgccacttaagagctgggtgacgttggggagtcatttaatttttctgagcttcacccataaataatacatacatacataaaactcacctttcaggtttctgaagatgatgcaacacagaatctcaaaggtactgggtacccagggacactgcagtaataggtcccctctcctattgctgtcagctcagaaatacagaacagagcaactgggattcagaaaggagactataggctctagatagaggtactcactcacttccttgggcaactcacttccctgagcctcaactttcttgttggtaaataagtggaatcttcctacccaccactagaactgtgcaaggaagagatggagctggttaatgccagttctgtctgattccagacctggttcttaactaacaacaaggagtggtgcctggccaggcacttggggcattgtcccaagaggatgtcaacatgtcttcttagagaaggacagtcattgaggcctgaggaagtgttcaggaggaataagcttcaccaggatagtttcaatgacttaaccctttgcatgcagtttcctcaagtgtaaaccgggggtcatatagtcccaggagttttcaattacagcctttgaagtcttttgagattgttacacaggatcaagtagaagaggatgatttctagctctctattggaatttcagattaatgtctacaaaactcactaaagtccttgtattgaataattctttacccaactgatagcagttaggcttcattttcaatgccattaactctgagagcaaacgacaggcttttggtctgccaatatattaaaagtgtgtttctgaggaaatttcaatgagtcattcgtttatataacaaatacttgttgagcatctactttctattgggtactgttatagggattagagataacagctgcaagcaagtaaaaggcccttgctttctcagagctttcattccaggaaggagagaaagagagtaaccacacacatcaatagatgaccaggctgttgtgaagacacaaaagccaaatgagttgagggagagactgggggttagacaagggtgtttagggaagcactctaaagtgaggtgacgtggagttaaaattctgaatgataaaaaaaatgaaccacctatgtgaccatttgaggatggaacattccagacagagaggaaggcagatacaaatattctaggatgggaaggagctcagaatgtctgagagaattgaagacaagctttgtgcttagagcagagcaagctactttgaggttagagagggagccaggagccagattatgttggttttagccataataagaacatttatactgggtatgaacataaactcttggaggttgtaagccagggagagatcacttgattgtgaaaaaatgctcataacataagattaagtggaaaaatgactcttaaatctagaactgtatattcagtaccatttcaattatgcaagcatatgtgtgagtatgtatatttgtgtgtatgtgtgtatgtgtatatagatacatactttatgtatatatgcataaagtacgtgtgtgcatgtgtgcacgtgtgaatgtgtgtattcagtaaacaaactggaagaagatatagaaaagtgtttgctgtagtttttgtagtggtggacttattttccttcattgctttcctgtgttttgtaagttttctgtaagtttgtatgacatcaataatcaaaattaaatcatttgctttttaaaaactttgttgcagagcaatcaatggagagaatgtaagagtgatattattttaccatgtcttttctcagatttgagcttaatatcatggtgctttggaatgctggagtgaattttgaaggctctggctagcagagaagtttatttggctttttgtttgtttgttctttttttttttttttttttgagatagagtctcgctctgtcacccaggctggagtgtagtggcatgatctcggctcactgtaacctctgcctcctggttcaagtgattcttctgcctcagcctcccaagtagctgggactacaggcatgtgccaccacacctgactaatttttgtatttttttttttttttttttttgaaacggagtcttgctctgtcgcccaggctggagtgcagtggcgcgatctcagctcactgtaagctccgcctcccaggttcatgccattctcctgcctcagcctccggagcagctgggactacaggcgcccgccaccacgcccagctaattttttatatttttagtagagacggggtttcaccgtgttagccaggatggtctcgatctcctgaccttgtgatccgcccgcctcggcctcccaaagtgctgggattacaggcttgagccaccgcgcccggcctaatttttgtatttttagtagagacggggtttcgccatgttaaccaggctggtcttgagctcctgacctcaggtgatccacccacctcggcctcccaaagtgctgggattgtaggcatgagccaccgcgcccggccttatttgrctttttaaggagtctgtcctaaactgaacttattactgtctccaaattatttatgcaaaagaatctaacatttctrtttcttcccatagatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtaagagaccagcacccgaccactggggaaagctggcggcctgggaccaggcagctgggcttagaactggaaggctcctttcccacagctgaatggattattgcctaaggagtcaaccccacgtattaatttggccaagtcaatctgcaayctgtatgacaactggagtttaaagtcagctaaagacacctttgtgaatcatagagcgggaacccagaggaagccattaggggtcctctcggctggaatcctcttgtctaacctgcttccacagagctctcctggctttgaagaagctgcagtatcattgtcagaaccacaagaaaacataaaccaaataacagtgtttgaaataaatatgtggctgttagagtcttggccctgcagacttggatcaaagcagacttttcaaactactctctcttactctctcttaaaaaaaattttttttggtttctcttctatgtttctctggtttgaaaaagtaaataaaaaggcatgaaagttattaagctatattatattaagatatattatttttgggagccctgagagggctcctacyagttattctagagctgcatagagccttcctcaaactatggctccaagcaagataawcacaacaagcaaggactttattttttgaatttccaatggccttgcggtaagcggtgcacaagaagagcaagccacggtggcaatcacagtgaattgttgtggttcgatttgttttcactagaagaggactgagtaacctctgcaactgctctgaagtttctaccccagcctgtagctgtgcttttgcagtgtctttaggtaatatgattcccctttctctgcaacacacactcacatgcacacagactgcttttgaaaagtcaagctgcagaactctacggaaaccatgaagtgtaagttaagtgcttctatcctccaacactggttacagtcatgcacccacattatgagtgatggctgagactcttgctgaaagggaaaaggaaagtcttttgcctaaaattgccctgtctgatatggtagccactaaccacatgtggtgacttacacttaaactaattaaaatactaaaattaaaactttagttcttcactagcactaactacattttaagtgctcggttagtcaccgatggccagtggctactgtactggatgacccaggttagagaacatttccatcattgcagaaagttctattgaggagcactgctctaaaataaagagcagatgtacatagacatctgtatgtgttcagagctaggtctgggggaatatgaaaggagcagagagagggagaaagctctggtggctactgaacttgcactgtaggatgcaatgaaaaaaggccatttagcaaatccattattctattcccaaggctaattgtttaattatggccctgactaggccactggcctaagaaagtgaatttagtaagctgaactttgattgtgaaatacaaacaaggcatacttgcaaaatatagatatgctgccatgtgctgaggaccaggggagttcttacaactgccactggccaatcatcaagcacttagatgctgggagccctrctgcccacctggccaaacccctcacttaatcctcaaactgcagtattggtcaatattatcacctcattttatggatgaagcagccgaggcttagcgaatttgcacacacagcctgcctatggaggagttaggattctggttctgcttagcctcagcccaggacaggattttaatgaccaagtcctcctcaggggcttaaaaggggaggaaagtatgcttcctggatttgctgaatattctttcctccttgtgaacagtaacttactcatgccacatacacacatataaactttaatatccccaatttacagttagcatgacccataaaaccggtaggcaacatgaggtggcaaaaactcagtaatagcttacaaagagaatgcaatagattctagaatgttggtgttatccatacttgatgacatgatgtgatgggggtgagttggygggtaggttcaccaagaagtattatttagaaaaactgtgccaaagaaatctatcatttcacccataactggtattaagtattgcaaaactcatttccataatttctctcaggtagctatgaatcagctttctgccacaggacagatggcagagtctcatgggttaggataaaaccttagcagctactctcttttgtctgccccaccctgattggtagcaactcttagatatatgaaaactyattaccatttaattgtgcccacaccccctgccaagctaaggaggctttggggaaaccagtttgtctgttcagatgagaaattagtcatgcgagctacaattgccacataggtaggagttctgtgtgcttggaaacttcagactcacagacatttccatgggtcgtgcagggtgatgcactccatgctgttgcccctggcaggaaagatgaaaagcatcaatgtgcattttagccagaattgcattttgaaaaacctgctggatttagcttcctcctctctgccctcctgctgcaccacagcttcccttgcacatggcattttctcagcccacatctcattttttgagrcatttwatattcaaaaaaaattgtgtttttagcacaattaaaaaataagcaagtttttagccaccaggatgctgctagaagaggctgggctgtgtatgttgtatctgtatgtcgtatccagctgtaacacactcccagagataccttggtggggagagaggggctatgcatttctctggctgtgctacttctggaaagttcctgagctacatgagccgttgctatctgcttacttaattgctatgactcccattgtaatgatggttaatttattcccactggcaatagaattatgcctgcaatgctcaggaggcagtgtgctgtgctgtgtacttggcatataaacaaggcttcatgtttagggcaatggagtatggagtaaggggactcacaggaaaagttgtggctgagaaagaagtgggggaatgggacatgaggcaggtctggaatgtgtgcactgaaataaagaagcaccccttcctatctatggaagctggccattttgtgtattttctggaaaacatgaaggtattccagagccagcatgaatcttacatcaaaacttctctcttctgtgactcaggcttccttctgtttgttcaaatagactcaacactgctgaacacaaattttaactgaaactaattattcctttcatgatttttttttaaagctctttataggtctctaaataaaatcactttgtttctatcagtcttgttgatctctttccctctctatgctgttatttttggatttcaaataactcggttgttgaaacctccgatatccctaggggtgaactgaatgaagtgttgcacggcattaaatgtcattgaatgggatattatgaaattcccatcttagccatttaggtcaatatcctgttgtttytctcttacaggtatgggttcatagaagggcaygtggtgattccccggatccaccccaactccatctgtgcagcaaacaacacaggggtgtacatcctcacatmcaacacctcccagtatgacacatattgcttcaatgcttcaggttggtyctcaggggggtgtctgttggygtgaaaggctgtgggagcctggtctttggagctcagcttaagtggggattcatgtagcctccatttacataacaaatgctcactgaatatctgtacagcagagccaacattcctgtctccatggagcttacatgctaaattggggaggcaaacaataaacaaataaatattaaataccattcaggactgtccaatcttttggcttccctaggtcacattgggagaagaattgtcttgggccccacataaattacactaaaactaagagtagctgataagctaaaacacaaacaaaaatcacacaaaaaaaatctcataatgttttaagaaagtttacgggtttgtgttggaccacattcaaagtcatcctggaccacacaaggcctgtgagccgcaggttggacaagcttgccctatatgaagtctgaaagtgataaaagtkctataaaaaagaaagcaaaatacgaggctaatgagtgctagggatgcttttattttctgagaaggtggtcagggaaagtgcctcctggactgttctgagaatatcagtgctcagaagggagaatgccaaggaataaagtcagagagctaagcaagggccagctaacggggtgattcattctcagtgtgatgggaagtcattacaggttttgaataagggagtgacatgaatctaatgatagctttggggtgtaagtcaaatgtcttagctgagaggtatttattatatgagagggctggaaaaaagccttggagagtatatggtatgcctttgaccttcttaaatatcccttacccaacagttgaaagaaccagagaagaagaaacctaagttaagatgtagatgctaggacacaggccagcctttctctatgtctttgtgactttctcccaaccattaacctagaaaatcaggcttatgagccttattcaagtcctagcaaaattaaagaattctatgcatcatgaattttcagaattttttgagaaggatcaaaatataaatgtcaaatatctcgatgccaactatcaaaagtcttacctcttaaactgggccttctgttcccatggaaggtttgaagttgggtgaagggaaagatgaagccttgaggtaaacttggtacatcttgctggagtgtcagttttccctaaagatgtgaaggggatgttaaattagctggaaagggacttaagacattatcagcctgagacaaacacagatatatacatatacatatatatatatttatatatatatttatttatatatatttataaatatttatttatatttatatatttatattcatttatataaatttatatttatatatttatatttatttatataaatttatatataaattatatttatatatttaaatatatattataaatatataaaaattatatttatatataaatttatatatatatattatatataattctatatataatataatatataatatatattatatattatattatatataaattatatataatatatataaattttatatatataaatattatatattatatataaatttatatttatatatatgtatatatgtatatataaatatatacacatttatatatataaaatcaagatatcacagatatatataccatatacatcaaatataaatatacatataccatatatatggtagtaaaatataaaaagctgcatggatttttaaactataaaaaggacatcaacttaattatgagatctttcttctactcactactaaaaaaaacccaaaaattaaaattaattgtgagattacatcagtggctttagtctacaccacctaccctttgttgtgtgaacagtagggatcagagtggaaattcagagaagaaatctagagtttaggacaaagtatcagggctggctagttgaaatggagtgcgtgaagccagtagattttgacaaaaatttacaggtcactgaatctatcgagagacatacgaaacaggaacagaaaactgtagaatgtttactcctccctgttatatgagtgaagaacacaaatggagtttgactaaagggaagggagtccaattaacactaagtagtacacgactcatacatactcagttcccatacccatgtctagcatgtcgttctaatgatattataatgagaaaaccacatataaaaaagtaagaaatagacatagagcaacatgtggtctagctagctccatctcagtgcaacaggtcagagggagacattgggaaaagcttgtgctttagatgaagaggttgactcattgggaaagggctggcatgaggctatacactcctgagtctctgggcactgcttattgcatctcccattgagtcttgctgagtgaatgtatgcaataaattatgtagttgcatacccacattgtcttacctgttttgcaagttggtttcacttgctaaaaggaacctcaactcagatagaagctcacactgttttattgcctggcatcgaagccatctaggcaggctgcgactgagacttgtttctatccttaattttgttcatgaggttgggcccatacctggagttgggagcaagagcattgattaattttcttctctttggagggttagttcagttgaaaagcttgagaagtacagggggtatgttccttactaaaatggatgaattaaataataaagctagaagtaatatttttccttttgtctattttccaaattgactcgatattgatggctacttttgtaagtttttatttaagtttaaagggaatatttattgatcacctctatgtgctcagtactgcactaggcagagatggagtaagaaagaactggaggctacatttcttgtcttaaaggagttaacaatcttgttgaagcaatgagacaaaaaaaaaaaaaagaaagaaactggagaagaggataaatgtgtttaaggataaataaattctgaatgtcttggattagagtcagatgataggggtattaagtgagctaaagattttgataaactgccctatgcaaagatttcattgcaaggatccctgaatctaatttagcctgaaagctgctagcaggtggtcatgtcccagtgctgtgatcccccccataaaacggctacagggataaaagtcagcttgatcttagtagatagcttccataagcttaagttttagcagtatttttagaaaacatggcctgtggctaacaaatgaaaataaggcagaacttgaaaaggcctttgtgattttttttccctcattttcagtggttgaggcccaacgtgagcctggtgacttctgtgtgaacacagaactgacttgaattgattcatttattaagcttgctttcagtcaagtgcctcattttcttttgagggtagaattaaagggaagattctacatgtacttgtttatccatttcctcctttattcaacaactatttgagaatatttatgagatacctaaaatgtatcaagcattgaagagggtgcctttctatctggcaaccagagattagtggttagactgaataattaatgtttctcttggttattttggtgtgttgaagccaaggtttatgagaaagcccacctcagagaatttctaacaagtcctcagattcaggaacacctcaccaggtctagctttccaagcagtacagagctcattaaatggaaagaaaggctatctaataaggccctggaatccgacatgagagcatgagtctgttaattgcacatttgggtcaatccactaagcatatttgccagatttgatgttctttataaaagttaaggtgaattggagcatgaagggggtccatgtgaacaaatgctctaataatttacaaaactgtcttagggtttgtgacatcatgctccattctattacaacttgctgcctggaaattcccagtgtactgttacttgcagttatatttgaagttaggggagattgtttcatccctggcatcaagaagccataatccaaagcctggttccaggtatgcacaacatacaaatatcagaagcatctcataggttgcgtcagtttctgctgatatttccaagagaaacaagatagatactcccctaaatctcccaggttggctatatgcccttattttcaagtgtaataattttggaaaatatttttgaaaactgtaaaaagctaaattaatattaattattacagtcccccatgaccttgtgagtttatcagaagcagggacagaaacatgctcatcttcttttctccttttatatggtctggcatataagtgttgagtagatgcttaaaaataataaatgaagagttatatctgtaacttcctttaattatttcttatggcattaccatttaaggataatctaaatgcgtgacctgtacatatttggagatgcatttagggggctaacatcttargtgtgtttactggaagaatagacccttgggaaattatatcggtacttttttcttttttcatccattcaacacatttttattgcatgtttctctgtccccatcacacataaatgttctggccaagacagataaagttattactcatctgtggagcttatacatttctagggagggaggcaggtagcagaaggcagagattgagagaagtgccatgaacagccatcaagtaagatgaacaagataagtttatatggtggtaaacatgaagaagaaatgagagcaagatgctatgtgatggtgacaggtgtgggggagtgatgaagcagtttagattggatggtaaggaatggcctcgccaaggaggtgatacttctctttaaagaaatctgagaaatcttttaggacaggctttgcaagaatggtgtttcctaaaactttctgtttttttccaattgaatgtataaaactgccagttagttccactaactgcccaaagaaatgggcaggttaaggttatcctttttatctgtgggaaaagatgctcccaggtactaggaagcaaacaaaacctgttttgttcaacttgtgtttctatccacttttataagtacacaaaaattatagcaggacacttaaaatacttgtgataacagcctttcttgtgatagcagtctgtctgtctgcctgcctgtcttcctccctccctctctccatccatctatccatccatctccatccatccatctccttcttcctctttgccaggagcaattctgggagaaactaacctaacaaataaatttccattttaatttaagtatgcacacacacacagaataaaagctgtaatgcacaaatggacttaacctttctataaaggcaaaaccagtttaaagctctctgaggttttagagctcaatacaaggtatagtcacagaataaagcactttggcatgaatagaaggttgcttcagctacactgcagtctgcttttaagacacaaggaatggaatgcagggtggaagtttcagggcctgttatcagaccgcttgagacagtgctgctcagagggctaccagtaacatctgtggatgatcagtcaggcccaagattcaggcagaaatctttattcctaaagcaagggatgaaagagtagaggataaaacgagaacaagagaaaaaaaaaaccagaaatgcccatgatgagatatgccaaaacagtaaccttgaaaaatattctgggcacctaggccaaaggtggtcaacctcagaagcaacatgctgagaagcagtctatacagagtaagcacctaaaagatcagctaaattaataaatacattattacattaatgaaagactagagattcatttggtttttaatatttcaactgagtaaattctttgttgtgattatgttattttaaccttcagattgtcatgctgttcatgttgataaacatttgattgtgtgtctgccatgttttctcatcatttctgtggacttcccagattataaatgattttctcatgatagttcatactttacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaacttcataagttccagaaatttatgaaatcaggtaaaaacggaaaatccatcaggaaaggcagagaaattcctagccaacttaggrgtttcggaaaaagaaagttatttggaataagttatagtaaaactccattctaactgactaataaaaatgagggtagattttcctcatgtttttaaagggttctcatcctttttttcctacctcatagctccacctgaagaagattgtacatcagtcacagacctgcccaatgcctttgatggaccaattaccataagtatgtctctcttctaatcttaattaaattttcctattttggggaaagggctcaggtgtgttctctgtggtatatttgaatagaatattaggccaggtgtggtggctcactcctgtaatcccagcactttgggaggctgaggtgggtggatcacttgaggtcagaagtttgagaccagcctgaacaatatggcgaaaccttatctctactaaaaatacaaaaaattagctgggcatagtggcaggtgcctgtaatcccagctgctcaggaggctgaggcaggagaattgcttgaacccaggaggcagaggttgtaatgagctgagatcgtgccactgcactccagcctgggcaacagagtgagactccatttccaaaaaaaaagaaaaaaaaatattagtcatttccctaagactaagtaaggacagttggctttaattcagtgtcccttcctttttttctgcaatgacttgaaactgctctctggtttacactcatgcatcgttcctcaaacttcagtcatttgaaaaccactttcacattttttttggcatctctatatgtacaatgctctcatttacttgatatttttatttaaatgatccactgttttctaattaaaatacacttatttttaaaaagaaattgcacatggaaaaccaacatcacatcgtaaatagaaggcaaccttaataataaacttaaatgtaagaaaaattaaataatgttcttaatttgcagctgctgaaagctctgggtctgagtcatgttctctcttataaagagggattaataagtgtcaggtgtaggggcattttggccctaattagcaattttctgtttgatataactgaagtattgaaagataatcatgaaggatataaacttcctgatacgtgttttgacattgtttataccacatccatcttaaatcatcctgatatatgattatccacagatgtatatattcgggcactttttaaaaatagacatgggggtctcactatgttgtccaggctggtcttgaactcctgggctcaagcaatcctccttcctcagcctcccaaagtgccaggattacaggcatgagccaccatgcctggcctattccagcactttagaaatcagaaaatctcaaccagaactttcaaataggctaactgctaaccctgatcttacggcctctgagcttcatttaatgggaaacagtacagtgttgagaggtctgatttctgcttcctcacagctggatactgacagtgtgcacaggcatgatgttggcagtggcagagggatgagaatcttcgtagaccatacaaacccagccccacattgttatgtaaggaattgtccctgacctgtgccttgcaataggaaggggaggcttcacaccatgatggctacgacatgagatgtgctgtctcagcaggcctggtatgaaatcctagttccctcaccatgtgtgagattttagaggagtgactgatcctcagttttctcattcatataatggaacaacctatgagaatattcaggaaatttgtaaaagacactatgtctaatgtatgtccagcccatagtagaggtttaataaatgccctgtttctttgatgcccacagttctcttttgaagtccagacatgtaagagtgtggtcaacaatatttccttgtcaaatcctcacctgcagagattaccagggtgactgagaccttgattttttttttcatttatgtattattaatagttccacttgaggcttgccacagtggctcactcctgtaatctcagcactttgggaggctgaggcaggcagatcacctgaggtcaggagttcaagaccagcctggccaacacggtaaaaccccgtgtcaactaaaaatacaaaaattagctgggtgtggtggcatgcacctgtagtcccagctgcttgggaggctgaggcaggagagttgcttgaacccaggaggcggaggctgctgcacactgagattgcaccactgcaccccagcctgggcaacagagtgagactccatctcgaaaaaaaaaaaaagtttcatttgagcaagctaaatatgtggccaaaaagaacctttagtcccatcaatgcaatacagcagaaaataatttcatctaaatgcacacctgcatagtgagtggcccagacttgagagcagcaaatacttctagggaggaataatgaatgaatgcattcaggctttttcttctccaattcattctagtcatttgttgaaaccacagatgttgatcttcatgtatatctgtgcttgttaatttccaggttgaatttcacagagaacggcaaatgctcttctgtatttagacctgctgrtttcctagccagaagtgggtgtttgcacaagtggacaaaacttgccccttaaaaaagaaaatcaaaakcttcatcattttgcagatgtatcttccctgctgaggctattagtctgctacttcaaatccttttcggaggaatatatggaattaatagcaacacattttatatgtacttcagaagggagagtagggaaacaagtgggagaatgattatttattgagcatccactgtattttgaatactgtgctgagcactttacttacaatgtatcacataatccccattttacaaatgaggaaactgaagctcagagttgccttgtccagagctctatgaagctaggattcaaacacagggatgggactctccagtacttccttgtttcctgcctcatccccagggtgtgtgggggatgggagggtgcactttcttagtgcatctgccactctctcccaccactggatagataggtgtttctcattacaaaggaaaatagctttgaagtcactatgttaaacgctaatccacatactcaaaatatgagctgtgaagttctgtaagtaccttttctctctcccagctattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtaaggagaataaatcactgtgcttcccaatagcaattccctggcaaaatgtctctgaccttcctgagcattgcacactcacgtgctgattttctcgtctctagacagctggaagctggtgatgccattcagggaggtgggctcttgtggttgtcagtaaactgcctgcattgactactactgcctaccttttttcctcatctataactgtttttcttaccttagcataagaagtgccatattggaagttttattttggggagagccctccttattctcttatccccaggtatacagtaacaattcaagcctgatatgaaaactgttttcattttttcatgtttccttcttgttcttatccacctatggataagattgttttcataaagttgggatcatagagtttgcataccactccactagcaccttttaaaaaacccacttatgcctgaggttgcaattttttgaatttttgcaatcagaccttggtgatgacaatgagcagtaggatataaataactcccacatgcttagctttccaataatggaacagtaggcatacgtgggtcaactgtggctttttatgttttaacttgatttacattcatactattgatagtgtaatattcagtgattttcaccaacgataatttactcaacaattcctttgtttttrgtccaaggaagcatatctggaagagttttctggtgaaattaaatcagcttaagagctctataatccagcctgttggggaatgttctcaatacttacttggtgtgtgggggtaattcattacttagggttgcaagagtggaagtatgtaaacattgcgttccattcctttggagtttgcccctcgcgcttcagctccactggaaagtgtttacatctctcttgtctcctgtttccctctttgcttttcttctatggtttgttttgaaatgggctcccagatgggccatgttcctcctgtggaggattaatcaaactcaaatagggcatctgcctctggagcggttttcctagtatggtgtggatgttctcttttcctggctatagctcctgaggggtgaaacttgggcctccaaagagtgtggcagaaatgcgctggcttgtgaatactcaagacagggcccttctctattccttgtcacccagaagccagggaaacccccacagtactgtgatttcatttaaggtcacttgcgcaatagtgttttaaatttctgtcagtctctggctgagggcatgatacaaataggcttggggttcccatcactccctgcacattctttgaagctttttaaaaagcagagttttcaagctgcccatactttcttgggttattggccctcttgagtttgcatcggcttattgttggtagtcccgtgggcaacccttcttgagagaggcttctgcaaaccaagcgggccgtgctgctagctactcactgcttcttgggttccctgtctttttaaagtaaccatgtcgaaggtgcttatcattatggtakgcaattttgtcggatgttagcgaacacaataattagtggtctcagcaggaaggagaataggtctaccctaaagtaccacttcccaccaaagaagaaaatcctgataaaacataacttgggactatatgtagttaacattcaaaccactaatagcctatataaaatagtatttcatgtgtgttttaaaaacacacatttcattaacccctatagaatatctcttaagaactgtatcttcccttcctaagttagtcagcaaacgtattttgagaacctactacgtaccaggcctattagaatgcttgggatcgaaggataaacatagttaggaagtaatattgaagagaggcaaggattactgagatatttattcattcaatcaatatctgaggtcttctgtatgccagacactgctctaggatgctaggaattcagagttggacttaccttcatggagactacatattattggtttagaaatcagggaaaaggagtgtttatgagatttaactaaaacatagttcaggatttgagctgagaaatgaattgtgcctttctcctcccagataaattagttaagtttccttcagcagctaaaaaagaaagagactaatgagtctaccaaatgagtccagggctaacctgagagtcactgaagtactataggacccaatgggaccagtagcagctccaagtggatcacttcatgcaaagaaacataccaaggcaaacaacctggtggaaacttgaacgtagcataatggcatgccaggaaaagtcagcactgttaggttcctgagtagaatcgtatttctaaagtccagtgaggagatttgcaaaaccttatcactgttggactgagagctgggacagagtgacagggagtgattgcaaagcctccctcatgcattgcaggagggcaggggtcaagaggagtgctggctgagagcacagaagaagcggtctttggctcggctggctcattccttcctgaagggcctgtagtgggtggcaatagggacagctagtaagaataaccatctgggtagctttaggcttccagcaggctgtttatcttgagtgtcatcagcctcttcctattggtgacctggaactctctgggatcaagaaacctaaactaattcaggaagcagactcctgccttggaacactgtatttccttgtcttctgggtgtcaaaggaattctttcttttttttttttttttttttcagatctggtatggcctatttgggtggggaaaattagaaattctgctggctaggcagtagctttttccatttttccccctcataccactcctttcaggaagacaaaaataacgcctatttctatcttgttcttgtaggtttgtttcctctggtactattttttcctgttgtactattgggtgagggtggtgggaattatgcatctttaataaagtttctgaggtgagaatgtggtgtctgtggattttcccggggatgctcaggtttgtctggaggcttcatgggtaaaattggctcctatttctctactctctgttctgaactaatgtgtcctttgcagcaggggtgtccagtcttttggcttccctgggccacattggaagaagaattgtcctgggccacacataaaatacactaacactagccatagctgatgggataacaacaacaaaaaaagcttataatgttttaagaaagtttatgaatttttgttgggccacattcaaagccatcctgcatcacaggtggcccacaggctacgggttggacaagcttgatttagaggacagaacatactgtgccagctgttggcattttatatagatagagtcaaagtttttaacctagggttcatggaccttcagtaggttcaatggtagaccataaggcattctagaactatctgaaataatatgcaaaattttgagtgtgtatatgtagcatcacttttttgaggaaggaggacataacgtagattttcaaagggatatataatttaaagtggctttttaaaatctcagctggcttaaattagatatttatcctgatggtttttgccattccatttcaataagaaaacatgctggactcaagtcaaacttgagagtcgaatgagagattttaaattgcaaaatgttactgatgatattttctctaatttgagaaaagtctggaatttctctaactttggcaactctagtttttggtagaaacacatattgaattagaataaaaagtgacagaaatgatagatggatacctgaggaagttttatctgatttcgacactttgaacacattttctttgcaaagttcctgctcaagtatgaagtttgacctgaggctgatgcgtgtgggcggagctttgaaatgccagttgtcatcacaaactacctgggtacaatgctagacagatgtgaaaaatacacactagcaacccaaagataatccaaagataaatgcatgaaagcagtcgtttgaaatgctgcttcgaaaacctccagctcatggctcagtcgcccaatcaagtaaatagaaaatctctttccttcacaggttattaaattgctgcttgattttgctttgatcakgaattcaggggattcagtttgaagaatgagtagcatgaaatttatacccatgaggaatttgcatttctgatgttgtcctaagattgtgggagacattaggagtctggaaagataaaaccaggcctagattttcttttctaattatcattcaataatagatacagacatcatatataggcagaactgaaagtaaagatttgtagagggaatatcactaagtgatactttcataattgatccagttacttcaactgtgcactcaaacagccacgcaacagctcaggagcaaaataactagatatggtcctggtttggtaattcacagcctaagactcaggatctcacaacaacagcaacgacaggtaaactgctttgtcttttgcttatcagctctcctggatgtcagaccttttagtgttaggggagaggacgtccattatcacgtcaaatctccttcatcattcttagtgagaatagggtcttgtaccacttcatatatcagaaaggcctgtggatctggggatatgattgatattcttaaatgtcctgtatgttttccttttggcaatgtgtatatagaatcagaatgatttttccatcagaggaaggaaaaactatgaatcaatagttttgaatgaatgaatgaaattatgaaaaactacaaatgaatgaattgactgtgtgattcaatgagaaaatgtcctttagaaagaagtctgccggaaagtgcaggcttctcctttctgctgatctgattctcacagccagtaataagagaaggaaatgcagatttctctcatcaaagtgtaggccctgaacccttctttggacacttaaaatctcaactgtaaagtgtaggaaatgacctgttgctccatatcagaatctaggcctctaaccagctccctgggtgtgtggctcttagctctatatccctgcaaagtgtattgttacaggagctttggggaaaaacgattcaaggcctgtaaatatgggagattacaaggacaccctcatttattaactttcattgatggagttaatggccatatttcaaaataactaggcattctttctgcagaggggggtaataaacatggaaaaattattctttacatttgtttgccttatatgacattggataaattatattctttacttctataaataatcgtgaggaaaatagtgctcatgttatgttatggttgycatatcacaatgtctaagatcatgcaggggtggggaggggggatacagagattgcagaataaagacaatgctatttttaaatgttgacaatgtttatcttcataggacaaagaatgtgaaggaaaaggtctttttggcagtgtttcatcttcttggttcatttttgggctttcttgatagctgaaaaaaaaatctaactcaccttactattttgtttgggsatgatggtttcagcctctctgcttgaacttgttctcagttttttgtctactgttagctcatattcttccaatgcacatttttgggcattattggttatagaaatggcagtctttggagatttttaaatcaagactcttgcttctggtcttattagcaagatcattggggtcacttcatctctgtctgtctttcctgattgattatcctattttcaaagaatgagactcaaaatgtcctgttctgctttgcaaaatatagtttcacataagaaattaccttgggcaaggttgtgagaggatttggaatctaaatggagaaaagtgtagaggcatatttttcaatcttctacttctatgtcattttycctgtgtgttggattgctaagattatgtatctattgctggcagaaatatcatatcctaaattcttggagaatgatattggttgcccaagattgtatagaagattaaggagctaggactctgaagagctgggttttagaatcataaactctcaggtttggaaaggatgttaaatggtctggttcaatcaacacttctaataatttaatctcttacacaactttcttgccaagtgatcttcctgactatgggaaacataatactttatgaagaagttcattgttggatagttcagattattggttttttaaatccaacatttggaagaacattcctcttcctgaaattttcaccacagatcctaatttggcctcatggatccagaggcaaaaaagtttaatccctcttttacattatatagactttcaaaattcaaagacggctgtcatgcgttcctggagccctcactcttgctaattaggcttctgacttcagacaggtcagaagctctgtccagcaaaatttttaaatctttaatataaggagcatgaaccagatgacatttaagatccttccctctctgacattctataaacttcagtttgagtctctgaaaaaaatggaacttttttgctttttccctttcttttcaccatctatatcaaatatagatgattctcttgagtagtaaaagagtacaagcatattcaatgctatttcttaggaaccgttaattaatctttcaacaatcaattcaatcatgattacaacagctttgatgagcactagtgctacagcaactgagacagcaaccaagaggcaagaaacctgggattggttytcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttgscgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccagtaagaataatcaattacagtacagccatttatgcaaggcttattgattaatctgagtgataccaaattgtatctctcttgagaagtagttaatgtgaaaaatgggtgaacctatgatcataccttagttatatcttgatgagattayrgaagaagaaatagaatgttttgagaagtggggaaaatrtctcacaaaatttctcttgtctcatgttcttcctgttttatttatctatgggatctactgctacagattgtctttgaatgatcaggctttatcagagaatgacattaaaacagtacaaaaaatgtacattgtgtacttactgtgctaggtgctggaaacacgaagatgaaaagagccagagcctttgcttttcagaagctcatggtctgttggagcaatagacttgaagaatgtgatgaggagggtattaattaaaagttgtaggccaggcgtggtggctcacacctgtaatcccagcaccctgggaggccgaggcgggcagatsacgaggtcaggagatcgagaccatcctggctaacacagtgaaaccccatctctactaaaaaatacaaaaaattaaccaggcgtagtggcgggtgcctgtagtcctagctattcgggaggctgaggcaggagaatggtgtgaacccaggaggagatcgcgccactgcactccagcactctaacctgggtgacagagccagactccatctcaaaaaaaaaaaaaaaaagttgtggaagttcctaaattgaaggccctaaaggcttaaatgatgggagctagaactcaagaattatcttagttaatcaaagcccagctgaggtcaaaggaacaaatccagagttttaacaaatgagctggacaccaatatagcagaaagaccttgaagggaagggcaaatgtcaggttagctttagcaagacattgccacttattaaaagcaaataatgaaaccactattggtacataatagtatccaaatttttgacaattataaaactttttgagaacaaagagatggaaattgagctttaaagatatccttaaaaagttaaaaacatgcaaaggttggtctaatattctgccagattactgagttttccacacatacctgtaatgacttaagattttgctgaacagagctgagaatcctgaacctgactccatcacagttctgcttttccttagaaaaaaggcttttggggtgctgtgtgagctctcccaattcactgaagttctatccattccattaaaatctgagaatttcatcctcaaatggacagagaagaaagggtccagaaaaaaaaatagcttaggccttgaaggcatctgagtatataacattgatatgacaaatactcaaaaggaactagaattttctatctaaacttttaagtgattttttttttagacccgacacccctccagagcttaatctatggaataagaaaattccttttggtaacttcagaacaaaaaccaaataatcaaaaacactggagttttacattatactgtctcctgtgttcagcatgtggcccagctttgcagatgggcccatcagtaaatacgtggtcttgatactgaagaaattaaattcccttgggtggtaacccaaacagatctacctgtaaatgaattgtatggtcaggcttcagggaaaaatttcccatggtgttggttttttttttttttttttttttttttaatttkttaaatctctatggcatatttttccaatttctgcttttctttttttttcttttctgcttagcacctatggacataattcaacatgatgccctctttcttctggaggggtgtgataactgcttgataataagcactttttcaggcctattgagaatgtggttaatgattctaaacttgatttttcataacttgtaaaatagagctgacagtattatagttctgaaaacagttttgcgttatttgggtatcaaaataaagtttgaaacaattaggatggatttgcaaataacctttcacaaaacatgttgactcagattttgtcatgatccttctgttaggtgcatctcwtattccagccctaacagattgggtgacaatatcagggtgctggtggatgtacgcctctttctttccagtgtgctgctatgatggtggctggttacctgtggtgtcttattttctttcactggctatgaatggcttgctcatgacatattttgtatttgatgagaataccatagtgtttgataaatattcagaaatgtatcgctaaaacatatggctattckaggtattctttttcagaatcatctataggaaagctctagctgctcaggcattcctttccccactgaaattactaacaacataaagtgattatcatggtataactttcagttatctgcctcttcacccggaggatctacaaacagcacacagtgactaagtccctgggctttcaagtgcagagggatactacagactgcatggatgggcaaaatggcgcctttggttatcctcggtggagggctggtgttttcaaagctgtccttcctactgctgcagcttctttgactgttttatctggaagatctcatgttctgaaccccaaggtattctatgacagaatgcaaaggacactgagatgcttaccaatatggctgaattaagctgaagtcaccctccgctttccctccatttccatgcagccatctatacaacctggtatagatgattcattgcatagcctacagaagcaagactatgtgcgggacaagtggcgaaggctcaagaaataacatttttctaattgcttcaatcatcgttatcacagtttcaaccacaccacgggcttttgaccacacaaaacagaaccaggactggacycagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaayagaatcattaaagattggttgataacaagtcacagtgtatttaaccatcatcacagcagatgtagacagaaatggcaccactgcttatgaaggaaactggaacccagaagcacaccctcccctcattcaccatgagcatcatgargaagaagagaccccacattctacaagcacaagtaagcaagatggcggtcggcagttctgggttagatgaattagtaaagacattccagcaatagggaagattttgtttagaaattggccgcatcttctatttccactcggtaatttcttttattcttagagcctgaaaagctgctaaacccgcacacaaattttaaaaattggaaggaaaatgataactcatcaggttgcccaaaggccaaaatgttttaagaagtagatctagatacaatttttgtgttaaaggttcctagaggttccatttgggtaacttgtgtgtgttcattgaaatgtgtggcaaagagtgtgttcttttggtgcttagtagtggaatctggaaagaaagtttgtcaagtgaattgatctttggaatccttattttctatgaagatctttgatgaatacagtgtcttttttgyattctgtccctgactgttctatagaaagacrtcccttgtactctttagagcaaagttggtagctcttatggtcttcatttgaattctaccactgcttctttttctgtttttaagcccatggtaacttggggaaggctttgatgctcttactgttatttctactattatgaaaactcaggttttcyaaaacaatctcaagttgcggcagtggactgtgagaatagggggccccctcactccccaaacataagaagtatgtgcttttcttcttttatctatcccgctgagatatgtctatcttatttggaataaaagtatttattttggaaaacagctttttagcatttttaaaatgatgacccaactgtcattctcacagccctagatacacctaatggggaaatgtgagccacttaaaagccacttaaaaaccaaagggctttgggaatctatggcttgaggggtgccttcagataacaaaagaaaagtttcaggtatcagttaggatagaggttagacattgtactgaatatatccagcagatcttacatcccattacaaaccccagtaggtgtgttgtatacatacggcttaggggttaagttaacaaagaagtctgataagaaaaggaaatacagaggaagcataaatctctttggaataggattttgttccactcccttagagccctaacagtataccttagaaattattttagacagtttgtacttaaagaccagaaagctactttagagacttggaaataatgagcctattgtcaaaaggtggtgcttgcggggcattaggactagagggttggtgaaaattcagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttctatacagtcacacacatacacttccttatttcttttatttaaactttgagtaacatagcagtctatgtttgggtcagttttcccttttttgtaattacattcagtggtttttgtaacttcattatttattgggaattagtgatttagtcagtgggagttttgtaaaacttaagattttggcttttttccccmtcctcctggataaccagttaacccaataatggcttggccgatggaagggtaaaatgaggacagttatattttttaaatgtcattactgtcaccaaatcacacatatcattttctaagataaggaaatacaaccatttttacaagttgcaaaaaagtactctggcttggcaagtttatagactctcattttcttgataaactaaaaaaaaaaaagaaattgctacaagctgctatagacaaaaatgttggtgtctttctgacttttcctgaagacaccttgatggaattatattctcttgattttgtcctttttaaaatgatggttgaaattttaagcctgtcacacactattatttatataatgcctcaaactggcttggatagttttcgtcaactgaattaattttgttaaaaagtgattttagcaattttaggtgccatgtggacatcaccaaatactgtgttagtggaatagcatccaagccatcccaccatctttcctgctgggcaaatccactgctggtgcatttccagtgtgtgcgattatgggttacatgaccaccatttgagaaggtctcctaatgtgctgatcttgttattagctgttatacagtgttttcctttcgtcaaaatgactggagcaaagaggttattctttgaatggttttctcagacagggtatgtgaagccattcactacagtaaaataaaaataataataactcatagaactatgagaattcatcagctatggtctgcttagtcctatgattttgaacaaatcaaaacttctttggaccacaattttcctagctgaaaaattaaacatttggatcatttgatttctcatatcccttttagaatatcagtggcctgtttccttggtgcctttcttttctaccttccctccccatgtgtatmtgcccttaaagtagaaagatatgttgacagctattggtgaggaaaatagacaattatgtctcccaactgatattcttctcacagtccaggcaactcctagtagtacaayggaagaaacagctacccagaaggaacagtggtttggcaacagatggcatgagggatatcgccaaacmcccaragaagactcccattcgacaacagggacagctggtaatggatrgtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcwtattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgkgtcctccagttcacatgctgattgctaagaagaaaatgagcatgagtgaacccaaagctgctgaaacattctgcgtttatgcaacttccttgscctctatacaaggaagatggtttcattgtcttgtctagagaataaagtcttttttaaaaataaaatcggtgtatccctgaccaagcgtccattaacactttgacaattgctcaaactgcatggtcacagcagcctcagctcatamcagccatccaatgcaaggaaggacaacaccaagcccagaggacagttcctggactgatttcttcaacccaatctcacaccccatgggacgaggtcatcaagcaggaagaaggatgggtaatagcctctgagatttttatatattatgttttttgaaatccactgagtgactgctgactatttttctagaaatatgcccttggttttagaccaaactactttcctgaaggacctgaggttcttcaaaaattagttttcttggtaggagtgatactcatattcacctgaatatgaagttctgagctgaaagtaaggaatttagcaggagggttggcaaaagaaaaaacttattgtcaaaatatatctgtgtgaggcagtaagtaatagatatgaaatgaatgttgccaacaataaacgctaaagaaattctgagaacccctccctgcccaccacagcatcacagaaaggtgaattggacttggtttatgaaaaataaaaaaaccctggatagtcagagaaaggaagtgggtggtgggggttggwggggggggcagttttcctaagaaggagactcctgtaaggagaaacgtgaaggaagaaaagccaaggaatgaatatgtcagtgagtggatccatttttcacaagggaagatgtgtttgaatggctaggcaggggccattatgttgagtgactgaagtaccacaggcagacccagcacacatgagtttgcacatggcagctggagctctgaggacacccatgggggaaaaccaagccaggcaaagatcttcagaatcaatattaattctatgtactgatgaagagaaagagattccattaaattaatgaacatgtcaaggacaatacaattggcttcaactacacaatggtatgatgactcttgaaggactctacttataagagggaagatgaacaagagtctagagcccatcatcaagtgggactttttctgggagaatgtccatttgtggttttgattcaggttagcacttgctcttgtttgaaatctgggataacagggtcaccacatttttgtcctacaaagatctttaatattttagtgttgaatatttagtgttgaatcttgaatatttagtgttgaaaggctgcagtgcagacctgggtacccagtattctggtgcttcactgggactgattaaatctcccccagaggcagtgatgtggatagactttgactgaattgacagccagaaatatcgatggggtttatgaattgtttggcctctgtttcactcaagacttcttatttcagcagagtagatctgtgataactgttaaaaacaacatttacaagtatttcagtgaaatttctgcactactcaacattgtacatgttaaattttaaagaccgcttatacttgggtttttgggaagaataattcaatgacgtccactgcttcttatttcttgcccctgtatactttctgtaactccacctaggtggtcttggatgacgattctgtttatttgcatattcactttgtgaagaaaaaaagactaaaggggggaagagggctatttttaaaagtccctttggttggtaagggggaggggataaaatggtgcctgagccagcacactttgtcttttctccatgtgtcagattgcatgtttctataaaaaaggcaatgtttctgtctctctgcaagatttgggtgttccatcatgcactcatgtggagtccttccagactcagcaaaaacaaacacacagcatagctttcatataactcggcccttcaaggaaagccagttacttgttgtggtgctctttgatgaaacaataatctatctcagttcgggagatatagtcagtatgtgctttctttcctcttggccagatgtgaatatttaaaaaaatcagctgtagaccataagccaccttcaggtagtggtttgggaaatcaagcaataacactaatattgattccttcagatatggactccagtcatagtayaacgcttcagcctactgcaaatccaaacacaggtttggtggaagatttggacaggacaggacctctttcaatgacaacgcgtaagaataacgatgctcagccactttattgacttgtattcctgcttcatctcttactcgctattggccaagatgcagagctttggtggtggaatggtgctatgtggcttacttcagcccagagtgtgaaactgtcttcattgtctgtatttcttgtggaggtctctcaacctgattttcccttcatttctttgtgccttccagatttaatgactttgtgttttaagaaaaagtaggactctattcaactccattttcattctctaagtagttatgtcagtgaaacacatgcccacttccaggatagtgatttctctatgttttaactgaccatttcctttcaatgtccatctttcctccagccagtgcagaagaggggtaggattgcttgcatggttgtaaaaagacatttttggggccagataatcctagagatcacatcagttctcagaggagaggcaaggcatgttattgacaatcaacaaaggtggcgggatccctggaacaacaacaacaacaaaacattgctagtatctctttctatcactaagaaatgttcaaattctagtagccttaatttctactctatgtgcagggatgtcctagagatcagcctaaagtcgttcataatttctttgaggaatacaaaagaaatctagaattaagaaggtcccattttactgcttgccacacataatgggcagagtccttcatatgagccctttaggcaaaggaaaaaaatcagcaagcatgtattgatggtcagcaatgtaaatagcacagcgttaagcatcaaaggagatgcaaataagcctatgaatggtccttgccaaagaaggacttatatttccrttttatgtcactgttggcttttgttctgacattgggtttgggatttagtgactgtctttctcctggttgtaatatttattcggtggtgggcatggcttatgggtgtgctttatgaagtttttgcacctgcaactcaggtcagtacctttcttaaaagaacacaaaagaaataaacttgaaacagtccaagtgattttagatatgggcaatgggtcaacctccagttgatatatgtcactgagggccctgtgtttgcccaggcaagcgtttccttggtgcagtgatgaaaatcccaatgcacaggtgaaattaaraaataacttaataatggagtaaaatggtaactttaatttaatgaccttyacaaggtagctaagtatttccttgtataaatttgatctgtgttacttgagtaggctattctagataggcttctttttcttttgtggttacaactagactacaggctatcatagtgttcattttccctgccgtcacatttcttgacacacagttaggtgcttttggttactgataggagcattgggattcaaatattcttttttccatgtctctgtgttctctggttttctggagtgactgggagcaatgctgcaattgagcctggacaatccaggataggcaaagttttggctcagtcttcaccttgccactttacctttgatgattatactgagaaataaagggtcttcagaaccaaataggggcaaaatagaattcttctgtatatttctatcaatcagaggagaattgtgtgcacaaaccttggtcttcctatgcacctatccatctgactctactctagctagattttccttgctagcagataacaggatttgtaccgtagcttcaaattaacactggattcattcctcattgaaacagagcagagtaattctcagagcttctctacatcacatgaaggcttggaagaagataaagaccatccaacaacttctactctgacatcaagcagtaaggattataaaacctagttggcytcagctattgataagaatcaatcaattatgggtacttttgcagtgtctttggtggaggtgcatccattagctgccgttacactgttacttttaatcaaaaggtgcgtctggtggtggttctctgatttttctgttttatatacctcttcgtacattaagtgcaaactacatttcttcatcttaaaagttgggtttctttcactctagagttagtgatttgttttaacaataatggattgcttatatatgatttattttatttatttatttttgttaacttgagatctttctaacttttttatgtgggcgtttaaatttagtgctataaatttccctcttactactgccttagctgtgtcccagagattctgatatgttgtatctttgttcttattagtttcaaagaacttcttgatttctgcattaatttcattatttacccagaagtcattcaggagcaggttatttaatttccatgtaattgtatggttttgagtgagtttcttagtcttgatttcaaatttgattgcgctgtggtccaatagactgtttgctatgatttcagttcttttgcagtgtgatttataattggcgtaaatgtctgattatatcactttacattcctcacaataatattgttttgccttttgtcctctggacctccatggtgctgatgactaaaaagcagtcccttctggaaaagaaaagaataattaaattagtagcctcaggcctttgaaaccatgcatttgctattttaattgcaggcagcaaaattttatctttcaatccaatgatatgtttcctccactacatcaaagatgaatccaattgagaaagaactcaagattatctagtacctcagctgacttcaagatcacagttgtagtgacatagccttacctaataacccaagcagatgttgcaacaaatgccaattctgggtattaagatcaccaaaatctcttctgttgagtgatgtccaagtagtgtctattgcaaaatatttattctgttcaatagtatgacaaacttcactctatttctccctatttatggataacaagtggaaagcttttgcagcaattgtgtgttctggagacaagcacatggtgggtggtgatcttacaaatacgrgttcatcactgattccacctccacacagataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggtaatttggcatttattatctagtttgctttctctatatagagaaacaatatatagtttcatattacagaggacattttctgtgtagtctgggattggactagtttgtgatatggaaatatctttcattattggttatcaattctagtgcaaataaacttgggtatattttagataaaagaatgcttccttttgccagtgttttttccatttgtctgtgtttgcatgtgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaagtagtcgaattttagcaattccgtttaattcgactaatatactctacttattttgtaaggttttatcctacaggtgaataatttctatatactagtatctttgctctgaaattattatcttgttttggtaatagattgatcagttttacttttggtgatggataaacctcttctagttctgatgcacacttaaaatgttcatgatttaatctagtattaatgaatagggaccacttctcttattgtaatagtgaagagaggaacgaagataatttattcaatgaagtttgacacggacctagaataagtctttttttttctcaaataagtagtcatctctgcttctgcttttctttgcttctccatttgtattaagaaattaacagtgaagaaaggggaaatggaaaacgcccactgtagtgaagaaataaaaaacagattctgtcttcctagtactagtttttcaattgctttgtaacacaatcactaggcatattcaagattagagactttagatacataattttggagcagagatcttctctcctccccccaaaaaagaaaaagaagaattcatatgtgtgcatatatatataatttttttttttgagacggagtttcactcttgttgcccaggctggagtccaatggtgcgatcttggctcacctcaacctccgcctcctgagttcaagcaattctcctgcctcagcctccatgagaatccaatatgtaaaacagatgacggttgtgatgcagggacagaaaattcagaatgccacatgcttggcctcatttctctgggtggcctacccaagagcttcaagaaaaacagtttaagaaaatgctaacttcagcaatattggcaagacaaagccccttacactccttagttctttattcagcattgttctgctctcatttattaaaaattccaagtaccattgtcagtattcttcagaaaatcttatagtgctgtctcatttctcttggcaaaagaaagcctgttgtgcaacccaatgaatttaattttttttttttaaagagtcttgccctgtcacccacactgtagtacagtggcgcgatctcggctcactgcaacctctgcctcccgggttcaagcgattctcttgcctcagcctcctgagtagctgggattacagatgtgtgccaccacgcccggctaatttttttatttttagtagaaatggggtttcaccatgttggccaggctggtctcgaactcctgacctcaagtgatccaccagcctcagcctcccaaagtgctaggattacagacgtgagccaccacgcccagccatgaatttaaagtttaaatggcaattttaatagtcacagtaccctagaatgcttatagcctaatgttagtaaatcaaatgctttttacaagactgatattcacagacactgattctttctgatttccacagtggtacggacagattttccataattctccatggattagacaattaagtcacccaattctcatccttggttttcttcaaaaacactcacccacataaatctcatttatgtctatacatttttctcagtctttacgcttaatgttaagaactaaagcatttgttgaagcaagcggatcacttgaggtcaggagtctgagaccagcctggccaacatggcgaaacctcgtctctactaaaaatacaaaatattagccaggcatggtggcaggtgcctgtagtctcacctactcaggagactaaggcatgaaaatcacttgaacccaggaattggaggttgcagtgagccgagatcgtgccactgcactccagcctgggcgacagaacgaggctccgtcccccaaaaaagaactgaagcatttagaatcatagtggcagtggtggtggtggtgatggtgatggtgatggtgataatgatggtgatgggatggtgacggtcatggtgattttggtagtgggagtattggtgtggcatttcagcaaatgttgttttcatttgttttaaccatcagccaaggaacaaagcaatctgtctcttcaatatagttacacaggtgactaagtgtcacccgcttccaccttctctaatcaaggaaatggtgacgatcaggttactatagattccttataaggtgccttcataatggataactgtagccattttatgtaagcattgtcctgtgattaaaaaaaaaaaaagattccagtatgcttttgaaaaatgtgggtgggggagagagttttaatatgctgcattcaagatttgacctatggatttagattctagcaattcatgaggttgtcttaatctaaagctttctggtgatagatgtttgagaagctaggattatattaactagtcatgttgaaactacagatttaactttaaaaaattattttaaacttactataatacccatattccaatacacattattaatgttagctatcatctcaccatttccttttttacttattttcaattttttttgaaaataagtagttgacctttctctttgaatctttacatcattcaatcccaagattccttattgcatactaatttcctgccgccaagaaatctctgtttcatgccctaagccagagtatgcccatttgcagtgattatgtttctcataatccaattcatattgtccttatttaaaatgtacaatgtctagtctcaacctcatacctgcaaagatatcacaatatttttgttagcatgttccttaccacagttcttggatttctaccaaaacaaagyttctacaaaacttcctgtggtcatccttcttagcctttgctgccccagtttccttaattcttattaaagttctagctcatttatcagtggattaagcratgaacggtaattaacattgtggacccattcaaggctgttttgccatcattttttggaataccttaaaaagactaaactttgtgataggctgtataagaatgcaaaggtaaagaaatgcagatgggagtgtaagtgaaaacatgcagtactgaccttcctgattgctcattacaggagaccaagacacattccaccccagtggggggtcccataccactcatggatctgaatcagatggtgagttcaaaactgctttagtcatttactgttataatcattgagcctaatgatgactaccaacgaagtatgagtcagtgtctccagagaagtggttctcaaaccttcttagcatacatcacaattgcagggagggcttattaaaccacaatgctggaccccacccttaaggttcctgattcagtaggtctggggtggagcccaagcatttgcatttctaatcagttccctggtaatactgacactgctgggacagggattgcactttgagagctactgctctggaggaaagccttgcatctgaaagcctcaggaagaattcaagcagtgtcccaatttaacmttgcactacaccagagtgattaagagcttgagctttgtagcaaaaatggcctgagttcgattccagccctccgcatattaactgagcaagatgctttaaagggtctgagacaacatttctcaactaataaacttggaataataacaattgtcacaggacattgtttcaaagactaaatgatagaatacatgtaaagcatttagcataatcctggcacatgatatcatcactggtatttgttgggaatttactgtgtgccagcagcatctttctaaacactttacatgtattaggttgggccaaatggaactgccattattgtaggtcaagaacaggtcaatatcggccaggcacggtggctcacacctgtaatcccagcactttaggaggccgaggcaggtggatcacgaggtcaggagttcgagaccagcctggccaaccctgtctctactaaaaatacaaaaattagccgggcgtggtcctgcgcacctgtaatcccagctactcaggaggctgaggcaggagaattgctcggacctggcaggcagagtttgcagtgagccaagattgcaccactgcactccagcctgggtgacagagcaagactctgtctcaaaaaaaaccaaaaaacaaaaaacaaaaaaacaggttaatatcagcaaattcatagagtttatctagtatgaactcattcagtcatcctataaactctgtgacataggtaagtactattattatccccatgttacagatgaggaaactaaggctcagagaaggtaagtaacttggcagagttgacaggaccagagagtgatggagccacctttcaagcctggagggccttgtattacttctcatagcacagtctggagaaggcattccataatgaccataattactcccaggcatgaattcttaaatagactcctgtttgttgtgattcagatcacacccctacaaaccttaccccagactgcaaaagtctgacatgaggtaggtttactaattacttctactgctgggctactgggaggttctgccagtgctgccttactgtggtctccctgaacatcataaatccaggtgaccccatgtaaatgatttaagccatatcaattattgtctcccctttttatgcccaagtttgagtgaggctcaccatcagatttaaatgtttacacattgaaaacaaatatgaagatggatatttacatggtggyttccacaataactctctatggaggagcactaggaggtagggattcattagaaatgcttctgaaatagagacagaagtcacaggttcactggggactttaggcagggcacttaacctttcccagactcagtttccttgttagtaaaaaggagatcaaatcatctgcctcagttgcttcctagagttattgtgaggaagacagggtaccagaagtgtgaaagtactctgaaaaagtagggagttattattaaggggcatgatctctaaaaccaagagaccccagccactctctaagtatgattctttaaccatcagagtggacatcacctaggaacttgttggaaatgcagaatccttggccaacccagacctactgaatcaggatctgcattttaactacactctcccacccaggtggtttatatgcacattaaartttggaagcttagactgtgctagactgcttttctcaccattgaagccaattgaacaatctctgtgcatatgtctcagattacatgtcatctcccaacaggaatatcaagtgctcctctytgtggaacttgctactgtggccagtcctaccctggctggatttgtagacatctagggcacaaggcaagacctgctatctcacatccatcttctgtggcttttgcttgaagtgagaatcaagcagacaggagccagtctcttttgtttggcttctgagcaggtgtctattgttcaaacaggaggtttcatcttgctgcacgcacacccagatcttttcttgctgggagcacttcttctttttttttttttttaaatcaaaataaagtgattatgatccgttaatggcctctttttaaatatcaaaggcttctatgagtcagaaaagaaaaaaaaaaaaaagaacagtgagagtgactgtacctcctggggagttttcacggccaaagatcttcagtttaggtggccagtgtcccatgagttgggcaggtgaaaacctgccaaccaccaaggacactggaaggcatgtagggaaagggccttggactgttttggagatttgtaaagtcaaaggccactgtcaacataggataggggatgttgaaacacccagatgtctggtaggaactkgttttgctcccttttaagttttaacaaaagcatcaaattgcataaacaagagccatcctgtccccatataaccattgtaatcaagatttcagtgtgcacagcctaaagtttggctccatgaggaaagctctcatttaagaccccaccattttcatccattgatcagccttcaggattctacagtgggcttccatttggtaggaaaaaaaaagttcattttggtggaacactttcaaattttgttttgaagcaatggaggaagaatttttaaaaattcatgaagctttcattttgatgaggctcttcacaagatgtcttagaagtttcttttttaaaaaaattgtttatttatttattatttttatttttaacagggacaggatctccctatgtttcccaggctggtctcaaagtcctggactcaagagatcctcctgtctcagcctcccaaagtgctgggattacaggtgtgagccaccatgcccggcttcttagaagtttcttttagaaccattgtgtctccctcatttcgataggcctccagttctgacttgaggattgtctgtcttgcgatacttcctcccagtttaaggcattttgttcatctccttattttgctttttagcagtagaaaatgttgattcttctaacaaggtgtgtttcagtaatatattagcagggactctaatagggtgatttttcatagtcagaaagggccactgccgctaaactccttatttatttattgtgaggtggagtctcgctctgttgccaagctgtaatgcagaggcacaatctcagctcactgcaacctctgcttcctgggttcaagcaattctcctgcctcagcctcccgagtagctgggactacaggcacatgccactatgcctggctaatttttgtatttttagtagagacggggtttcaccatgttgactaggttgatctcaatctcttgaccttgtgatccgcctgcttcagcctcccaaagtactgggattacaggcgtgagcaaactccttattttatagtgtttatgttggctcctatgatgctattggatgagattttcaggttccctttgggctttctggagcgtgtgagtcccctgggggtcttgttaaaatgaagattctgatttggtagctttgagatgaggcataagattctgcatttctagcgatctccccaggtatgcctgtcctgatggtctgagagccacactttgagtagcaaggtcctaaattaaaaatagaaaataacaaccacacacaactaccaataccgtgtatttcttcaaatctctgcaaaattatgatgaacagcattctgttatccccatcttacgagtgtgaaaagggagacttggagaaggtagattgacccagcacacatggctagttagcaagggacagcggtgagacttaaatccagggttgtccagctctagacaccaaagtcctgaacactgtgcaacactgctgctgagaattctcatgttccttgacacaaaataacattactaagccttagccttaatcaaatgaggtgggggggaaatcttttgtgtaatgctttataaacatctgcagcttgaatccataaatggcttctcagtgattcagaatgtggagagctgcccwttatgcagctccacaaggaactcatggttacacatttcaaactttggttgagagatgttgtttttccccttaggacactcacatgggagtcaagaaggtggagcaaacacaacctctggtcctataaggacaccccaaattccaggtgagtttcaaactttgaggcagaaaaacacactgaaagcagctttctcagaatgtcccagcaaggacgaagagactcatttgaaagcacattctccacaatgcccaacatatgaatccaattgctcctctttacaagttaaaggatgaatgagaatactacaccctcttggtaggaaaagatggaatagtcttttcttcctgggttctgcamactagctgagctcatactcagatctgtccctggcctgtcccagagaagtgccatgttagttactaaagcttccttcctaaaygaatgatcaccaagaggaccccatgtcatacctaggtcctttctatcccaatccaatttccacttatttctggggtccaaggtgaagcatgtaattttccttttacgattacagacagggaggagctacaagaggcatttatgttagatggagtgaaaactttcttttggttccccaactaatttttttttggtcgagggaccgcctgctgatgtggacagaataaacttttcagaaagtatgcatgtgcagtgargaggctgggacacctggttctcctgagcatcaagacaaggcatttgttgcaaattctttatttgacttggaattaaaattgatttgtcatagagaattactaaagggaagggttctcctaaggttgtaaattacccttttaattctctcctcttcagaggtctccagactgagcctctcttggggaaagagaagaatgtggcatgcaccgttctcctttgccccagcttgcctaagcacacctgaagacagaccagacagagacaggggtgggctgtcccaagggagagcacaggggaagccttagctgtcatcaggcagcaagattcttcccagctccagtgacagtgcaggtgggatatctcagggctggaaaccagggccacagtgggcaggagtagaaaggaagaacagaaatcgggccctcctgtcagtcycccccacttctgactctacctccctctccaaactcatctaaaccaggaaaaggtgaggcaaaggtagtgctgagcaggaaatcagagataaaccaaaatttccaagaagaaaacagataatgagactttccatgcctcttctttctcaagccctggttcattgcacacatatacaacccactttgcaactgaatttagtggagttgtcaagtcatattttagtcctaaaagagcctgatttcaaaatgtgtagaatattaatccacaagtgatatataattattgaaaacatttgaaaaaatacaactaaataaaataatggaaatataaatcaattattatcaatctcaccatccagaaatamcatggttaccattttaatatacgtcttttttttttttttttttttgagatggagttttgctttgttgcccaggctggagtgcagtggcrcgacctcggcccactgcaacctctgcttcctgagttcaagcgattctyctgcctcagcctcctgagtagctgagattacagcatgccaccatgcccagctaatttttgtagttttagagatgggrtttcaccatgttggtcaggctggtctcaaactcctgacctcrtgattcacccacttcagcctcctaaagtgctgggattacaggcgtgagccaccgcacccggcctttcctgtcattttaaaatgtaaaatatataccaaaatgtgattacaccttacayggtgtttagcaaacattgcctactggttaaccatggcttccatgtcattgaatatttcctcctcatattgtagtgcgtaatgcaatagatgtaccctaatttatttaaccaatcctttattgcctccatttttgttttttaatacaatgtaaggtggataggtggatgctcttatacaggaaaaaaatgttcctttcaaaagaagcctacatttccttttatatgtttaataatattataccaaagrcatctacaagattcaacaagtcatcctgtccttttttagaaacatagttctcctgaagggacttgaaaatcctgactgatgataaaagattaaagcaagaaggctgttggacaaataccttcagcaaattgctcttccagaattacctgcctattggctggacctattggccagacccccctgcagcgctgactgtggtgcttgtttcaactaggtcaattataaagtgcatttttgtttttacaaagtgtgtctctgaagctcacgcatgtcatttaatttactcataccagaatggctgatcatcttggcatccctcttggccttggctttgattcttgcagtttgcattgcagtcaacagtcgaagaaggtaaggggctgtcctgggggctttcaacttggaaagggcatcatttaaacctgggctttatatccttgctgctcagagcgtagtccctggaaccagcagcctgggtaccctgggagtttgttggaaatgcacaatctcagacccaaccccagaystcctatggcagagtctgcatcttaacaagtttccagggattcatgtgcatggtgcagcttaagacatctttctctgccccggtttttagagacaggagacacctgtgattgtttggctcatcacttttaggtagtggttgaatcctttgtgattttacatgttttttagggttaaacctcatgcagactctgtctgatgaaagttatgaagtatctcaccaggaaggcacacaaaagtatatactcattcattgatttgttaaatatttattaaatacattcacaatgcacaaatatcgtataaagattcagtgattcatcatcccctgtagcctctctgaggcccagggaacctttaagaacttttaccagaaggaagtattggccttgtgcttttgtttgtcgtttgtttttttattggccttgtgcttttgtttgttgtttggtttttgtaatgatatcattttctattttctgggaactgtagttgaagagattcaggttatagcataagaagagcactgtttcatcgtcttcttgctgttaggaggtctatgaagcagagaagaactttcctttggaaaacaactaaatgaagacagtcacctcsctagaactgacacrtgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagayctagagagaattatggactccttactggtttttggaaagcaaccaacagctaattccaacaccatgggcagcccatacagtctctaattatctgagaaaatcaaatgatgctgttayaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttgctcaattaaatatgaatttcctattgtgtgcaatcagccctttattgccaagccctagaatgcaccacttttgctcacatacacagtccataagctttgcacatgtcaccatagaaacgctggcatggatgctgtcgacatttagggagacctcggagaagcatctcagctgtccctaagagcagctggagtccatacattggggctgggtatctcccccatcgtctgtgtcttgtcagcagcagacagcagagaaggggcctcattgctgccctctccctcctcccaagaccagcagtcaccctggcaaccggcaaacagggacacacagggtccggcacagcgagtatctcaccaggaaagtagctgcttggatgccataaattactatgtcctgatttgataattgaaaacagatttgccacgcagctaaaaggtggtgaacagctgtacgggccccttaatgggctctgtgattctaaagctgtcaacccatttctaatccccttcaaaggctgaggcttttctgctttgagtgtcacatttaagagaaagagatacagaatcctattttcatcagagaaagtttggttgaaaatggggcctccaataggtgttcatttattcagcaaacatcttttgagtggctcctgtgactaccagccctggcaaggagaaagagaaggtaaaaaacaaaaagagtaccaccccttttctaaaagaatcttgaggtttagtggcagtattggcctcttgaatttgaattggctaatatttattgagaacattccctgtgccagacactgttatataaattatggttaaaagacaaaagtggaaaatcattagtctctgaagttgacatacaaggatgggtcatgggcttgcatgatgaagtgatctgtgagtcacgttgtcttaaagatgctgggttgggggttctattacttctttaggtttttccacccctgccatcatccaaaacagctttctttgctgttcctcatgtcacctgactccttgagttacagctctccaagagaaatcatattttattcccttttcatgagagcacataattattttaggagtcagttgggttgatagatactgcgtgaggctccagagaagattttcctttaaagaatctatctgggccaggtgcagtggctcactccatgtgcagtggctcactttgggaggccgaggcagtggattagttgakcctaggagttcaagaccagcctgggcaacatggcgaaaccccatctctacaaaaaacacaaaaattagccgggcatagtggcgcatgcctgtggtctcagctgctcgggaggttgaggtagaagaatcgcttgagccccgggaggtggaggcagcagtgagccatgatagtgccactacagcctgggcaacagagtgagaccctgtctcaaacaaacaagcaaacaaacaaacaaacaaaaacctatcttatttgtctaaagaggagaaaaaaacatgagaactttactatgttgcttgtacataaaagctgttcatcagccttcactttaatgggaataatcgtcttttctataaaccccagcaggcagtcacccacactccaatcagtaggtcttctctacgcatcgccataatttagaaatattttccttctcttatgctacagtctagctcctgcaatctgagctcacccaacctcgtcctgctgtctagaacagtgctatgcaatagaactttctgtgatgatggaaatattctatacctccactgtccaatatataactactagccacaactgagcacttgaactatggctagttcaactgaggaagtgaatttttaatttcatttcattgtaattagtttaaattcaaatagccaaatgtggctggtggctaccatattggatggcacagctctaaaacagtgcaaaataaatccctaaatatcgttaaggattgtcaggtagaagagtcatgagatcagttgccaagttacccacctaaatcttttragataaattctgccatgccataaaagtatgttacctggcttctaaaccccagccagcctgccctctctttcctggtgaggtctcagtctgcctccttccacactgtgtgattgctgtgtgctcagctaatgcctgagatttaagggaagaggagataaaggtaagacacagatccatgaggatctctgatcttcagagtcagaagatccaagctgtggctgggcgcgggggytcacacctgtaatcccagcactttgggaggctgaggcaggcagatcatttgaggtcaggagtttgagaccagcgtggccaacatggagaaaccctacctctactaaaaacacaaaaattagccaggtgtggtggcgggtgcctgtaatcccagctacttgggtggctgaggcaggagaatttcttgaacccaggaggcagaggttgcagtgagccgagatagtgccattgcaccccagcctggttgatgaagtgagactttgtaaaaaacaaaacaaaacaaacaaacaaacaaacaaacaaaaacagaaaatccaagctgtgattcttgcagtgcagtgccataacaagctgtgaaactttggacaatacttcttggacttggtgtccagtttacataatgaagaagctgggctagatgatctctgaagccccttaaggtctagtgctccttcttaaattcttataactaggaataacttaaaaattagaatttgtctcttaaaagcacttattagaygcctagagcactgaatattggaatgagttatttatgagaatcatcctaccctcctgaaactactcagacagatagaaacacataaatccaaagggaaatgcaggccaaccaaaaaccaagcacaatattcctgtgtcctataggtcaaatgttatccactgtcaagatcagcttcgtttagattaacaacattaatccccacccactcccatgcacagacatattttttatgctcataaatcactttcccacaatatttcattccatccctcaaccacccattggttagggaaatgggaattactttaactagacaactttcctccaaagaacacaggggccagggaattggaagtaacacaagcagtattctaccttgagccttttaaatcctcttcatagtaaataataacgaggtaggtggaggcagccaggagaaacaagcaaaattcatttcatatggcttttgttatattaacaattatagatagcacttgaaagcttactgtgctccagatactgttctaagtgttaacccaaaccttagtttccttaccccgcataagagcaagaataacaattatttccttacccctcataagagcaagaataataacaatagactcatttatttagtgacagtctctgtttcaagggcttttcacaatcctatgatattgctactcttagtaacctggtattattgatgcaaaactgaggctcagagaggttaagtgagttgccccaggtcacatagcagtaagttctcaaaaccaggccttccgagccccttttcttctttcttttttccttttttttttttttttttttttgagacggagtcttactgtgtcacccaggctggagtgcggtgatgcaatctcagcttactgcaacctccacctcccaggttcaagcaattctcctgcttcagtctcctgagtagttgggattcagccacgcaccaccatgcccccatgaccggctaatttttgtatttttggtagagatggggtttcaccatgttggccagctggtctcgaactcctgacctcaagtgatccttctgcctcagcctcccaagtgttgggattacaggcatgagccattgtgcctggtctctttttcttttttgaaacagggtctcactctgtcacccaggctggaatgcagtggcacaaacacagctcactgcagcctcgacttcctgggctcaagtaattctcccacctcagcccccaaagtaactaagactacaggcacatgccaccacagccggcttatctttgtattttgaatacagactgggttttaccatgttgcccaggctggtcacaatctcctgggctcaagtgatccacccgccttggcctcccaaagtgctgggattacaggagtgaaccactgcacctggcctccaaggcccttttcttgaccatgcatcctgctggactccatctgtattcctggtccccatgaatctgtttcacagttcaagcatccttcccccaacccctcatcaagccttatgctagaggagacaggatctacctcctgttgaggaggtataatttttatttccccaaacaagagcttaaagtttatggccttggcagtcctacagggaatggtccatgatcatgaataatagaggctttgtcactattactccaaatatccagaggcaaagtgaacaattctgacttcatactgtttccaaatctccagagggctggcagcattgacagagccaggcagagcccaggctttggtcataaaggcctggatttgaatattggctctgtcattcttactttctgtgtgacctcgagcaagttattaaacctcttttggcctcagtttccattgctgtattatgggaacaatagctgctttgaaagagtgttgtaagaattacagaaaattacatgtaaaatgtctggtattcaggaggtaatctgcttccctgaatccccatcttgcttgtagttgtgaagctatgcaactttccttcctctaagcatagtctgactcgtatatgtgtagtagtgatrtgttacaggaaagaggaagcattgcattaggctgggtggggtgaagcaatggacagtaaccagggaaaagatcaaggtcgtactcttccatagcaactttcttttgcgtttgggtcttaagtaatgtttgagaaaccttaaattaacragaataatttgtcttatgttattaaacttcctatatcagggttgtatgagttagccaatgttaggaaaacatcactatggccttatacctctagaaaaatgttgttttattcttctcgatacattcagtaataatgctgacaaggccgacaaagtgttgactgggagaggaagttatgggactttctggaatatacaaatcagaatgatttacaatcatcatgttgatggtttatctaaatctgcagaaactgctaaaatgcttaaaagaggcaaacatttccattgtgaagtaagatagaaagagaatcagaacttgagagtcagacagaccagggtttgaatcctctttcttacttgctgagttacttgggggaagttactgaattttctgatccccaaggtttcttcacttggaatatagagaatataataataacaccggcttcctggagtcttagttgctggtttgcaaacttgactgtgcagagaagcccctgaggggttgcaaatttgactgtgcagagaagccacagatcctgggctccaactctagagttttctgattcagcaggtttggggtggggctgagaatttgtatttctaacaggttccaagatgatgcttttgctgctggtccagggacctcactttgaggagtgctggttgttatgagtctggttgttaagtgctggttgttwgttgttaaagtagagaaaacccctagcacagtgcttggcacacactaaagccatcataaaccatagtgatcatcaatgatggtgctcagtaaggatgatgatctgatgcctgagtcactgcaatctttctgatatggtacattttttaaattattaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactyttttygttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgytttccactgaggttgggggttggggtgtactagttacayatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctrtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacaygtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaagtctctaatttaaaagaatgggaggctgagagggacagaactatgcttatctggcaccgtctgggtaatttagaggaacaaagtcaaaggtatctgaggtggctgaagcctcacactcattttatttttaaaaaaagcaaaaacaaaatgggtttccatcaacttgaaagtcttcttttggagaaaatctggttttctatgagtgatgtgtggttcacatgtttcaaactaagtgagatacagtgaagtgttagttcttttaaagccaagaactactcctggacttccagttaaagagaggagagtgtacataccttcattccctcatgtaagcctctaaaaagaaaataaagagatatttccagacggaatcaaccagtggagttaaagagattggaagaagagacaagagcaacaaaaacttgaagctgaaaagtgatagctgattggtaactgaatgaacaagtctggaaaagctgactcctaagcctgcagtgtggaaaattgagaaacaaccagacttatgtgacagaaccatcaaaaggctcaatagctattctggaaatgaatgggaagatgaggctaagattagggggacaagcttaaagtctatgtaagaagcagttagaactccaggtccccttccttactctgtgtaactgaacaccgtcctttcccaatctcagcaaaagaccagaagtttattttctggagacagggaaatagagagtctctggttgaagtccaacagcacgtacacagttgacattagaaataccacactgagagccgggcatggtgatgcatgcctgtaatcctagcactttgggaggttgaggagggcggattgcttgagctcaggagcttagagaatagcctgggcaacatggcaaacccttgtctctataaaaaatataaaaattagccaggtatggtggtgtgtacctgtggtcccagctactcgggaggctgagttgggaggatcatgtttgagcctgggaggtcaaagctgcagtgagttgagattgctccactgcgcagcagcctgggtgaagagtgagaccctgaaaaagaaaagaaagataagaaaagaaaagaaacaagaaaagaaaagaaacaaaaaaagaaaagaaaggccatactgaaaaagtgaaaccatgcttaaagagtgttgagattccctatcctcctctcccagcttggctctcagaatgctgggagctaggcatatgttctccaggcagaagctcagtgttgctggggaatcttatgagcctgagagaaaattctaaaaatattaacatggtagttccccaaggaaatggcccaaaaaaagcgatctgcaatgaagatggcatctcaagccccaccaggcacccagaaagctcagtcagctttctgtagcttactctcacacatgagctgttaccaaggagcaccagacatttggagaaagcatctaatattaaagtcagggactacaaaaaacaggaaaaagtaccttgacagaaaagaaactgcttagagaaggaaactttttctaataaaggtcaccaatactctcagtaagataagaggagatggtatatctataaaacaaaaacacaatgccaggataaaaaggaacatatagagaacacctaaaaaagaagctttaaaaatgtaaacttgagagcacaaatttaaaaataaacctcacagaaggtttgcaagataaagttaaagaaataccctcagaaatacagcaaaagcaaataaatggaaacaggggggaatacattgggaagactggcacccagtccaggaaatttaacatgcaaatgctgtaatcaaagtcacaggaagagaaaacaaataggaagaactcatccaagaaaaaaatcaagaaaacttcccagaactttaaaacatgaatatcttgactaaggacaaggtgagtacttagtaaaatgaataaaaacagacccacactaatgcatattatcttaaaaattcatgacacctggggcaaagaaatgatcctatgaacatctagaaaggaaaaatacatacatggaggatcaacaatcagaatagaatcagatttctcaatggccacattggaagatagaagaccatgaaacagggcctcaaaatactgaaagaattatttccaagctagaattctaacttagttaagctgcaaattaagtataaggatggaataaagagattttaggtaatcatagtctccaaacctgctcacccattcacaggcaactcccaaaggatgtactccatcaaaacaagggagttaccaagagaggagaggacatgagtttcagaaaacaaagtagagggagttcttaaaatgatgataaagggagatcccaagatgacagctgtacagcaggtctagagaacacttaaagttggagtactgactaataattaaaacaatcaatgttttgcttttattgacctctaattaaaaagaaaattattttttgttgtattcattaactactgatgcattaaaaactgttccaaaattagtcgcttaaaataacaagcatgtatttatttcttatgcatccaccagttaactgagtacttctgctgatcttggcagggctcacttgagcatgacgggactcatgcatttgtgtgtgtgattaacaaacaggtcagctagaagctgtctgatttcggacagcttcatctgggatgattggggtctttttccatctgactcttccatgcctccagctggctggtccaggcctgacagggttccaagtaagagcacatgctcacaggtcctcttgaggcctaggctcagaactggtgctctgtcattccaccatattctattgaccaatcaagttacgagagcagcccagattttaaaagaagggaaatagattctatctcctaatgggagaagctgcaaagtcacactgcaaaaaatatggttacaaaaaagccaattatcagggccattagtgtgatcaagatctacgatagacatgttgaaagattcttgtgctcaagggcacctctcatgtttatgcttaaaatacactcaccatttgagccatattggcaatggcattaacttagaaaaccatgaacaactttataaaccccatgcttattggaaaaggaaggagcaaagtcatgtgtaaatgtgtttgggagattgcttggtatggtagaaacagcatgagctttgggatcagacaaattttgggttttaatactgattctaccacttacttaactgtgaaactctgttcacacatcttaaatattttgagtcagtaaagagacagtaaaaccttcatagggtggctatgaggattaaatttaacaagtacrtgtcagtgctggggtatattaggtcctcaaaaatattaattcctacctgccatcacccacatatgcacagtaggtacttaacttcttccttcaccatttcctccaatgttctgaactctaaccaacttttaagtgtgaattgctattaacttacagtggctggagacagattatttcagaatctgaagctccccatgaagaaagcccttcaattttagttgaaaggtttttgctttcaaagcaaggctaacaagcagggagtccaggaagcwaataactggcattcgttgattaaatcttggccatctaggttgtggctgtaggttaaccaaagttgggcatccacccaaggctttgatcgtcacctccaggaagttgtcttgccccacccctatccaggatgagctcattttcccctctgtgggtataactcttaccttgtccatatgtcattgtagttcttactttgcaatttcattaatccgcccatgaacctgtctgttctactatatgatgaggtgtgagggtacggagaaattcattatggtcccccaaaccaggtaagtagaaagtggtagaaccagggatagagctcagctctctccaaagtctctggcttaacatgcctgaattgtctattgtcagaagtttggtaaactgaatttgctgaagttaagacatcatctccaaatgttgcaaaccaggtcagtattccagagctccctgtgcctggtggagccaaaggaggctttcagaaaccactgaaaagatttggggatgagtacactcaccatttagaccacattggcaatggaattaatttaggaaaccataaacaacttcatagatgctgtgcttattggaaagggaagaatcagtcatgtgtaaatgtgatttttgctgtgatgcccggggcaaaggctcagtggagaagaaagtctggctgggcatcctggcctcaagccccatttcttgcctgtgttgacacctggtcttgaacaccagtagtttgcctgtcagggccgcccataacccggctcctcaatcctgccccattaggcttccagactgctgatctcattacgtggtgactactgttttccagaagtcttgtctaaaccacttcctccttcctctctcccgaaagaggaataataaacctcagaagaggaggctaaggtttagcttttaaaaggtgatatttaaaacaagactctcagttcaaattcaacctctgccatttacttatgtataaccttacacgaattattgaacagttctgtgcctcggtttcctcatcggtaaagcaggaataataatctctaccggaaagaatgctggggggttaaatgagataatatctgtaaaatgatggaatatagtagacgcatataggtttccttccctcatttctgctatcttaatcacttttgtgtgaatacacagtaggggtctagaaagaatatgaaccatgatttgggagaagtcagaggtgttccaaaaatttctgaacctctcccaaacccttttaagcactggggtctgaaaagcctaccctctcccaccctaagatttccaaatagtatcaaaaagaagaagagattcccactcctgttttctggggaagggtggaatatgcaggtttattattgccaacatctataacacaaaggctctgccagagccaaccttcaaggtgacccctagatagggagagagaagaaatgagattgaaatttcaagggcctagctctggagattctgaagatccttgaccttgggaactcacccatgcagaagtggagagacaggttttcaataataaaggctaagggcttcaaatttcagcttgggttactagagttcagtgagagatttactttttattttcgcctcttctaggattctttaaatctcattaagaaatgaagagagaaatgtgaagaaaagctgtcagaggggtaaactgtcagagggatgcaaagaagagtaagatttcaaacaattgttctgaaagaaaattagtagctatttaataaggactgtctatgcatatagcagatatttaaatcataataagtataaagtaacctcaaaagcgtctcaataaggacagcatctctcttccaaacctcaatgggttttgctggctgcacttccagggcaagttgtcttggccacactttacttctcttccactctctcaatccctttcactgggcttggaggcacagcaactcagaactacaaagtctggtctgggcagcagagtcattggctgcgctgtactctccctcagggcagtggcaagctgggacctctctcaataggcaagggacctccgactccctgttttagatcacttcccccttggacaaaatttagacctttgtgtaaaagctgactgagaaaagtgcaatgtgttcatctgtcaagccaaggatgagagtaatgaaaattttcccatcaagtttcacgtcctttgcagaaacttcgttttcaaccatcttgttggccttctctggcctgttgataatgcgccccctagtggatgctttacaacatcccctttgtcttcgtagaaactgagtccttccgcctgacttcagttctcgaatcctcaacgtaaaaccagaaag

SEQ ID NO: 17621 - DNA, 61916 bp, Homo sapiens
gaagatagagtaaaaaaatggcttaaaacataaaaaatggtacacctgtagagagcacttaccatgaatgaaacttgcaggactggaggttgctctgggagagtcagcgagtgagtggtgagtgaatgtgaaggcctaggacattactgtacactactgtagactttataaacactgtgtacataggctacgctaaattaattaatttttgttttttgaaacagtgtcttgctctgtcgcccacgctggagtgcagtggcacaatctccactcactgcagtctccacctcctgggttcaagcaattcttctgcctcagcctcctgagtagctgggattacaggcatgcgccaccaaacttggctaatttttgtatttttagtagagacagggctttgccacgttgggcaggctggtctcgaactcctgacctcaggtgatccacccgccttggcctcccaaagtgctgggattacaggcatgagccactgcacccagcctattaaaaattttttaaatctgcaataattaaccttactttactgtaactgtactttataaatgttcaaatttttttaccttttgacttttctaataacacttagtttaaaacacacgttaagtagttgtataaaaatattttcttttttatatctttattctataagcttttttattttttaaattttttacatttaaacttttttttttttgttaaaaatgaagacacaaacacacacattagcctaggtctacacagggtcaagatcatcaatattgctgtcttcctcctccacatcttgacacactggaaggtctccagggacaatgacacgcatggagctgtcatttcctacaataacaatgccttcttctgaatacctcctgaagggcctgcctgaggctagttacagttaacttctttttttataatttgaagaagtacactctaaaataagaaaaagtatagcacagtgtattagttcattctgaaattgctataaagaaatacctaagactggataatttgtaaagaaaagaggtttaattggctcacagttttgcaggctatacaggaagcatggcggcatccacttctggggagaccttagggaactagcaatcatggtggaaggtgaaaggggagaagccacgtcacgtggttagagtagcaagaatgggctggggaggtgctacacactttttttttttttttttttgagacggagtctcaccctgttgcccaggctggagtgcaatggtgcgatctcagctcactacaacctctgtctcctgggttcaaacgattctcctacctcagcctcctgagtagctgggattacaggcactcacgaccacgcccagctaatttttgtatttttagtagagatgggttttcaccatgttggccaggctggggtgctacactcttttaaatgaccagatctcatgaggattctatcatgagaccagcaccaaagagatggtgctaagccattcatgaaggaaccacccccatgatccaatcacctccccccaggccccttttccagcagtggggattacaatttgacatgagatttagtggggacacagatccaaaccatatcacacagaaaatacataaggcagtaacatagtcatttattatcaagtattatgcactgtgcataattgtatgtgacttttatatgactggccatgcaataggtttgtttacaccagcatcaccacagacacatgagtaatgcattgtgctacaatgttatgacacctacaacatcactagatgataggagattttcagctcctttataatcttgtgggaccaccattgtatatgcagtccattgttgacaaaaatgtcattatatagtgcatgagtctacgtctatcagagatttattatggaggttggctccctcaattatggtggctgagaagacctaaaatatactgtccacaagagaaccagggaagctggttgtgtggctcagtctgagtatgaaggcctgagaacctggagttctgatgtccaagggcagaagaggaagggtgttgtccccgctgcaatagagagagcaaattctctcttcctctgcctttgtgttctatccaggccctcagccctttggatggtgcctgcccacattggtgaggtcagatcttccttattcagttcactgattcaaatgccaatctcttccggaaataccttcacagacatacccagaaataatgtgccaccagttatctgggtatcccttaacccagtcaggtttacatctacaatgacccaccacaccagtcaaatacaaatcagcaagactcagctggagtgaagtagtgcagatgggctgggcactgcttggtgggtccactgcttacctttcccacctcacattttacatttctacagggggcagatgcctgagcatagctctgtgatcaacaggctttgtgggtttttattatttccacactaagattcttgagattggaatgttatcccctttccttttgaaatcagctcacttgtcctagagaactgatgtttatggtttcttctgaataaacatagaaattgatcctcccactcttaaaactttagaaagttacatttgtcttatctgagttcctttctcgggtttccaactgtcagccctcccagatagtaatgaggcaggagaacagggtctggaaacaggggatgtaaggccgattcaggctgacttcctagaactgaatcaaaaggaaaaccccacctctccatgtccaagtaacaaaaagatcagaggctactccctttacactccgcccctccccactcccattccactgcattgcagatgaaaaattgaaagtacctctgattggttgcctccctctaccaattagactggttgtgggccaagtcttcatttacatagggtgtaaccaagtaaccagtgggaaacctctagagggtatttaaccccagaaaattctgtaactggtcctcttgagacacttgctcaaatctgctcccactctgtggagtgtactttcatttcaataaatctgtgtttttgttgcttcattcttttgtcgctttgtatgtgtgatccgttcaattcttcgttcaaaatgccaagaacctggatgactcacagtcaagaccctccagtgcggtaacagtatcaaggaactgacacttaccagatcatcacatctggacaataagaagccagacccctcacctgtcatgattgcctaactgatcacctgcttcttcttgaccaactcctcttccttacccctccctaattcctattttcctatatgtagttacatttcttccctgttatataaacccctgatttcagttggccagatcacagctgcagcatgtgattaagccttcttccctggcaataatcattgtctcagtgattggcttcctgtgcggtgagcaattgtacctagatcaaactcctggcattttggtagcacttttttttttaggtaaggaagttgagaaatgttacaggacttcctcaagttcctacaaccagaaaagggcagtgctgggttggaactccacttagcagctaaagttcatgtaagtaagcaacatgctagcttgtcttccaacaaaactatgtgaaaatgaaccctagctcttcacttaaagcccagcagccctgtgtgagctatgtaatctaaaagaacctcagttagctcatgtgggaagggggtgtaatatttttcttgcactgttattgggatgtgtaaataacataatttgtcaatgctctccagccagaaaccactaggaacacacctatagttaagaaagttgggtttaattctcattgcaaagagggaaaatgcaaacaatgggaaaccctgggggtgtctcagtgagatgatgttagaaaatgttattaaaggatttgggctttggtttgctgctttgggagaagttgaagaaagcatagtttttctctgggttggatagggtcaggaaactggggtaattctatgaatgtgtatcctcataaatcttacccatagggaaagcagactacaccaagtctgaagctgtaattgggctgagtgtagtggcccatacctgtaatctcagtgctttggcaggctgaggcgggagaattgcttgagcccaggagtttgagaccagcctgggcaatgtagcgagactctgtctccacaaaaaattttttaaaaattagctaggtgttgtagcatgtgctgtgatcccagctactcagaaggctggggtaggaggattgcttgagcccaggaagctgaggttgcagtaagtcattgtgccactgcactccagcctgggtgaccgaacgagactctgtcagaaaataaaagctgtaactggcaatgaagcagcagccagttctattagccaagacaactgctatatttgtgtgttttcttttgtggcttgaacaatgtttatgctttgtctgttttcagatatgatgttgaagtggtcttattctggtctagatccatcctggtcacagaggagtcttgtctaatggtgttgtgggaaatcgtttatgttcatgttcaacaggaggacatggcccagggtagtgccaggccagatctatttcagaatataaggtatccatcccagtgctggactcaccggtgttggaaccacaggggttatgactctaatggtgcttacccaaatgccatcccagacctctgagccacagtgacacaggcaggtgcattctggagaggctaaaagacagatgtcccatcagggagtaatgactcattttcctcctgagcttcaaacattacacgaagccatttccatgaagtcagtggtatttcagcccagggagaattttggacacagcaacgaggggcctgcaagttagatgacctatcctgtgatctgcctttgcctccttcatgcagcaaatatgcagtgtgtctcagagctgggctagatactgtgacacccaccacctcatgaaaaaggcagagaagcaaacaatctagctgaaaaaatgtaaaagcatgtagtgttcagtgagggcagtggtgcccacactttcctatgcaatggaatcacctgtgaatctttcaaaacactaatggttggggtcccatcccactgagttaagtgatctgggcttccactcgggcttccagcttttaaaaactccctaggtgatcaatgtgcagccaagtttgggtactattggtttaatccatcatttttacaagcttggcgggggttgggggggtgggggtggaggtggggagtgggcagtggagggtgtcacagatgttgaattggataaaagcttttgtctctcattccaggcacttgcatttagatgtaaaacctggcatagtatttcaggggatttacagatcccaagaagtgaatcagggaacgcctgtgggccttgtggtccccaagtgagaaaagtccagctgcaggagtgtccacctccaattggggtgacaggagctctctgtcctgtccagaatggtgctggccctttgtctcagtctttttgtctgtaataacaaaatacccaagactgggtaatttgtaaaaaacaaaacaacaagaacaacaaaaccaggaatttatttctcacagcctctgaagtctgggaagtccaagctcaaggtgaagcctcctcaggtggcaaagagcagaagcacaaaagagaccaaactccctccctcaagctcttttacaagaacactgagacattcacaagtgctgagtcctcaaacctactaacctcctgaaggctacacctcaaatacggattgaattttcgcatgagttttgagggacacccattcaaagcatagcacccttcggcttcagagaagctccagccctgttgtcaccaagcaggttccccctaggcagagcgccaagaagcagcccaggcgatcccaaggcgcacaagtgctctcaccaggctgcgcgctggcgggtcggtgcacagggacggggtcgccgcccacgcgcgcttggttcagggagcccaggctgtccctacccgcggctacaaaagctcgccgagtcttcctgtccacccaatcgccccacatgtcagcggttggtcgcctcgcggtgcagtgctgggcacgcgagcccctcccgcagtcattctcagcacaagcaccagcctggagccccgcagcgacagagctgagagcccccaagccgcagaggtcgtgcggagcaggtaagcgcagcctcctggctggggagccacggaggagaaagggcggccgggtcccacggccccgccaacaggacaggctatgccctttcagtaccccctcttccctggctctgtttctaatctaggaataaacaagaaagtccttagtctttgaaaagaaaatgattccaaaatmcaaaaaaaaaaaaaaaaaaaaaaaagttaaaaagttaaacatcacgtttgtttggcttaaaataattatayatggcttgtaatgagggaaatccaaaattcacaagcctcttgatgtaaaataatttaaatatctttggtttgggattatgtggttactacaaaacataccacagctgatgggaaagtggtttacttcccattaggttgcaaatgtcttagaaacacactcctggaccacagcttcaagagacgcaagcagtcacctcatctgctggtttccaagctgccctgccagaagcaggtcaggggtcccacaggggtcctcagtaactcctcaaaatcctctcccatcaatggccccaccagatcatccctacttttgaatgcttgtccaatgcaggttccaggtaagatttcctttcacaagtgacttccatggctaaggaaaaattcagcactctagaactagtccaagcccctctctgcggcagtatttataagcagcggaaccatcttgtagatttctaagcttgctggaaaataaaacactgctataaatgcatagagccttctcccttgtgaaaaggaaactcctgccagagatgaaagcaacagcaaggatagcactgtgcagagtaagggtggctaacgccaggcttcctcctggggatttacatcaggattgtaacatattagatgtaaatccacctgtgggctccagggtggatctggaggtccaggcaccagggagctggggtcaaaaccaactgttgttaaaagtcaagggaattataactaaggaataggacgctttaaaatacgacttgtggctgggcgcggtggttcacacctgtaatcccaacattttgggaggccaaggcaggcagatcacctgaggtcaggagctcgagaccagcctggccaacatggcgaaacsccatctctactaaaaatacaaaaattagccaggcgtggtggcaggcgcctgtaatcctagctactaggaaggttgaggcaggagaatctcttgaacccggcaggcrgaggttgcagtgagccgagatcacaccactgtacttcagacagagcaagactgtctcaaaaaaaaaaaaaaaaaggcttgtaagtaaataatgatacaaagaagatacatgagcagtgtcaaaaggcaggtttatttttcttccctttatccataacttagggattcttcaaatagcttaagcaaaatatatccaagttgttaatcaccacatgcatgatgctaggtggttaatttaattggtgaaatggttttgttgctccgtagagtagcagtatctatatggaccaacaaaatcatttcaccaagtaacaaaagccagtgtggcccattattctctgtggcaagtctcctttaagaagtgacatgcacttgtgctcctagctgcttgggaggcttgaggactccttgagcccaggagttccagggtacagtgagcataacttgccactgtgctgcaayctggaggacaaaaccctgtctctactaaaagaaaaaagaagaataaggagaagaagaagaagataaggaagtttttccttcgttctttgaaatctctttctgagtagcattcctcccccaccacaaaagtaaatgattccatggtgaaagacaagaaaataacttctccagtaggatgaggtggtctcataccaaccaaagcaaccaaagcttgcataccaacattgtyaggtgggtgagaattgcattcattcctaacctcttgaggcttcagcatcccaagactagatagtggaaaatctyagtagctctccaggcaaagctggccgggtggcggctggggggcattgggggcggggttgggattcagaacgctcmcccaccatgtctgaaaagcatccararagatcataatgctttgacttctgatataaccttttggggtgtttatgtacttttgatgcttcaaggaataaaaagtctaaatagaattctaaatgcaaaacctctctctgtactactgaggattctcagatggaagaatacattkgttaaccatggtaacaacatatataatcaaagttttgcattattttgagcttggttataacaatgtgctacatccatccacacacacacagaaagagaagttgttgaaaaccaagacaaggaaccctgtggttttctggatcaacaccaggaacgatcccctccagccctccctgggctctgctttctcccttcccctctttgctggttgagcatctgtggcgccaaccagtggtccccgtgatccatgcttcagggccccggaaggcccagaaggcttatgttaccagtccggtctcggtctcaagtaccagagtgacatgacctctcccttactgagcctgaccacctgcctggatcttgacgtgcatggcctcctttctttcactacagctcagatcatggggggtttgtacccatttcacagatgggaacagagagccttcaaattaggttgagactttgcttacactcccaaagctagccagcactggggctaggcttccaacccttcctctgactcagctgcacacaccatccttactaagaggacagcagccccttgcttgcttttgcatttgcattaactctctgaacccaagcttataaataaccaagcaacacattctgtactatgcatttgttattcccaaagatacagcttgattcaaaataaaatgactaagtttatttcctgctcaccttccagcacatcttggacttcaagaaagatgacatcattcaagcacttacataaattctatgttgtggcaaggctctgatccttttcttgtcacttcttcagcatcctaaatttgcacatgataacatctgttgtcctccatcagatataatcagtattgctaatctacagtgccacattggcagtagtgatttttttttttttttgagacggagtcttgctctgtcgcccagcctggagtgcagtggcaagatcttggctcactgcaagctctgcctcctgggttcacgccattctcctgcctcagcctcccaagtagctgggactacaggcacccgccaccacgcccagctaattttttgtatttttagtagagacagggtttcaccgtgttagcaaggatggtcttgatctcctgacctcatgatctgcccgcctcggcctcccaaagtgctgggattacaggcgtgagccactacgcccagcctggaagtagtgatttttatccactttttctccaggttcccagaaagaatattcaacttagtatctatttggctgggagggcaggatgttagtctttgcttcatctaaaagtaaatgaggaattcagtagctcctctgaccacttcaatcacttatagacaagtataatgaaaatatattcttcatacttaaaaaagatcacctgaggtcaggagtttgagaccaacctgatcaacatggcgaaactccatctctactgaaaataggaaaattagctaggcctgatggtgcatgcctgtaatccctgctacttgggaggctgaggcaggagaatcacttgaacctgggaggcggagtttgcagtgagccaagatcgcgccactgcactccagcctggctaacagagcgagactctatctcaaaaaataaataagtaggctgggggtgatggctcatgcctgtaatcccagcactttgggaggctgagatgggcagatcacctgaggtcaggagatcaagatcagcctggccacatgatgaaaccccatctctactaaaatatataaaaactagctgggtgtggtggcaggtgcctgtaatcctagctactcaggaggctgaggcacaagaatcgcttaaacctgggaggtgaaggttgcagtgagccgattatgtcagtgcactctagcctagatgamaagagtgagactctgtctcaaaaaaaaaaataataataataaattaaaaaagtacaccatgattggttacattaaccacatttatttatttaatatttttttagacagagtctcgctctgtcacccaggctggagtgcagtggcatgatcatggctcactgtaacttccacctcccaggttcaagtgattctcttgcctcagcctctcaagtagctgggattacaggcgtgcaccaccacacccagctaatttttgcatttttagtagagatggcgtttgaccatgttgggcaggctggtcttgaactcctgacgtcaggtgatccacttgccttggcctcccaaagtgctgggattacwggcatgagccacagcgcccggcctaaccactttaaaaatatatttaagtgcccccagtatcactgctttctaaactatttcaaaaactgaagggtactatttctataataataaattgttagagtataatattcacagtggtaattcaggtaatgagagtattttacaaggcagaactaattaggttggaataaaacaaaatcagacaccaacaataattcatatgtctcaaatagtgcccttgcctacctgtctttatctaaatattagctctacacattgacaccacgttagtagccactaaaaagaagagcaagcactctgaattttagtctctgttatgccatttcctggcatttggaggaaaagcacattctacagaaaaatcacgggatggyactatctgttttgtatctgattttaacatgtgttatctcttaggtacagggtcatacacttggaaggtgtgatattgtgaaatatgtatttggtcttcctcatcttttcctgacatacggttccttcaatccttggaatcttctgtgctaatgaggtgactggaggctgagggcctctagatagcctcagggtgggaactttttgtgggaaaaatcaagttctgattacagggttaagatattcagccccaggccccaacctccaaggagggaaggggggctgaaaattgagttgatcgttaatggctaatgatataatcaatcatgcctacaaatggaagcttccataaaaattcaaaaggaggccaggcgtggtggctcacgcctgtaatcccagcactttgggaggcctgagtgggcggatcacgagatcaagagatggagaccatcctggccaacatggtaaaaccctgtctctactaaaaatataaaaattagctgagcrtggtggtgtggtaaaaccccgtctctactaaaaatataaaaattagctaggcctgtagtcccrgctacttgggaggctgaggcaggagaatcacttgaacccgggaggtggaggttgcagtgagtcgagatcgcgccactgcactccagcctggtgacagagcaagactctgtaaaaaaaaaaaaaaaaaagttcaaaaggactgggtttggagacctcctgggttggtgaacacatccacatgctgggagggtggtgtaccccaacttcatgaggacagaagctcctaggatcagaacccttgctgacttcaccccatggatctcttcatctgtatcctttatcatattcttttttttaggctagttaggtgagcccttattatattctttgttaataaattggtaaatgtgtttccctgagttcttgtgaactgctctaacaaattaattgaacctggggaggggcatgtggcaaccttaatttgtagctggtgggtcagaagttctagaggctcagatctgcaactggtatctgaagttggggacagttttgtgagactaacccctgaacctatgagatctaacactgtctttaggtagggagtgtcaaaattgagttgaattagaggacacccagctagtgtccactggagaacctgctggaaaacggattgtttggtgtctggggaaaaccttgcccacatttggtcacagaagtattctgtgttgattgagagcagaaaaaaaataaaaaaaaaagctttggtttgggtttttcctatctcctatattgcacaaaaggccatatatgtctgccagtaaaagccattgaccccatataaatactagccctatcattgagctagttttttccttagctggtcgtgctacagggtagcacagctccctggttgcagttttatttaaggatccttgaagcatttcaaatacttgaggggacactagaggggggcaagagatgagataaactcttcctgccctttcatctgcaccagctatttattaaagtgcatttaacatgtgtgcttggattcttccccacttgacaggtttcctctctgaccactttttggactgaagaatgggctccaagggatggctcctgccatctagtggcttcctgatgtatggcagattgttcctggctttcaaatttccacaccttgaaagatgcccagggagcctatgaaaagcccaagacctggctgggcgcggyggctcaggcctgtaatcccagcactttggaagaccgagacgggtggatcacctgaagtcaggagttcaagacgagcctggccaacatggcaaaaccccgtctctactaaaaaatacaaaaaaaaaaaaaaaaaaattgggcgtggtggcaggtgcctgtaatcccagctactcgggagtctgaggcaggagaatcgcttgaagctgggaggcagaggttgcagtgagctgagattgcaccatcgcattccagcctggcgacagagcaagactccatctcaaaaaaaaaaaaaaaaaaaaagagagagagaaaagaaaagcccaagacctcggggccatccccaaacctactgttatcagattttgaatctatctttttttctcttaagagacaggctctcactctgttgcccaggctggagtgcagtggcatggtcatggctcactgcagccttgagctcctgggctgaagttcccgagtggctgggaccacaagtgtgtgccactatgcccggctaatcaatacttatttatttttgtatagacagaggtctccctgtgttgcccaggctggtcttgaacccctgggctcaagcgatcctcctgcctcagctttccaaaatgctgggattgcaagcatgagccactgcacatggctgagtttgggattttaacttgctttccaacacatcctctcagccaaatgtttcccaaacttaagtcatttgccttccattgtcatgatttttcccatactcatatgccaggtgaaatgtgatttcctcaatatttctttaaattcataactaatataaatggaacattggtatcatttgccatatgaaaaggaagtcaaaaagaaacatttaaaaatttatttccaggaattccacctaaaacaatcttctatatcattctatattttggaaaacagtactttgggagttccttctggacactttgctgtgattcaacaccacattcccggtttgaaatttagttccttttctaacaggtgtctatgtttcatgcagaacttccatagttccttttgctgaagatgccttaatagtgatgcatggtctcaattagccattggtgtaggcctgaaaaaagagtggagaccagaaacatcttacagtgctgataattattaaagaagattctaaggccgggcgcagtgtcttacgcctgtaatcccagcactttgggaggctgaggtgggtggatcatgaggtcaagagatcgagaccatcctggccaacatggtgaagccccgtctctactaaaaatacaacaattagctgggtatggtggcgggtgcctgtagtcccagctactcaggagaatgaggcaggagaatcacttgaaccccaaagggggaggttgcagcgagctaaaatcacgccactgcactccagcctggcgacagagcgagactccatctcaaaaataagtaaataaataaaaataacacaatgtcccaactaggactctttatggatcagaaattttagcttgactaaacaggcctgttgtggttttttggtttttgtttgtttgttttgtttttgagacggagtttcactcttgttgcccaggctggagtgcagtggcaccatcttggctcactgcaacctccacccgccaggttcaagctatttccctgccttagcctcccaaatagctgggattacaggcatgtgccaccatgcccggctaattttgtatttttattagagacggggtttctccatgttggtcagactggtctcgaactcccgacctcaggtgatctgcctgcctcagcctcccaaagtgctgggattacaggcgtgagccaccacatgcggcccaacaggcctgttttaaagttgctaattgaagggtaaaatatagagagcaaaaatcagtcacatccataggaaaggctgaattccaaaacaactgaaaatcaaaaaccatttccttttgaaagataaacacatgatgggaaataatgatccgtaatgatcgtaattctgtgtcttggaaaacagacatcaatggatgactggtgcagagcacttcttctgcatcattaccagtacttaccagatcatctgtccacatataacctgatggataccatagaaacaagttaagaaatgattcaaaagttattcagataagtagatgtatggaatacctaacagatccctaatatcattacatttatgcagcaaaataaaaattctggaggacagaggccgggcayggtggctcatgcctgtaatcccagaactttaggaggctgaggcaggtggatcacttgaggccaggagttcaagcccagcctggccaacatggtgaaaccgcatctctactacaaatacaaaaattagccgggcttggggacgcgggccagtaatcccagctacttgagaagctgaggcataagaatcgcttgaacccgggaggcagaggttgcagtgaactaagattgcgccactgtactccagcctgggtgacagagttagactctgtctcaaaagaaaaaaagaaaagggctgggtgcggtcactgattacaggtgtaatcctagcactttgggaggccgaggtgggcagattgcctgaactcaggatttcaagaccagcctgggcaacatggtgaaactctgtctctactaaaatacaaaaaattagccgggagtggttttgcatgcctgtagtcccagctactcaggaggttgaggcaggagaattgcttgaacccgggagacggaggttacagtgagtcaagatagcaccactgcactgggtgacagagcgagactccatctccaaaaaacaaacaagcaaacaaacaaattctggaggacagaagaaagagaagagtgggttaaaactcctttgatgtccagctacttagccccttgtgatgcttttcagaatgatatgataaccaatactgggttgtgtgtgttacttattgggaaagatgtgaaatataatccaaaatgtaaaggatgaagaaatcaaatcaatcaagcttctgcactgctaaaacagaccaaagcaaaccaattccactcctggctgagcacaccgactatttgaagtgttcccacactagctgtgcaccccactgacctccagggatttgtgctgtgggtgcctgtggaaccagtgccagcacctctgctccagaagctggggcttttgttttgcttagtcaaatctttaaatgctatagtgatgggacaattatgttttttactcctccgtccccagctccacccaccccaccccaaaaccagtttatttatttaaaaatttttttagacatgagggtctccctatgttgcccaggctggtcttgaacccctgggctcaagtgatcctcctgcctcagcctcccaaagctctgagattacaggtgtaagtgaccatgcccagccaaaatcagagtttttattcaagatacaacttacattatctcagttttctgtccgtataatttcctcagaatccatttcaaccaaaagtaatttaaattcccactggtttctctggatacacttcaatataactattttatgtattattttttgagacagggtcttactctgttgctcaggctggagtgcagtggtgcaatcatagctcactgcagccttaaactcctgggcccaagagatcctgcctcagccttccaagtagctggctacaggtacacaccaccacaccaggctaatgtttattttttgtagagatggaggtcttgctagggggcccaggctgttcttgaatcttggtctgaagccatcctgctgcctctgtctcccaaagtgctaaagtgctaggattacaggtgtgagccactgtacctggcaaactttataattttaaaagtgaatccttaatatcagtttcctttaagaaaactttttaaattaaaaagttgtattagttgataatatacaatatcaagatacaaaatgatgacagttagaagggttagattgcttgagtggcaactgaaactttgaccttgggaatccgcatctggaatcacacaccttcttttcttttgctaccagccccgccttccagaccctgttttactacttcattgaggcttctagaccctcacctccatttttccgaagtcttatttttctgccctctcatagtttcacagtgtttcatgtttcaaactgggacrtgagtttaccgttgacaaccgtttcctaagagctttctaacctcctcaccatctttgcttaaatcattctccaatctggaaatgactcagcatttacagaactaagctagtggtttaactgcctctcctcactgaataacatatttccctaacaaaccctcttatcactatgagtttgttgttgttgttgttagagatggggttttgccatgttgcgcaggctggtctcaaacttctgggctcaaatgatctgctcaccttggcctcccaaagcactgagattacaggtatgggccactgcacctggccttatcactatgtgatggacaaagaacctctgagaagctactccacttgctccagtcttcatctaggaaagggtgaaactgaaatctgagcccaaccttctggctctaaagtgtgtgctctgactcacactacacagatcgggctttccctgctggctttattctcatggctttaccaacttgcattatcctcctagtttacttacctggtcttcatcgtactttacacacctgacctttacatctggccttcagatttagctttccacttctggttgtacccactgttccttacccaactagtggccttaaccttctggttttaccaatctggccatagcttcctgaccttgtcccccggtcttaccccctagtcttacctacctgttcttacttacctggccttaacctccttgccttaccagcctgtttctattaaccttctggtgttactcacctggtcttaacctcatggtcttacccattgtgcttacccayctggtattatccacctggttttgatctcctggccttagcaattaggccttactcacctggcactagcttttggccataccactttgccttacttacctagagtttctacttggccttatcagccccctagtcctactcacccagtcttattctcctggccttgcccactttgctttaaccaccctgccttaactgggtgctctgtccttctagcctcacacaccaggcctcagtcacctggtcttactacctgctcttaaccttgtggcctttccctccagcctttccccctgcccttatccagcaggccacatccacctttggtcagtgactggcttacaggtccccagcactgttatctttgcaccagagcccactctcacctaatctccgtgtgctggtgctacgtcaagtgtggtggtggttaggagtcaccttccgtgtgagrycaagcgttctggctcccgttgtccttgaagttgcatctcaggcttctgggcatggcagagcctgcgttcctgtgactcggctgaggccggtgtgatggagacttcccggcagcctcccggacctggtctctccaaggtcagatcttgaaacttctgggcacccatgcrartgcctgtcctggtgtgccgacttgctcttggtctgcgaagcctgtggacacatggtcaacatgaaaccaccttaacccgcttcccrtcaggtctcgtgggagggatggggcagtgcctggagcacagagaggctcaggaaagggcagttcaactggtttcrctgtggtggatccctyatgggggtctttctagcccaaactgggtgtgatcctgggatagtcaagagctcatgggaagctcttgtttttctcgtattttataggmaygtggagttttcaggaagtccaaaaaagtgcccagtggtcttggcaggctttgagtcttggccacctgacttgttgccagttcccttcacccctggtgacccctaacgtttatctggggtctcatcatggggtcagaatttgttacttcmgtttcttttatgaaagagtgcatttgggtgtatttgaattgtttattttatactctatgaagtcaataaacccattcctatcacccatcccactgcctgagctaaggggccttccacagttgacctggagagttcaagygcactgcactcgagtgcgcttctgggttgaagctgccacctggtactcccagagcctgtgcctctgaggcttcctcttaggttgtggatccgtggaagagccctgcccctgggaactgacatttcccttagaatagggacagaatggaaggtcttgcatttctggagaagccagataaggctgacaattcctgtaagattccttcttaggatgcttgactatgtgttcatattctgtattataaacatatgctacttttcatttaacattctatttttttgaaaatgttcctctgttatgaaaactttcttgatttttaatggattctccaagtcataaccattttctaggagagtgtggcattttggtaactggaagtaaccacagtttcagcattgctccaaagacttaggcgttcttctggttgttggtggagtttgcatgtcagtcatgtatctgcttctgatattttatagaaacatttgacaaggatgattttgctaacatttgccttgcagttcttctagatattgtacttattattattattattttctgcaggttggtctaattgaaggcaatggagaagtaagtctttatggatcaaaatcttagctctagaaaaggtgagggggcctgttttggaaatacrtctattcataaatatattgtttgatgtaattatgaatttgatgatattgaagcctctcagtactctcaattacccttatgggtaatcttagggcttataacatttaggagacacctgcagatgcacaacaatagctttgtttattgtgatttctaagttatttatatgatttgcaaaagttcagaaaatgtagagtaatgtaagaagaaagaagaaaataaagatcacatgtattccttctgcccaaagataatgaacacctcacaatgctgtagactcttctaggaggctcctgtgtggccagccacagtaatgctktttatttattattttattattattattattattatttgagatggagttttgctcttcttgaccaggctggagtccaatgttgcgatctccgctttctgcaacctctgcctcccagattcaagcaattctcctgcctcagcctcccgagtagctgggattacaggcatgcaccacaacgcccggctaacttttttgttgttgttgttttgttttttttgagacagagtcttgctctgtcccccaggctggagtgcagtggcgggatcttggctcactgcaggctctgcttyccggrttcatgccattctcctgcctcagcctcccgagtagctgggactacaggcgcccaccaccacacccgctaattttttgtattttagtaaatacggggtttcaccatgttagccaggatggtctcaatctcctgacctcgtgatccgctgcctcggcctcccaatgtgctgggattacaggtgtgagccgccgcgccccgccaactttttatatttttagtagagacagggtttcaccatgttggtcaggctggtcttgaactcctgacctcaggtgatttacctgccttggcctcccaaagttctgggattacaggcatgagccaccgtgccyggccagtaatgctgtttaaaatgaaagaaggctctacaatggggccatgacgcacaccgcatatgaagtgggcatcttccgtgtcagtaagttttatgtatgtattctaatagttcttgaggaatctgtatttttctgttcctagaggaatctagggaggaagtaaggtggagaggttaaagtcacagctcttcaatgatcttataactcacagagtttctgtttaagtyctcaaagtgacactgtgatgagcatctgtaaatgtgtgtgtttgtgctctcctggccacttcctcagatgaccttctaggcagaattgccagatcaaaagggtacacaccttggaagcattgatgtgggatgcctgtctcttttttttttttgagacagagttttactcttgttgcccaggctggagtgcaatggcttgatcttggctcaccgcaacctccgcttcyrgggctcaagcgattctcctgcctcagcctcctgagtagctgggattacaggcatgcaccaccatgcccagctaattttgtatttttagtagagatggggtttctccattttggtcaggctggtctcgaactcccaacctcaggtgatccacccacctcggcctcgcaaagtgctgagatgacaggtgtgagccactggccagtctcatttttaagactgcattggtgtggagctgtgagtttgttcaagacagttgaagtgcagtttattataatattgctaaaggcaaacttgtggaaaagtccactttgtcctgagaagaactgacttgcaggaggtcaagtgaggtccttgacagtgctctgagccatcctgtccacttcctatgwgtcaggcagactatgagcccaaaggtcttgaagtattacggtgttaggttttgtttaaacattagttatttctgatttttctaattgtttgcatacacaatctctttttactcttaacagtgagactctagtaagtggtctcttgatgcttactataactttggggatgtttgaaagtgktgaccgagtcmcccacctggtcttctgccatgtcacttggccctgctggtccatttgtttttggccagtgccygtttgggagccaaaccttgtcacctacctccagcccaccttgcccctggggagtcaggtgcagatgcttctccgggcccttcccactgtcctgttctgatcttttacctggtgcagggcagaggggcttagaggacttgacctcattatctgagcaagctcgtgttctccctgaagcctcctggtgcctggcagggttcaggtgctgcaggccagtcaagccgacacataatattaaccatcacagggccacttgtgcctctctttttcttcctcctgctgccgcagataatccattttcagatttcccctgtatgtatcagggttctctagagaaacatatgcatttgtatgtaagatatagaaaagattcatttcaaggaattggcctgtgtgattgtggggactggcaagtctgaaatgtrcaggacaggcaggaaatgtgcaagaattgatgctaaagtcgcggcagaattccttccctctaaaacctcaatttttgctcttaaagccttcaactggttagctgagccccacccccattattgagatatatgcgaagtgtttgtgcttatgtagacacacacaagtatatgcatattagtcatatgtgtatatgagaatatatagacagtgcctaccacatagtgggcactcacaaaaatctgctattagccatgtgcggtggtgcccacctgcagttccagctacttctgaggctaagtcaggaggatctcttgagcccaggagttctttgagttcagcctgggcaacatagtgagatcttgtctcaaaaaagaaaaaaaatatgccgctattagctgctattattattgttcttttcattagttcaaatctttttccttcctccatgtaacaactgccgatccttggttctggttgtctatagttatatggagggagggaaagatttgagaatagtgttcatatctttccctatatttcctcatttaatcctgagcctgagtggagggtgaggctgtgtcagggaaataaggagacgtgggagtgaggccatgtgcttgtgctgggcaggactgtgcatggggcgcacctgtgaggtcgagtaggagagacgtygggtgcttctgggggtggagattagatttgcagattggggagtaggttagatgccctccctgggctctcaacgtggaaaggaggctgggagtgggcagtgrggcctggggcgttagcagytggaggtgggatgacagagaagaacgagaaggccaatggagaaatggcattcccactccagctttctgcaaggttgtatcattgaagtcgtgcatgtsagccttctagatgtgtgggtagaggggtaagactggaggagcagggccgagtcaaggctgggtaggacttgggtgacaccaaatgaaattagtattaaagccagacttgtgatttgagctcaaattcaaacaattaaattctcttttatccattttcaaagaygaacaggctcctttgatgtgaaacagactggttgtggactcagggagaatttagaaaagaaattaattgagtttggatctsttttacaaaatgtatgatttttaaaataaatcatttctactctttattcagtgtgtgcatttcctgacctttgttttcatttaagacaggacaacagttctgagagcagttctggatgtaagtctgttaagtaagatattaatctccttaattacggaaattacatagaaacctttatttttattttaaagtaatacacacatcatttattaattgttgtttccagatatattaattacaagcatggttttagacagcattggaaaagtatttatatggtaaataaaataacttctagttgtcaaggaaagtgaaaaacaggataagttcaagcaagacaagactcatgtctgtgtttcagaaccttcagatcagcctagaaccttctgagacaaggattctgaaaacttttagtctttatttgccattttatcttcaatgctgtttttaaaagctggttctcttgcaayccctggtcccccaacactgccctgataggccaattgtctaggcagcagttgtggcaacagctggaactgcctgcactttctgggcactagtgctggcataaggaccttgccaatcatgctgagcaggagtgcctagcttcccttcacgcgaccctcccaaaggtggctcagatctggaaggtccaaagcccatctcgtggcacattaggtatgaaccccaagtgtttatacctacttttgaagtaggttgttgtctacttttgaagcaggttgttgtctacttttgaagccttgcatttttacatggtccacacccatatccatagcaaaataatagttaatatcagatagctaacacttaccgagtgcttgctgcctgccaggcacaatccccacctgtgatttaatttccataactttgtggaggtgataatattgtaactcccatttaacagayaaggaaagtgaggcacagagagactcaattacacacataraggcacatgctcaggcaacacgtggccagtgcagataacaggaaaattcactgctcttccctctcataatacattttaatattatggaaatgtggtccttgaaaaagtggtcattgagcacttaccaggtgctayggatacaattcctctgcagcwtgcattctagtggggagagacaggaaacaaatgctaaaatgtgcaggrtgccaggagtggcccattccctgaaagaaaaggaaaggggagagtggttgtgtcaggagattctctctgatagggcagcatctgagcagagaccagasgatatgaggggagtgagcaacagggctatttgtgggggaagacagtaagtgcaaaggccctgaggyaggrgcgtgcctttgaaaagaaatggcaaggaatggctggaggacagcaagtgcagggaggctgggaggagacggaggaaagggcartgagatcctagagggccctggccacactgaaagaagctcctgtgaaacggagtctctcagaataggtyccttttaaagtcacctgaaaccaggtgtcagtgcctgcctgcctgccttccctccttctttcctttctttctttctttctttccttcttctttctttctctctctctctccttccttccttccatccttccttcctttctctctttcttctctttctcactttcttctctttctttctttcttctttgtttctttgtttgtttctttctttctctctctctcgcttgcttgcttgctttccttccttccttccttccttccttccttccttccttccttccttctttccttctttctttctttctttctttctttctttctttctttctttctttctttctttctttctttctttctttctttctttctttctttctttctttctttctttctttctttctttctttctttctttctttcttttctttctttcgaagtcttgccctgttgcccagactggagggcagtggcacgatcttggtttactgcaacctctgcctcctgggttcaggtgattctcctgcctcagtctcttgagtagctgggactacaagtgcccggcaccacacccggctaatttttgcatttttagtacagacagggtttcaccacattggccaggctggtcttgaactcctgacctcgtgatccacctgcctcagcctcccaaagtgttgggattacaagtgtgagccaccacgcccggccctagtgcctttcttacttccaaacacatgtttctgaactgcataaggagcctggaaggctgatggcagccaaggctaagtgccattgtgagcactgtgagactctagcagagttctggggtcctggtcgccccaggtgactctcgaatgggagcagctgccctccagttgcaatgctggtctctgagatgagtgactgtaatgaagagattgatgataaccccatgtcctcagaccttcattgtttctgcrgaagggaactgggaaagtcttccaccaaggaatcttttgtgaggcagtgagcttgccttcctgttttctgtaattcctcccattctcccatgtgcttgyggcgagaggaggacgtgaggattgtgttaaagggtgatgagagagcaggagtggttgcagttctggaaaaagatctaataaaacacttacctgcctgaaggcagtgtgctgaaatgaagaggcacattcaacagcattgtcatacattggacctgtgaggggtgtcattgaattgaccacttrggatgtttaaatgtttatttaaagttgcccttggctataaagcctgaagtgggtgttggagtagtcaacgactaacccaggatggatttgtgccaatacacaagtgacaacatctttcacagctgaagagtcggaggataaagccatgcccacagatcgttgtcacacaggtataaccttacattttccaaaatagtcttttaagtgccagcattgttgagtggcatgcactttttgaattatgtaatctgggcatattgtatacctttattttaaaaattttgtttaaaaatgccaatcacgtttattttactttatacmtataagtaacattttttctatcatatataatttaataaaatccaatctcactgtgaacactgtactgctgaaaattcatttttactrtaaaatagaattctgtaaattgctttaagaaagcatttattggctgggtgtggtggctcacacttgtaatcccagcactttgggaggccaaggygggtggatcatgaggtcaggagatggagaccatcctggctaacacggtgaaaccccgtctctactaaaaatacaaaaaattagctgggcgtggtggcaggcacttgtagtcccagctactcaggaggctgaggcaggagaatggcatgaaccagggaggcagaacttgcagtgagccaagatcgcgccactgcactccagcctgggtgacagagcgatattccatctcaaaaaaaaaaaaaaawttatttatatagtacttatatattatctatgtactttttcccagacacacacagtgaacaagtgatcactgggctcctttcccaggcacagtttttgtaagtaattgtgaatgcaggatacctaatatctttgatcatttaagtttttacataaaactaactctagtaggagaaaaacaaaggtgcgtaagtcacgttcacatatcttatgtagtcactttgattgtttccttggataatgatgctctgacagagtgctattgagttctcttagttccttccttccttccttccttccttccttccttccttccttccttccttcctttctctttctctctctctctctctctctctctctcacccaggctggagtgcagtggcatgatcttggctcactgcaacctccgcctcctgggttcaagagatcctcctgccttagcctcctaagtaactgggattacaggtgtgcaccaccacgcctggctaatttttgtatttttagtagagacggggttttgccatgttggctgggctggtctcaaactcctggcctcaagtgaccygcccgcctcagcctccaaaagttctggaattataggcgtgagccaccgctcctggcctcttagtgcttttgaatgaaataaaaacccgtaattattttaagaagtcttcttctatgtaaaaattagaactaggctgggtgtggtgactcacgcctgtaatcccagcactttgggaggccgaggtgggtggatcatctgaggtcaggagtttgagaccagactggtcaacatggcgaaaccccatctctactaaaaatacaaaaattaggcgggcatggtggtggcgtgtgcctgtagtcccagctactcgggaggctgagtcaggagaattgtttgtacctggaaggtggaggttgcagtgagccaagatcgccattgcactccagcctgggcaacaagagtgaaacttcrtctcaaaaaaaaaaaaaaaaraaagaaagaaagaaagaaaaaattagaactaaacaggtgttcttgtctgtccaacatagactggtagactcagagggagtattccaatgttcggaaactgaaaactttatttgaggtcaacagaaaagaagttgagatcaagtatcatgttttgtcctggagccaaatatgtagactttgctgttgagcctggcttgacactggacctttgattgatgttaactgtgactcaccctctcttgcctcctttcagtttccaaattctctctgcttgggtcaaaagtcattgyttgccagaagtttaatagtgtgtgcattgtgtgtatgtgtgtgcatgccaatatgtatgcaacccatacaatgcctggaacaccaatttagcttcatattttaacagaccatgattccaacatcatgtcaaagtcttatatgttaaaagttctgcatccacattagaaggtactatggatcactgtgtakcccatgccaaatggtacatgagctctctttctcctctgggtcctgatattttaaacaaagaaacagtgtgccattatgggcccttgattctgtgcaaagtcattgatcgttacccatccttgaggtttttttcttgaggcagagtcttgctctgttgcccaggctggagtgcaatggcgcgatctcagctcactgcaacctctgcctcccgtgttcaagcgattctcctccctcagcctcccaagtagctgggattacaggcacctgccaccatgcctggctaatttttgtatttttagtagtgacagggtttcaccaygttggccaggctggtctcgaactcctgactttgtgatcyacctgccttggcttcccaaagtgytgggattacaggcgtgagccaccatacctggccccatccttgacttttaacatgtacagagcaaccaataacgagtccttcctcaaagtaaagtgaaatgaataataaatgtctaagactttgtggttaaacctaactccacactgaggtgggtcctgtccctgttgatctaaattttcctccactaggggtctaatttggagcttccctacagaggattgtgtgctgcatcctcagatccatggcgcaaggttttttccacgtgtgaaaagaagataacagatgggaaagagctatccagaattggtgtgggcgctggtaccaggcctggccatggagaggactcccccatatttaacctagggcatctrttttctgcagccttgctgcttaaaatggggtctgggaaccaaggtaccatgaggatcagcatcaactgagagcagcttgttaagacgcgaagtctcagccccactccagacctgcagcactgtaatctgcagtaggcaggattccaaggcaactcttgttcacatcagaatttgagaagcaactgttctagaatacactagggagccatatgagatctcaggrtcaagtgtagagtgacttgaggtttctccttggttgagagctcctcaaataagataggcctcccaggttaactaatttcagagcaatttttyagatttagaaaattggagtcaggcgcagtggctcacgcctgtaatcccagcactttgggaggccgaggcgggcagatcacctgaggtcaggagttcaagaccagcctggccaaaatggtgaagcgttttctctacyaaaaatacaaaaattagtcaggagtggtggtgtgcgcctgtagtcccagctgaggcataagaattgtttgaaccagggaggaggaggctgcagtgagctgagatcttgccactgtattccagcctgggtgacagagtgagactctgtctcaaaaaaaaaaaaaaaaaaaaaaraaaagaaaaagaaaaagaaaaaacaaaaattgggttcattttgggttttgttgcacaaatatacatatttaagcacctgttaggtgcaaggcattatggcctgaggggaggtggtttggatattcataatggaacgagattcctagaatatagaacaaagctgcaatgtttaaaccatttttctaaacttttgtgtaattcagcattgaatctcctttctcatctttacctattgtaagtccagttaaaatgagggtagacgtggatggtgaactgaaagtagcaaagtagacagatgcaatggtgrctacaaatcccactttctgatttgaaatgtgggattgacagcagttgaaaaataaggattaggtctataataaactgtctttattaatgarctatagtttragtaattaacacaaattcagaataagtagtaccatttaatgrgtttatgtttttaacaagtacadtaattagaaaggcctcatgcacacttcctgggaagctagaatagctgatcatattctgctaatgcggagggaggttcccccaagaacaacagggacaatggcatgggaaaggctggacgtccttcctggctgatgttttacacctttcttcttgggttgattgtttttttcctatgtagaagatttccttggacttggccttcagaaaacctaaatttaaagttcagctttatcaggggagcctgggmgaatggttacattaacctctttgtggcctttgaaacatacatagaaaatatcaagggatagwtgtaaaaatgaggataaaaacatctaaagtgctaagtagaaagtaactgagtagaatggaagcctgtagagcaaaaaattagattgtggtttgagtgagtggtttatgcctgtaatccgagaaatttgggaggccaagatgggaggattgcttgagtccagaagttcaagaccagcctgggcaattagcaagaccctgtctctataaaaaattaaaaattagctggatgtggtggtgtgcacctgtagtcccaacratttggtaagctgaagagagaggatagcttgagcccaggaagctgaggctgcagtgagccacatcactccagccaaggtgacagatggagatgctgcctcaaaaaaataaagttagattgtatttgcatgaagggcatgtagttagcctacaggtatgatgctagtgcttatttaattttctgaaatcttttagaagaaggctgcttgtgccacrtggggtacctgtgttcttttggctgtggagtttgcrcaggaagaggtttggagatccaggagcctgaagtcagatgacaggtgccttgacctctgtggcatgtctctttggactctgtgaaagttatttaattgctgtggttttcyagaagaatatgaagataattgtaaggtgccacatgcactgcttggactcttacagttctgacagttattcctgacaaatttcaaaaccaaagtctgtttctacttgtaggatatttctaagatatcccctgagaaattaatgacaatggagaagcctcttgtttgccagaatttattgtagaatggaaataaatacagagtgatgagtgaaccagaaactgtaattaccctagaaatacatattctttttcttttcttttcttttcttttctttttttttttttgagacagagtgttgctctgtggcctaggctggagtgcagtggcacgatcttggcttactgcaacctctgcctcctgggttcaagtgattctcctgcctcagcatcccaagtagctgggattacaggtgtgtaccaccatgcctggcttatttttgtatgtttagtagagatggggtttcactgtgttggccaggctggtctcgacctcctgacctcaagtgatctgcgagctttagcctcccaaaatgttgggattacagacgtaagccaccacgcctggcccagaaacacatattctawaaaccaacttgaattagcagcagagatgtatatcccttagatatggtattttctttctttctttctctttctttctttctcttttctttctttctttctttctttctttctttctttctttctttctttctttctttctttctctttctctttctttctttctctctctctttctttctcttttctctctctctcctttttttttttttgacagcattttgctgtaatgcccaggctggagtgcaatggcatgatcttcactcactgcaacctctgcctcctgggttcaagcaattctcctgtctcagcctcccgagtagttgggactacaagtgcgtgccaccacgcccggctaatttttgtatttttagtagagacggggtttcaccatattggccaggctgttctcgaactcctgacctcaagtgatccacctgcctcagcctcccaaagtgctgggattacaagagtgagccaccgtgccgggccagatatggtattttcaatgtttcaaaatagtgcattgtgttctcacattttataatcctatttctgaaaaaacaatagtttgttaaccttgtagcttattccaaagaagcagctttggaggatttgcagaagtggagtcatgggagggcattttctgagctctatgggccctggtgattgtcagacactcagaggatcctttaaaagtttctaggactaggaatggaaagagagaggagccaggttaaggcaatcaggtggcgatggcaatgcccagtgcagttaagtgctttgttcctgtatttcctccagacttgctgtcaaacctggacaggagccgaggaggtgggaggcaagggccagtgcatgtagtggggttcaaattccagttctacccyttcctagaggaggacttgggcaaatggagtagctcctctgaggttctctgtccataatatagtgataagagggctttctggggggaaggtggtattcagtgaggggagacaactaaactattagcttatttctgtaaatgttctccagttccaggttggagaatgattcaagttagcaaaaatgatgaggaggttggaaagctccaatgaaaccatggtcagtgggtgataagtgtgtgttgcagtttgataacatgaaagactgaaamtgagagagagttgaaaaataagtctttagaaaaatagagtttagggactggaagcctcaatgaggtagaaaaccagggtggagtaaggaggaactgaaagcaaaagaaaagcacgtgtgtgacttgagagtgagatttccaaagtcagtttcagttaccacccaagcaatcactaacccttctaaaktgtcattatttcgtatattgatatggtattttattaattaatacactttttttttcaagatagagtttttctctgtcacctagrttgaagtgcaatactgtgatcatggcttactacagcctcagcttcccaaacgatccttctaatctcagcctsctgagtagctgggaccacaggaatgtgccatcttgcttgtctaactaaaaaaaaattttttattttagacatggagtctcactattttgcccaggctggtgtcaaactcctgggcccaaggaatttacttgttttggcctcctaaatccycttggattataggtatgagccactgtgcccagtctaagtagaattttaaaaatctccttttctaaagaaaattgmatttgttgatagtaaagttttaaaattgggamgttatattgaaatgtrtctggtgcaaccagtggagtttaaattatttttgaccaaaatggattctgaagaaatggtatggatagaaaacaaagaatgtaagttttatcttgaataaaaactagttttcagggtggggtgagtggaactgagggtagaaaagggtgagaaagcaaatataataattgtctcatctctataacatttaaagatttgattaagtgaaacaaagccccagctgctggagcagaggttccactygggttccacagacacccacagcccaaatccctggaggtcagtggggctcacagtgagtgtggggatgcttctaatagtgggtgtgctcagctgggagtgggtttggtttggtttggtttggttcaaaggcagcagaagtctgcatcttagctgtcttaatgtgaatgtgggrtcttgtgacagggtctcttctgtatcctgggggtggatctgcactctgcctgatggcytagctactttgccagaccctgcctgcttggtcttcaccaggttgctcctgctgtgtatgattacagccttgrcatgggactgcatttcccttgtttaatgttggtgctgggaagccctcttgcaaccactcctttaatatcctcctttctcctgggagaagctggagagagctacaggtcmtgaggtcctcctctgggagaagggagatggagagaaacaccagatacacctccatctcctgcagctgttttgagtttgatttcttattctatttgaaggaaattttttagaataacagatacatgtataataaacacattttcgaacgtaaagagggaaagtagsaatgggatggaagtgagaccactgaaattcactggctccatgtgggagctcagggccatagtgtcatcatctacaaatggcactgaagtttctcctgccattgatacaagtttgcagcagatgttatttctgcatcatttgcattttcagttatgatacttcacctctttctcagtatcacacacaattcagtgttgactatgatattctgaaaagcacacaggccgggcatggtggctcatgtctgtaatcccaatgcttttggaaggagaagcaggtggaycctcggtgccaggagtttgacaccagcctgggcaacaaagggagacctcagttcttttttttttgaggtggagtcttgctctgtcacccaggctggagtgcaatggtgcaatctcatctcactgcaacctccgcctcccgggttcaagccattctcctgcctcagcctcctaagtagctgggattacaggcacgcaccaccaccccctgctaatttttttaatttttttgtatttttagtagagacggggtttcaccatgttggttaggctggtctggaactcctgacctcgtgatgcgcctgcctcggcctcccaaagtgctgggattataggcrtgagccactgcgcctggccgagaccccatttctataaaaatttttaaaaattagccaggcatggtggtgcgttcctgtggtctcagctacttgggaggctgagrtgggaggatagcttgagcctgggaggttaaggctgctgtgagccatgatggctgcagtgagtcatgatggtgccagtgcactccagcctgaatgacagagtgagactctgtctcaaaaaaaaaaaaaaaaaaagcaagcaagcaagcacacagatgagtttagtagatggacattaaaggagttttaaccaactcttttatttcttctctctcttaaaaaactatatgttgctgacaagaaattatatttcttctgtcatgtagaatttttattttgctccataaatgtaatgacattgggatatcatggatctgttttctgtacacctacttatcacttaaataacttttgaatcatttttcaacttgtttctattatatccatcaagttatatgtggacagatgatttggtaacaaccaatgctggcacagaatgagtgctgtgcacaggtcatccattgaagtctgtctcctgtcatgtctttgtctctcaaaaggaaactgttttggaactcagtcatgtttagaattctcagtctcagtttaagcataagcctctcctatggatgtggctgaattttactctagatactatcccattcaattagccagtttaaaacaggccagtttattcaaagctaaaattacagctgcataaagaggtagtttggactctctatgtcaggaattgggttgttttttgtggtattcattgctatgttcaaataaatgaacctgaaaggtgtgactttttcatcactgcagatgcctcagtaatagggatatttaactggtagcacccagaataacagatgttcttctacactgagtttcttggctgtttaaaaagctactttataatacctctggtttacttgtttagaatctattttaataatattttgcattgtaagatgcttctggtctctgctctttttttcaggcctaaggcaatagctaattgagactatgcatcactattaaggcatcttcactaaagggcgctgtggaaacgctgcctgagatgcagacacctgtcagaagggggctaaatttcaaacaaggaacgtggtgttgcatcacaataaagtaagtgtccagagggaacttctgcagtactgtgttttccaacgtgctgagtgatattgtaggagactattattttgctggaatttctatgaatacatctatgaatacatttaaaataaaaagtgttttttgtttttttttttgagatggagtttcactcttattgcccaggctggagtgcaatggcgctcccttggctcacacaacctctgcctcctcggttcatgctattctcctacctcagcctcccgagtagctgggattacaggcatgagccaccacgcccagaaaattttttgtacttttagtagagacggggtttctccatgttggtcaggctggtctcgaactcctgacttcaggtgatctgcccaccttggcctcccaaagtgctgggattacaggtgtgagctactgtgcccagccaaaatgtgtttttttaatatttaattttgtggccaggagtctcacgcctgttatcccagcactttgggaggccgaggcgagtggatcacgaggtcaagagatcgagaccatcctggccaacatggtgaaaacctgtctctactaataatagaaaaattagctgggcatggtggcatgtgcctgtagtctcagctacttgggaggctgaggcaggagaatcacttgaacctgagaggcggaggtggcagtgagctgagattgcgccactgcactccagcctgaagacagagcaagactacgcctccaaaaaaataaaaaaaagaaagaaaaaattgttttggtacatagtaggtgtatatatttatgggatatgtgagatattatgatacagaaatgcaatgtgaaataagcacttcatggagaatggggtatccatcccctcaagcgtttatccattgagttacaaacaatcaaattacactctttaagttattttaacatataccattaagttattactgactatagttaccctgttgtgctatcaaatagttggtcttattcattctttctaattattttcttggtagtcaaaataaaatgtttatttttatgacttctttttttttttttttttttttttgagatggagtctcgctctgttgcccaggctggaatgcagtggcgtgatctcggctcactgcaacctctgcctcccgggttcacaccattctcctgcctcagcctcccgagtagctggggctacaggcgccaccgctaccacgcccggctaattttttgtatttttagtagatacggggtttcaccgtgttagccaggatggtctcgatctcctgacttcatgattcacatgcctcggcctcccaaagtgctgggattacaggtgagagtcactgcacccggcctccatataccagtgatagcagtgttttatttacagtaattataggttttttttttttttgagacagagtttcactcttgttgcccaggctggagtgcaatggtgtgatctcagctcactgcaacctccgcctcctgggtttaagcgattctcctgcctcagcctcccaagtagctgggattacagaggtgcctgccaccatgcctggctaattttttgtatttttagtagggacggggtttcgcgatgttggccagcctggtctcgaactcctgacctcaagtattctgcccgcctctgcctcccaaagtgctgggattacaggcgtgaaccaccacgcgcggcctcaaactcatatttgaaatttagagagattgccaagaccctagagttttgcatgttctcacaaattgatttcgttagttcaaatttcataccactttttctaactgatgattcttacaccttgacaggtgactgagttcaatatgattagagctgaaccatttcaaaaagcagcacaagtggcgactgccagtaaccgataataaccgagtttaatccccctcttctgctccttccctctgatggaattctcattttccctggcctcccccattgacattcatccaatgcccatgctgctggatcagtcttcctggagccatatctaacttagaaagatgaaggacttccaaccttttgggagatgacaatgtgttatcaaaatcaacaaactaatagattgacttcctttgcatatttttgcaatgttctgtgagatatcaagtcacttccctggtagtttcttattcagtatttcactgtactgctttaaaaaaaaaaaaaagtcaggcctcaaccctaacagagtcacttggagatcttgttaaaaagttgagtttagagtctgatacaggttttgagatggccctgagaacttaggttttttcataggctctctgggcaacttttatggggcagaggtttagaaagctaggagtaagctgccaggtatcaggaaaccactagatggcagggccatcccttggagccygttcttcaatcaagaaagtggtcagagaggaaagtggagtggggaagagtccaagtacacatgttaaatgcacgttaataagtggatggtgaagatgagcttaggtgttgggtcctagcgggagagtgggaaggattcctgtcacttctcacctctttctagctttatctccagtatttgaaatgcctggaggatccttaactgaaactctccactagtcaactgtgctgtactatagcacaaccactttaaaaaggtgaaagtaggaaaactagctcaatgagagggctaatatttttatggggccaatgatttgaattggtagacatatatgccytcctacatgatataggagatagagtgcaaaaatcaaaccaaagtgttttttcctaccctcactcaccacacactactcctcacatgccvagcaagcaagcaagcaatttttctgcagattctgcagtgcacaccagctgggtgtcctctaattcaactcaactcttacactagctatctagagatactgtcagatcccacaggttaagggctcagtcccacaagactgtcccccacttcagaggccwgttataagactgaattgccagaacttctgatccactggctacaaattggggctcccaagaccctgcccaggggttcaattaatttgttacagtggctcacagagctcagggcaatactttacttacatttactggtttattagttagagatataataaaggatgcagatgaacagccagatggaaagatactcagggagctatctggaatggtcccagcactggagctcctgtccctgtggagttagggtgcacacactcccagcatgtggatgtatttgcaaacctggaacctctctgaaccctgtccttttggttttatagaagctttaatttgtaggcatgattgattacatcactggccgttagtgatcractccattttcagccctcctccctatctgctggttatggggtggagctgaaaatcctaactttccaatccagccttggtttttactgtgacccactcctaacctgaagctatccaggggccctcagctaccagtcacctcattaacatataaaggattatatgctaattatatagtatatattattatgttatataataatataatatatatatctataattacatgctatattatatatgctatctagtaatatagttagcatacactcctttatatgctaatatataattatgctatataattagcgtatacactctaaacactccttagattccaaggattttaggagctttatgccaggaaaagataaggaagaccaaatgtatatttcacaaaaatcacaccttctaagtgtatgacactttctaagaaattagcagacattacaaatcagatataaaacagatattaccatcccatgaggcttttttttgaaatgtgcatttccccctaaaaccaggaagtggcataatggagatgagagctcagatctcttgcttttctccttagtggtcactgaggtcactaagtgtcttggtgtgccactaacatttagataaagacaggtgtgtaagaccaaaactgtatctttctctttttaagccacttgaattatttttgatgtctgaatttttcaaaattccaacctaatttgtgctgtcttcaaaacagtcttattattggaactatcactgtgaatgaacattacactctaacagtggtatgttatatgaaatggtaccatttagtccttaaaattgattggaaaacagtgattggggarcatttaaatatattttaaaagtgagagaagtaacaattaatgctatactttttttaataaggagagtatattttcattgtaagtatctattaatgattgaaatgttcagaggaactactgaattcatcatctgtgtttagatgaagcaaagacgaaacccccttaacagttactcagttttttgattacccttgctggcgacttgaggaaagagtggataaaaactgccactgccagctgggtgcggtggctcactcctgtaatcccagcattttgggaggccaaggcgggcggatcatgaggtcaggagttcgaggccagcctggccaatatggcaaaaccctgtctccactaaaaatacaaaaattagctgggcatggtggcaggcgcctgtaatcctagctatttgggaggttgagttaggagaatcgcttgaacccgggaggcggaggttgtagtgagctgagattgtgccattgcaaacaaaacaaaacaaaacaaaacctgccactgccaatctggagttggagttatcaaaactgatgatatctggaagagggcagaagatgttaccatctgcaagtttaggatgctgaagaagtggcaagaaaaggatcagagccttgccacagcccagaatttatgtaagtgcttgaaagacatcatctctcttgaagtccaagatgtgttggaaggtgagcagaaaattatatcttagttatttgtctggaatcaagctgtgtctttgggaatagytatagaacatgtggcttggttatttataagcttgggttcagagagttatgcaaatgcaaaagcargcaaggggctgctgtcctcttagtaaggatggtgtgtgcagctgagtcagaggaagggttggaagcccagccccagtgctgccctagctttgggactgtaagtaaaatctcaacctaacttgaagcctctctgttcccatctgtgaaatgggttcagaccctcctatgtcctgggctgtggtgagaatgaaaggagaccatgcatgtcaagatccaggcaggtggtctggctcagtaagggagcagtcatgtcaccctggtacttaaggcagggctggtagcattgagccttctgggccttctgtggcactgaagcaggggtcatgggggccactgggtggcgccagcaatattcaaccagcaaagagggcaagggagaaagcagagcccagggagggctggaggggatcgttcctggtgttgatccagaaaaccacagggttccttgtcttggttttcaagcacttctaattttgtatgtgtgtggatggatgtagcacattgtcataactgagctcaaatcaattcaagactttgattattatatgttgttactacaacgaatatagtgttttttttttctaagaatcctcagtaattcagagagaggttttatttaaaattctatttagatttttttattcctggccgggcgcggtggctcatgcctgtaatcccagcactttggaaggccgaggcaggcagaccacgaggtcaggagatcaagaccatcctggccaacatggtgaaaccccgtctctactaaaagtacaaaaattarctgggcatggtggcatgtgcctgtaaccccagctactcaggaggctgaggcaggagaatcgcttgaaccagggagtcagaagttgcagtgagccgatatcacgccaccacactccagcctgatgacagagcgaggctccgtctcaaaaaaaataagtacataaacaccccagaaggttatatcagaagtcaaagtactatgatctctctgcatgcttttcagacatggtgagcgagcgttctgaacccycgggcccactttgcctggaggaccactgaggttttctactctctagtcttggggtgctgaagcctcaagagattagaaacaaatgcaattctctcccacctagcaatttgggatgcaagctcaaaggtgagctcctcatcccctggagaagtacaactggccamacactacttttcttggactttcacrgtggaattatttacttttcatggggaagaatgctactcagagatagctttcacagaaccaagggaaagmtgtcttcttttcttgaaaaagacttgcctcaggaaataatgggcctcattggctsctgctaattggtgaaatgtktttkttttttttttttggtctgtgtagatattgtcactacttcagcatcatgagtgtggtgggtgattaatattctggatatattttacattatttgatccataaattcataaatcatggatgatgagaagaaaaggaagtctgctttttgacactgctcttctttgtattatttacttacaggtcctgttttaaagcatcctattccttggytgtctttcctttggctctttggcaatagttggttttgatcccagctctttggctcctgggccaaggctgagtgagtgccagacagggtaaactagttcaccaggtgttcacacaggttcaggacaacctgcattgtccccacagcccttttgccacaggaataattatggttttctcccttccaaggatgggaaggtgtgtttttatttaaaaccaggcagattcctaatacttcctcatttgtgcatttctcttgacaagggatttttctgcacataatgactctcatttggtccttttgctgtattcctttcggggaaaagtttcctcccgctgctttttcatgagaaagcacgcttcactccattctctaaagagaacacagcagttgctgaatttttaatttgttcccatgagaatcgtggtttccagcagtcagcctaggccactacccgttttctggaagtccttcttagggtgaaccagcacactgcttgctgaagagcttgatcccagggattcactgctggaatcatgtgtttttggttgacaggtgttctcagcctccctgtctatatgtcaggatttgagaagtcctgatcctggctctgcagccgctgatgctaacacggaggccctggggttaaattctaggctctgagttttgagatttctcctgcttcttaagtgagacctccatttccaccctggagcccactgtagatttagacctaatttgttctggtcctgatgtaagtcctcagttaggaagtctagagttagtcagccacctttattctttgcaatcccattcttgctgttttctgtaacctctagcacaagtttccttttcagaagggaagacgctctatgcatttatagcagtgttttcttttcgagcaagcctggaaatcaacaggtggttccattataaaaacaactggagagaggggcttagagtaattcagcaagttttcatttttccttacccacgaaaaccttttgtgaaaggaaatcttacctggaacacgcactggtaaaatattcaaaagtggagctgctgtggtggggtcattgaggggagagggatttcgagggcttaccgaggagccctgcagggcctctgacttgctcctggyagggtagcttggaaaccagcagatcaggtcattatttggatttcttgaagctgtggtgcaggaatgtgtttctaagacatctgcaacctaatgggaagtaaaacactttcccacccctaggtgtggaatatttattggcacgttgtttctgaagcatagacatatactcagaccacaggtatttaaattatgttaactaaatcaaaacgtttatgaatttggatttttccccattatgaacatgtataattattttgaactaagtaagcatatgcattttcaattttttaactctttatttttataattgtgaataagtttctttcaaagactagagacttattttttaaattttatttttatttatgtattttttgagacggagtcttgctctgtcacccaggctggagtgcagtggcacgatctcagctcactgcaacctctgcctcctgggttcaagcaattccctgcctcagcctgctgagtagctgggactacaggcgcacaccaccacacctggctaatttttgtagttttagtagagacagggtttcaccatgttggccaggctggtctcgaactcctgacctcaggtggtccgcccacctcggccccccaaagtgctgggattacaggcatgagccaccacacctggctgagacttctttatttctatctagattaggaaaagacatgagaattgtgggggctcatgaagattccctttgtttctgtatcatttttaagttcctggggctgggaacacaaatacgtgggtaatactacattgcctatatctgaggttcccacagtttagcaagagagagaagggagatacataaataattgggatgatatttatatggttatagggaaagcattcccttgacttagacagtgacttcaacatgagcatagctgctggcacaggctgagaccaggccacttaaaatgttaattatgtgagcttacataatcttattatttattatttttattttttgtagagatggggattttgccatgttgcccaggctggtcttgaactcctgggctcaagcaatccttcatctcggccttccaaaatgctgggattacaggcatgagtcaccgcacctggtcaacttcaataattttcttcactttccacatccataaaaagggttattaggatggttatgtttatttgtggtaaactcttaggaacatgcctggcatttaggaagcacaaytgagcagttgctactactttttttttgtctaaaacagattccattaatatactgtttttgatattacatagatctaattcatactcatatttttaatgtaaaattgaaagatacataaatataactaaagtttttgtgcctgttctcaccacatatatttcaaaacatttatacgcatcctatttcacttttttaaataaaatatttcaagtacatagaattcaatttttggacaatgcggccatatttttttcttacttatcatattgtaatgcagtttgctttaaactaggaagccaaattatgctagccagaaccaaaagtattttttaatttttaatttttttttttagatggaatctcgctctgttgccaggctggagtgcagtggtgcgatatcggctcactgcaacctccgcctcctgggttcaagcaattctcctgcctcagcctcctgagtagctgggactacaggcacacaccaccatgcccaactaatttttgtatttttagtagagacagggtttcactatgttggccaggatagtcttgatctcttgaccttgtgatccgcccgctttggcctcccaaagtgctaggattacaggtgtgagccaccgcrcccggcccaaaatgtttagtcctcaaataaggataataactgaatggcccagtgtgacacagagaagaggacttatgatggctgtgggtgctggcccccaacaaagctggtgttcttttctttttgtctgtagtttcttatcctcctttgggtgtctaagggtcttttacayctcttgagtttttcaatactyacctttggatgtctggccagaccatgtcctagaactgttctgtcttcccaaagtcctggacctttaatggggcagckgacaactaaatatttttcatgttaattctctgatttagtcattcttaggtgtgagatacactttcaaggtttagtttcttttgaataaagtagtttgttaatcaaacgaatctccaattgactggggggtatttttagggggatggtccttggttttgataagttactttgctcctggcctggctcagtggctcatgcctgcaatcccagcactttgagaggccgaggtgggtggatcacctgaggctaggagtttgagaccagcttagccagcatggtgaaaccctgtctctaaaaatacaaaaattatctaggtatggtggtggacacgtgtaatcccagctactcaggaggcggaggcaggagaatcgcttgaacctggagggtggaggttgcagtgagccgaatcgcgccactgcactctagcttgggtgacaagtgaaactccgtctcaaaaaaaaaaaaaagttactttgctctccaccctttgttcttggaaggcagagaccctgccttttgccctcatacttcacaccaggcagccgcttgtgccgaccacacttaatatgctgagtgccatgggggacagcacatcagcgggtgttckgatgtcttgtgagaactgtgacaaatttatgttgagtaataactaggtgytggcastgtattgtgtcatttaatcttcacaataacacagttaattaggtcccaccgttttctgaatttcatcaatgaggaaatagcagcaaagaggaggtaamaaattyggtgcaggtgcttagcccaaagactaataatacatttcaaaatgtgcttacatttattgtgcacttactatgtgccaggtgcaacgctagccctttgcacgagttgttccattttaccctttctctgatcctttkaggtagattctagtattaccttcctttttcagaagaggagaccaatggggagcattggaatgatttggttgcaagcatactacacwacttgtaaactgcagrcacaggcttaaaaaaagtgaaaaactaaccatgcaataaagaatggaatgaaccatgaagctgtttctgtggccagtcatgtttttgaagcatatcccatgctaatttctagaacagaagaaacacacgtgttcttgtgtgtaaacccagtccatggaagagaccgtctgcttgtccctcctgatctctgggcccagacaaccagtagtcaccattccaagtgaggggtggctgcaactctacagccccgttcgtctctcctcactgtcaaagctgctgagaccccagactcracacttgaaagaaacccatgtctgtgaagcacttgtggaccattcaagattgtggaagaatcactcaagagaaggagataggtgatgggatctagcttctgatggtttctattttattgaatgtctaatagggcaagaatttgaaaaacgagaatgtttgycatgcaggaggacctgggaaggagataacacatttacagggagaaagattgggattcagttgggaggagtaactgaggaaaggggtcactcaaaatattttgtattttaggtcctttttctattaaggaggaatggattrtcaaagccttaacattaaattgtaytgtgtcaggtgaattgctatggtttgaatgtggtgtgtccccctcccaaactcacattgaatttttttttttttttttgagacggagtctcgctctgttgcccaggctggagtgcagtggtgcgatctyggctcactacaagctctgcctcccgggttcaagagattctcctgcctcagcctcccgagtagctgggattacagatgttcgtcaccacacctggctaatttttgtatttttaatagagatggggtttcactatgttggctaggctggtctcaaactcccgacatcaggtgatccacccacctcggcctcccaaagtgctgggattagaggagtgagccactgcacccmgcctcacgttgaggtttaattgccattgtaacagtataaagatgtgggacctttacgaggtgattaggcaatgaggactctgccctcatgaatggattaatgctgttatcatgggagtggattccttataaagggacacgttcagcacccccttgctctctctctcaccttccgccatatgatgatggggcacaaaggccatcatcagatgttggccccttgttctygaacttcccaacctccagagcagtaaaaaaataaatcactgttctttacaaatggcccagtctcagatattctgttacagcagtacaaaatgaactaagtcatgaaacctaagatttacatgatttacagcagtggtccgcaaccttttgggcagcaggggctggttttgtggaagacaatttttccacagacccggggggcrgggggcaaagatagtttcgggatgaaactgttccacctcrtattatcaggcrttacttagattcttataaggagcatgcagcctagatcccttgcatgtgtagttcacaatagggttcacactcctatgagaatctaatgctgccactgatctgacaggaggcggagctcaggtggtaatacttgctcacckgccactcacctactgctgtggggcccactgcccaacaggccacagaccagtaccacwccatggcctggggatcggggactcctggtttagagaattaaaaagatggaatttaacatttagctcattaagagcacatctcttaagccaaagtaaggcaattatccatgtggttcaggcaaaagttctatacagttttaaacaaatggagagattttctggttgcaaattagagacaacttttctctcagagcccaaagggtcacaaaaattagaataattaggctagaaggcctcttagtgacattttttttctggttgaagaatactatgaagtatttttctaatgcacagcatacttttagtcttatgttgaacaaaaataataaaccctcaaaaaccatgactcacttggctgccttagtagtaaagcatatcttgtcttactagggtccctttaaaatgagatgaaagggactaggaaaggaataagaatattgtggcattctttccagagtaattttgttgaagtctcatcagagttttcaattttcccacaatgtrtattttaacacttaaaagtacattagaaaaattgcagaatcactttaattcaatacttttatttttagaacacttaaaaatatttttcaaatacacttgataaataatttaataaatataacataaataaatataagttagctcagatgctttcatgattaccaagttatataaataaatattttaaaataagttatgcttacatgtttgtttccacaaacactttggtacagaaatagcttataaatatttgcccttctattaaagtgaatgaaaaacaccttcaggatggatattttcccttcttagcaattcattcatgaaaacttaaaaacaatttatccacagtaaatgtcaaaaatacttgatcagaggtatyatgtggatgtaatrgtcccatccttctttycccctccctagttcttaatccacatcctatcaaagtttcctcatttcaaagttttataaaaatgacaacggtttggagggacctcgctttttaggaagcattcagatagctcrtcactctrtcaatagtcactgcccgaattctgaaagcatgaagaagtatgcagagcttgattttagttttataaaaatccggttcttcaagggaggatttttgtggcayagtctcactgttgaaattcagggcctaggagaatgaacagtaagcatgacttacatggtattccaaaattcaaatattcattcataaaaatgagtgaagccagtacatgtctcagagcctgcaactcrgtcccttatgccactcctaaacccaatccaaatctactctcagccagatcaccaggcagaatgagaaaagaaatactcattttccaagcacatscatcttcaatgagctctgaaaagacccttaaaactatttagaaaaaatcatcagtgggagttgtgtcttagaaagaaacagttcctttaaaatgacatctgctgcaatatctaattaattttatatatgttacattaaaaagcccacttctgtttagcacagggaggtgatggattgctattgatcagaactcactatcagtaacaggcctgtttactgaagacatgccatttgtgtcagataaacctggcaatgaatttcccaagtttagcactttgatttgataacagaatataaaaccttacatttgcacccttgatgaataaatactttcatatcttcctcacaaaaagtctaaaagaaagctagaataaagtcaccccattttatactggaggaaactgaggcacagagggkttaagtgacttgggaatagttgtctggttactggtagaattgattctagcacccaaatcacccaactcttggtcctaaaaatgaaatagcaactacagctctctagatgctaacattctttgatacttggatgaagctcattgcctttcaaacaagaaatctggcacatgcacacacacacacacacacacacacacacacacacamacacacgaaaagaataaaagtaaaacaattacttttcagacaatgatttctgccaccatatttttatcccatgtcctcgtcaccaaagcagtcaccctcrcttatataaatatttgttttatattagcatctgtgttatggtrattcagaacataacaaagcaagttcttgcctatgaataacattatagatgccccagatgataggtcattcttttatttggttcacattttggttcacaatgggtcataatcaggcaccaatcttgcttgtttcccagcaatatttgcagatatgcaaactggccccttgcakgcamatcctggagcacgtcctggagcctttagaggtgagtgagaaggtaagtgtagtgaaatcctcttgaaggattttaagaggcagagcctcagacaagtggtttaactctcctaaggtttggttccctcctttgtgcagatcccatatggttgytttgaggctgacataagaaaatgcacaaaaacatttgccgagtgtgggggataccacagagtgaatactttggagtctgcttttcataatgtgatctgctcacatttgtgctccctatagacggcaccctcaaggctgtcttcttgaaaatgtaggtctgtcaggcctttaaaaggcctccagacctctttttrtatctctttatcaaagaccctggctggttatctttagcatgaaaaaggtgctctcactgatagaatgaagtcttacctgcatcagctcatcaataactgccagcatgttttgatcyagaaagatctgcctcttaggatccatcagaagctttgcattcatggtcttgaactccacctggtacatcttcaagtcttcataaatactactaaggcacagggcctgggtgacatgacaagatggggaagtatccattgagatgggctaaaaacatttcccccattgcatttgaggaaagagctgtgtgtcttaccatcataaaagaggtctttctggaggccaggcaactcccattctagaggaaaaaataatcagacatcagtgatatgaattcatcatacaggctgaaacttttcattttttgacttacagttatgaaagaggtctctctggaatttaggcaactctcattctagagggaaaaaatcatatatcaaagtattaattcttagtataaatctttctgactcttcaggtctcaaattttttttattatggtaaaaacacatatcataatatttagcatctgaactatttttaagtgttaagtgtattcacattgttgcaaaaaaaaccattttttaaaaataatttttctcccaaatctaacttctgaagtaggaccagttaaaatcccataatgatggataccagaaaygtgaatttytagaagcaggtgagatttgatgcacagtttttaaccacactgcatgctctgggaggaaaatcctttataccttggttaattccaatggtaaacaggcctccactgtgctggttttatcttttgtgatatcttcatgatcaatctcttcagaagtgcaagggtaaaattctagagtttgtctggcctataaaaaatgaaggagaaactcagtttataacattgataatgcacctggcaccccacaaggctggtaagccagggtgccaggaaggctccggctggctgcccttgacctctgtcactttgacttgcaggaaattctggttcttcataatacaaaagaaaatagattccttacattctgtctctcaccctcctctccctaagcttggggcatgtttctctggattacatattttttcattatgtaaacacaataaatcatgtcaacagcctgtgctaaccagcctcyacacctcactgtgacacttgcttctggtgaaaattgtttcttcttttgctaaagtgactgtattctatgaatacctatttcaagtataacttctaaagggggaactgttaaggtcacagtytgatggatataacaaacatgcaaacccttaagacaagctgagatttaatttgcagtgcacasacrcacacacatacacagagatgtcatcttagtgtgttggaaagcaccgttgggtaaaattatgaaatgtatcttaggaagtaaaggactgtatgattgaagattacgatcatttttccattcaacagcctaatgggtggcaggcactccattaggtactaagaacatgacagagaagaggaccatgtataccctcctggattgcaagtttagctgctgagacagacaaktgcccaaatgaccaggaggcatcagtaggtgagacatggtgagaagggcatgaagcttctgaggaggggcaggaagggaagcaaagcttcctagagwtgggacacccacattaagaggagtaaagtgtcgacaatggaggagggaaatttcagacagaggtaacagcatgagccaagaagcaaggcctgaaaattcagaatacgtttgggcacaagtagtaaaatccctttctgtggtagctagaccaattctccacctccaaagacatccayctcccaatccctggaacccggtaatgagctatgtgacctgccaaagaggaatgaaggtgcagatgacattcaatttgctaatcagctgatctaagagtagagagatgatcctggattatctgggtgaatccagtgtaagcagtgwcctcaaaagtagaagcrggtagaaggtcrgtccagagggagcagcatgagaaagactcaaccagacattgctggtatggacaatggaaggggccacaagtcaaggaatgtgggcagcctctagacctgacaaagcaaggcaacagattctccccaagagcctccagaaagggctacagctctgctgacacattgactttagcccagtaggacccattttggacttctgatgcccagagctgtaagataataaatttgtgtcatttaaacccactacatttgtgacagcagcagtaggaaatgaatacactattcccggaggtgtttaaacagacctgggcaaccccactattctgagcaggttataaagagttagatttggaggtgtgagtccagtgttgttcttcagatcttttcaagagaagctagaattttgaaatcttaattgaaatgtttggtttttgaatggcatcaaactaaaaaataaacatatagcccaaattctacaaacctgtgccctggatatggccggtgaatcacttgcatctacctcatttgttttctactacagcaaatttgacaaatgatgtacaaaacattaaattgatttctataatcttttgacccttaggactatatctgggagtaggggtgtcagcttttgcacaaaaaaatctatatgaattggrgcacctaaaagttacccattttgaacctttcttcgggaaacaaagcagttttcacttgagccccctgtccaattaagattaattgaattgtgaggagcaatgcacagcacattatgaaagattgaaaggggaaaggagccctttaagaaggcttggtggcattgagyttattttaagatattcctaaggcaacaagctagaaaatactcaagaaaaaattcctagagagcagaaaggcagaggacatcttttaaaacattagcctttagcctttgcagcagtagctactggagcagtttttaacggcaatgttttttacattaaaatatgaaacctaaaagaacgaagctgtaaataaaattaggtaactcttccctagaaaatgaaggctgcatgtgcactgtcatagtcctccctgagatgtgttgctccaagaaggaactgtgtcaccaagtagaagctggtgggcagcaggagggacaaggctatttcatctttgtacccctgccccccaacacagagtatgcacccaagtaactatttccgggattgatcagtggtgtggtgccagagaaaccatgtggacctgacacaattctatctctgttggcaggctacaggaacactgcaaatatccactttactcagtgtagacatagccaaaaccaacatcattataatttattactactcttgctttctctggagacacaatttcactaggactctttaacacttgggccatttgtaaagttccctctcctgctgttgacagctgctaatgaacttccacaatttctctgcagttccatcaggtaccagaggggaggatcagaggccccttcctcagggagggtgcaggtccacagtggagasgacaggaaaggctcaccttctggagcatgttgctgacggccctcagcaggttttgggagtggtgaaggcatgggaacattcctgggtctggagtggccacggggaggtttctggccaaactgaggtggtccaggaggaccagggtagccacaaggaggaggcctggaaggaagaggagcaggtggaggagcttcagcctggatggcctgcctgcaccaccttccctccattctggccaccttcacccatccattcatgcttggcacccacctccctcaacccatttccaacacttttccttcaacacctgagagatgactcgagttattacaaagcrccactctattctagggctagaagccagctccctgtgagggtctagagatgagcttggacaagggtgttgaacccaacactcacccagagaaagcctacatgtttttgatcagggaaacccagaccaggtggtgaagtggctgagtcagacttgggacccagtgttttaaaaacagtggagtgagaaagcctgactttttttgtttttttaagacggagtctcactctgtggcccagactggagtgcagtggcacgatttyggctcactgcaacctccacctccgagttcaagcaattttccctgccttagactccsgagtagatgggattacaggcacccaccaccacactcggctaatttgtgtatttgttastagagacggggtttcaccatgttggtcaggctggtcttgaactcctgacctcaggagatctgtccgccttggcctcccaaagtgctgggattacaggcgtgagccattgcacccggccaagcctgactttagaactggctaggatctgccttctgtttgtagctgagggaccctaggcaggaaagcaggaaatctcccacgctgggcctcagtttctcctctacgaagtgggcataatgatagctcatcaggctgtttcgagatgaaaagagacatgccctatttagcacacggtgagacccctattcttattcctctttgcaggagacggctgctgctgttccagtctctccttaggcagacttgagtttctacccactcttcccaagcagccgcccctccgcacccgagcgagccaaagacctggcgggctgagtactcactgcgcgctggacacatgctgagccggcactgcagggacacagggcgagccgctggatgcagacctgtggccgcggcaggtgagggcggtggctgggaggctgacccagggggccacatttttataattgtcccgaggcgcggcaggactttcccgggactctggtctcttgctttctgtctccttctgtgtctctctctacatcagcttctcggtgacacgtgcggtgcggccggcccgcggggcttgcggcgctttcggattaactcccggggtgcccggccgcagccgttccgggacggccccgccgcctccagctcggcccaaaatgaaagcgaaatgttcgcagttactgcgcggggtccacaggcgggcgggacaccccgcccaccaccctgggtccccggccttagccggacgccccgtgtctaagctaccccgccccgcagctgtgcagcgccccctgccgacgtagagagaggagtgcctcccactttgcatgtcctgcgtagggatgggccctaaccacgacctccagcctagtactggaaggggtaggcaaatcattcactcatcatcgttcctttagatggctcactagatgccaggccgacgttgcaccaggtgcaggacacccagggagaacaggacccttggggcattgccacactaaatcagactcaaggcgttttgttcacaggtcttttctgaaacctgaaaagggatgagagctggctgactctgcaattattactcttgtagagaatccagtttaacgataggatgaatacacagagtcctgggaggaaagacctagagaaagagcccacgctcagccggagcaacggggtccaggagtcagcaaaggctcccgggagcaggcaggggccccaacctgagtgttaaaaacaagcaggcattagaccgcttccagcgggagggcacgcagggtctagccaggggaaacagggatcagaagcgcagtcatgaagggttgagggaggtgggggtctaggtgtccttgcagggtgtgaggctggagggctggatggggccatgccatgagggcaggggatgccatactaaggagtgtactttctgtgctgagagtagtggggagtcttcctgggttttaggcgggagatgtggcagaatttgcatgatggggggatcccttcagccacagcatgaaggatggatccaggggtcaggagtagagcagagggaagagttgacaaggtgtggccaagtccttattcagtatggagaacacagggtgggcaggagggactctcagagggcttgtgggccaaggcttggtagctcctcaggtgagcgggagaggaaggccctgagaatggggaatggagattgttctagctttacagggattactgtataagaggactgagtttggaggagatggtgagaagttccattttggatgtgctgggtttgaggttcctgtgggactttttagttcagttgtttttcccacaggcattagtcaccctaggcgtgggtagtggggaggatgtgtttgatctctgacttggagcttccaaagggcctgactacacccaggccctaggacctaataactggagctgccttctgggtggctcatctgctcgaagctgatgaagcacggctgtagggagttttaggtgtgtgtaaaataagagaaatggttgatctctaaggccccttctaatgctgctgtctgagaattcccccacgggatacagagtaatccattgtcagaaacaattgcgtttagcagtttgtctagagcaaatgacaggtgcagagctgtgttgtggccacaagggtttagtgtggagttaaatgtacttaaagtcaggatgaagacaagtgtatcacaactgagctgtttctcccctggaagggccatctcctatacaaaagtaatttctgttgcttagatgagcacagggccactgttaaaaatggattattggctaccagacacagtttctaatttacatttttgtgaaatagtttcctgaagtgctccatgtcctctagctaagatgaaatgaaaaccttcttctaggaatacatgatttttctataagtgacagtcttagctcacaatcactacttcacagtgtgtagcattgtcgtggaggtctcggccaatgctataaggaaagaaaaagaaatgagagctttaaacattggaaaagaaaaggtaaaactgtcactttttacagttgatatacaaaaagaaaaaaaattaatagactattagaactaagaagagaatttaacaacatcatgcaatacacatatcaacttaaaaaaaatcagccgattttctttgtatctgcaacaatccatcagaaaatgtaataaaaacaagatgacatgcatagaagcagccaaactataaagtaactgactgtagatacagaggcagtataatggctaagagtatggactaaactatgttaatccaggttctgctacttacttgctgtgtgttcttaggtgagttatttatctctctgggctcagtttcctcatctgttaaatgatgataataaaagtacctacagtatagagttattatgattattacatgagcttggataactacagaatagtgtttggagaaaaattttaaagttcagtcaagaatatagtgtgatttaattaaataattctatacccttgggtggaaggtttctctatatagaaagcttaagcctcttttcgttaattcacatgctcaatgtaattccaatacaagctacaaataaattttctcagaaacttaataataagcctactctaaaatacagatgtaataaaatctatgactaagttaaaaaaattttttttgagacatggttttactgtatcacccaggctggagtgtagtggtggcacagtcacagctcactgcagccttgacctcctgggctaaagtgatcctcccacttcagcctcctgagtagcttggaccacaggcaacaccatcatgtccagctaatttttatttttgtattttgtagagacggagtctagttttgttgcctaggctggtctcaaactcctgggctcaagtgatccacccaccttggcctcccaaagtgctgggattacaggcgtgagctgctgttcctggccttaagtaaaaatgctaagggaataatgaaaagggggactaaccctatcacatatggacataatttaaagccatagaaattaaagtagtgatctttgcaacagatcaggcatatggaccattgaaacagagtagagaaattatagatagatttgtatatttgggtattaagtataagataatacagatgattccctgatcaatgaggaaaacatgcaatatttagtagaaaatactcaatgggctgggcataatggctcacacctgtaatcccagcactttgggaggtcaaggcaggagaattgcttgaggtcagtagttcaaggccagtctgagcaaaaactccctacaaaaaatttttttaaaaagagaaaatgttcagcgtatgatgaaaaataaaactggactccaatctaaaacaacagaggtgaatccatttggaagtgaattaaagaccaaatgtgaaaagtaaaattgttacagtagtagaagaaaatatagaggactgtctttgtcacttataagtgggaaggacttttttaaaacttctaaagctccaaaccataaggcaaaatacctatcaattggattacataaaaatgaagatttctgttttacacatttcctctatgcatgaaccaaatgaacagacagctgacagattgagagaagatatttttcagtgtctaaaaccaatattttcaatgtctaaaaacaaggaactcttgtaagtcagcaagaaaaagacagaaacactagtaaaaaatgcgtaaagctcatgaataagcaatttaacgagaagaaaccccaaagactaatgagcatacctggaggctcagttatatcagaaaatgcaaatgaaaaaaagaatgagatatctctttacacctcttagactgacaagttgagaacactggatactggtaagtgttgggaaaatgggggactacaggatctattatatcacaccatgccagtaggctgacatggctgttttgaagggtattctggcattccttgaccagattaagtatattcacacccatgacccagctgttaaccctgggtgtatatcctatggagattctcatacaggtccacaaaggaacatgtatgaggatgttcattaagtcattgtttgtagtgatggggaactggaggcaatgtagctgctcattactgggggagtgggtgagtggaatgtagggatccacttcatggagtattctacggcagttagaagtaatagactagatgtacatgcagtaacatggatatgtattaaaaatataatactgagtaaaaacaggaaaacagagtaagatctctctctataatgtataagtagacaattaaaaccctttggggctgggcacagtggctcatgcctgtaatccaagcactttgggaagccaaggaaagtggattgcttgaacccaggagtttgagaccagcctgggcaacatagggattccccatctccacaaaaaatacaaaaattagtcaggcatggtggcacatgcctgtactcccacctaccaagtaggctgaggtgggaggatcacctgagcccggaaggtcaaggctatagtgagccatgattgtgtcactgtactctaacctgggcaacagagtgagaccctgtctcacttaaaagaaaagaaaaaggaaagaaagaaaaagaaaaaaatgggggggctcagatttgtttttggaattcaaaatgcttggaatttagaaaaggaagaggtggcatcgcataatcaagcataatagttccgcagcaaaacataggaatagttacattgagtggctaaagaaccccaagtaaccccttgtcgcttcagtcagatttcgctgttaagaatttaagagaaaacttctggtgtccagagctgtgtaagtttaagaattgtgagtaagtgattgcggaactctattgacttaaatgagaatgatatattcaaaatagtacacattatacaaagacacagacaaaaggatatatattagtaggatagatcccactggggagtgaggggaatgagaatgaggactagtgataatgaaaatatataaatacatttagatatttgtatttgatggggacaaataacgtcatggattaaagaatatggtccactccatcctcttcatcagaagtcctttgtccaaaagacagatagacaccttctgtaagcagatgactcaaggtcattgtttgcaaacttcaattgctatttggtacattcaggtagttttttgttttgttttgttttgttttcgagacggagtctcactctgtcgcccaggctggagtgcagtggctcaatcttggctcactgcaagctttgcctcccaggttcatgccattctcctgcctcagcctcccgagcagctgggactacaggcggctgccaccacacctggctaattttcttgtatttttagtagagacagggtttcaccgtgttacccaggttggtctttatctcctgacctcgtgatctgcctgccttggcctcccaaagtgctgggaattcaggtagcttttattgttagttattcctttcccattcggtttgagctatgagtcaatcaggcattttcatcactgagagacaagggtcttttcaaaaatttgacagaatatattaaagatctatttctgtggttctcagttggagatggccttgctccccaggggacacttggcaatgtgtggagacattttgagttgtcataattggaggaagggggttgccactggcatctagtgggtagaagaatgttgctaaatg

SEQ ID NO: 17622 - DNA, 44763 bp, Homo sapiens
  misc_feature (1)...(44763): n = A,T,C or G, or insertion/deletion polymorphism (see Tables 1-2)
tccctgtctgacaactttgaagagagtagtggttctcccagcacgcagctggagatctgcgaatgtgcagactgcctcctaaagtgggtccatgacccccgagcagcctaactgggaggcatcccccagtaggagcagactgacacctcacacggccgggtgctcctctgagacaaaacttccagaggaacaatcaggcagcagcatttgcagttcaccaagatccgctcttctacagccactgctgttctgcagccactgctgctgatacacaggcaaacagggtctggagtggacctccagcaaactccaacagacctgcagctgagggtcctgactgttagaaggaaaactaacaaacagaaaggacatctgcaccaaaaacccttctgtacatcatcatcatcaaagaccaaaagtagataaaaccacaaagatggggaagaaacagagcagaaaaactggaaactctaaaaagcagagtgcctctgctactccgaaggaatgcagctcctcaccagcaatggaacaaagctggatggagaatgactttgacgagctgagagaagaagtcttcagatgatcaaactactccgagctacaggaggaaattcaaatcaatggcaaagaagttaaaaactgtgaaaaaaaaatagatgaatggataactagaataaccaacgcagagaagtccttaaaggagctgatggagctgaaagccaaggctcaagaactacgtgaagaatgcagaaggctcaggagccaatgcgatcaactggaagaaaggttatcagtgatggaagacaaaatgaatgaaatgaagtgagaagggaagtttagagaaaaaagaataaaaagaaacaaagcctccaagaaatatgggactatgtgaaaagaccaaatctacgtctgattggtgtacctgaaagtgatggggagaatggaaccaagttggaaaacactctgcaggatattatccatgagaacttccccaatctagcaaggcaggccaacatacagattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataactttacagacaagcaaatgctgagagattttgtcaccaccaggcctgccctaaaagagctcctgaaggaagcactaaacatagaaaggaacaactggtaccagccactgccaaaacatgacaaaatgtaaagactatcaaggctaggaagaaactgcatcaacagaaatcatagtaaactgtctctcagaccacagtgcaatcaaactagaactcaggattaagaaattcactcaaaactgctcaaccacatggaaactgaacaacctgctcctgaatgactactgggtaaataatgaaatgaaggcagaaataaagatgttctttgaaaccaacgagaacaaagacacaacataccagaatctttgggacacattcaaagcagtgtgtagagggaaatttatagcactaaatacccacaagagaaagcaggaaagatccaaaattgacaccctaacgtcacaattaaaagaactagaaaagcaagagcaaacacattcaaaagctagcagaaggcaagaaataactaaaatcagagcagaactgaaggaaatagagacacaaaaaacctttcaaaaaattaatgaatctgggagctggttttttgaaaacgtcaacaaaatcgatagactgctagcaagactaataaagaagacaagaaagaagaatcaaatagacacaataaaaattgataaaggggatatcaccaccgatcccacagaaatacaaactaccatcagagaatactacaaacacctctacgcaaataaactagaaaatctagaagaaatggataaattcctcgacacatacaccctcccaagactaagcgaggaagaaattcaatctctgaatagaccaataacaggctctgaaattgtggcaataatcaatagcttaccaaccaaaaaaagtccaggagcaggtggattcacagccaaattctaccagaggtacaaggaggagttggtaccattccttctgaaactattccaatcaatagaaaaagagggaatcctccctaactcattattttatgaggccagcatcatcctgataccaaagcctggcagagacacaaccaaaaaagagaattttagaccaatatccttgatgaacattgatgcaaaaatcctcgataaaatactggcaaaccaaatccagcagcacatcaaaaagcttatccaccatgatcaagtgggcttcttcgctgggatgcaagggtggttcaacatactcaaatcaataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccactcctattcaagatagtgttagaagttctggccatggcaattaggcaggagaagaaaataaagggtattcaattaggaaaagaggaagtcaaaattgtccctgtttgcagatgacatgattgtatatttagaaaacccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggataccaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccacatccccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacaaccatctgatctttgacaaacctgacaaaaacaagcaatggggaaaggattccctatttaataaatgttgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatatctaaaacaccaaaagcaatggcaacaaaagccaaaatagacaaatgggatctaattaaactaaagagcttctgcacagcaaaagaaactaccatcagagtgaacaggaaatctacaaaatgggagaaaattttcgcaacctactcatctgacaaagggttaatatccagaatctacaatgacctcaaacaaatttacaagaaaaaaacaaacaaccccatcaaaaattggcgaaggatatgaacagatacttctcaaaagaagacatttatgcagccaaaaaacacatgaaaaaatgctcatcatcactggccatcagagaaacgcaaatcaaaaccacaaggagataccatctcacaccagttagaatggtgatcattaaaaagtcaggaaacaataggtgctggagaggatgtggagaaataggcatgcttttacactgttggtgggactgtaaactaattcaaccattgtggaagtcagtgtggcaattcctcagggatctagaactagaaataccatttgacccagccatcccatttctgggtatatacccaaaggattataaatcatgctgctataaagacacatgcacacgtacgtttatagcggcactactcgcaatagcaaagacttggaaccaacccaaatgtccatcaatgatagactggattaagaaaatgtggcacatatataccatggaatactatgcagccataaaaaatgatgagttcatgtcctttgtagggacatggatgaaactggaaaccatcattctcagcaaaccatcgcaaggacaaaaaaccaaacaccacatgttctcactcataggtgggaattgaacaatgagaacacatggacacaggaaggggaacatcccactccagggacggttgtggggtcaggggaggggggagggataacattaggagatatacctaatgctaaatgacgagttaatgggtgcagcacaccagcattgcacatgtatacatacgtaacaaacctgcatgttgtgcacatgtatcctaaaacttaaagtataataataatttaaaaaaaggaaaaaaatatatgtataattgacaaccctcataagtacaggctatcatgagtgcatattttctggggtctttcagcgttagagttatttctcctagtgaagggaggtttaactgagaaataaagtatatgtgagtgagagttatcttagagaaaggtacgggtagggaggcagtaaacacagaaggaacaatatgtatgacataccatgaggcagggagagatttggcatgcccgagaagtggaagaaaactggggtgcctttgttgactgggttctagtgaatgtctctctggaaggctggagttgctctttaattccccatttcaggcccatcactaacacctgacaatatgtatgccatgatgaactattagtagttcttttgagcttatatgtttttatatacaaatattcatttgtatgtgctatttttatgccttaaactcctttatcatttgtccctttggcaatgtttttctcatcttttaggacacaatttaagcctgtcctcagagaaaatagttttctgactgttcattcctttctctcaatagataggactactttgtccattatttttaacactgcactttagctttatgttcattgttgttatcatatgtgtttctcttacttgaatctgagttatatggagctaaaatcatgtgttgctaatttttgtttcaccatttgtaatatcagtattagtcatggctaattctcttggtgtacttcatcccattagaaaagaaatgacaaatgctgtgtctcaacaacttacacaaaattactcattagacacatttgattatggaaataaaattaaaagtgcatatgataaaatgttatttaattatgttttgcctgttttgctttagttttttacataatttttctacatgacaattagtaattttttgtgtcttatatatttgtccaaaatgaagttcaaaaatgtaaaatatttaattcagcaacagcagcatatgagttagtatttcctctaatttttcgaaatctgtgggaagtgtttcccaatttcctttggttgtttcatgtgctatattgaagaaaacatgagtatgaaatggaacctcagctctttcaatgacttccctttttgagttgactccgcctccatatgtagccttttcattttcatgaaagtgaagtgatttttagaattcttagttgttttctttagaagaacatttctagggaataatacaagaagatttaggaatcattgaagttataaatctttggaatgagcaaactcagaatggtgctrcttgaagactctggatctgctggtaaaagcttctcatttattctacatttcccctttaatggggtatgtaattattatgacagtcaatggatgtgatttaaaagtgattggcatcaggagagtaaggagtggaaaaaggacataggcttatatggcagcacctttgatctgccatagattcaaaattgaagatgtgatatgggaatcagagtcggcattaattttgtaaaactgctgaggtgaaattaagtcaggaactaaagttaactgaaatgtactgagtatgaaaaaatagttgttagaaaagatagaatatgcagaaaggaatattgatagagagttaattacataaagaaagttatctactctgataagtgagttatctattttaagacttatttggacatgttaaaatcatttagcatttttagttttaaattagtgttgggttagagtaacgagaagatatgagagtaataacagcattaaagagtgtattatgtgataaggatacaggtagagatgacaagatttaatatttgagtttttcagatatggatatcatcacttaggtattgttctgctagctactatttggcaagcatcaagccaggtactggtgaaattatggtgaacatgatagatataattcgtttactcatggaacttatcctctatcagtgcggctaggtagtcttaaagatgggggcatccataattgaatatcaaggtggttagggaatagagaaatctcaggataccttccctgtgcctgctgggagaattgtccactactaagtttcattgatgttgtttccattttccaggttttaagggttgaccttgcaattctcgtttccaccaccaaccttctgctaatccgtcacctctaggttgcctataaacatgaacattttcaaaaccatttcactgaaactatatgagcctgggtatgaatgttttctgcctgccttgcaatttagawtgaagagttttctgtcttggtttgagcttctttgttaattaacctctgaaaccatctatcttctccaaagtctctttttgggaagatgctacttttgccctcttttctttttcacagacttcagaagacattttgtcaacytgagtcccttcaccattactgtggtcttacttctcagtgcctgttttgtcaccagttctcttggtgagtactttgtcaaatttacttacagccttagcccactctgacaagaacagttaaaaggcaaacaatttttctgaaggccaagtagcatctaaaaactaggtgacatgctccatgtattcaaaggrtcagatattattaaaagcacacaataaaaatctaaccaaaatattagcatggttcctcaccaaatgaaataaactcacaggagagaaatgaattttacttaaagattagaaataatgttgaactgaaaaataggaaagaatacaaaggaggagaaacttcagaatcattaaaacaaaagtgaatttgggaaacacattagtaaattcaaatgccaaaatttatctaaaaatgtattgagagatgccaggttggtgggaccagattcctacataaagctaaaataatgccaaggaggcaactgagatcatctatcatctggggatgggaagagagtacaaagaggtttattttatggtagaaaatagcagaaaatatctccatcttaattttagataagtttcagtctagcgtttttaagatttatgctattttacatatacgtatgaaataagagttaaatttcttacaactagtcttttcatcttcataaattctctatcagccttctttctatcgaccttaggattttggagaaatgtaaaaagttcatccccataacgttttgtagcatcttatttaactcgaaaatgcttcacaggaattatataaattgccactattaaggctttccagccataaaataaagctattaaacactattgtgttacttacctttactggtcatatagcactgcttaatttgaaaccagtgatactgatacttatatttgaatgactgtgaaataacattcttctgttttaccatggataggactaggatggttctcaaatctgagtttgaaggataaataagtaatgtaaaaaaataattttctacttgctctttgcgaccttggccaattactgtcttaatccattgttgcaggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcaggtaagactwgcattagtcaaagcctcaacacaaaatccttggtgggaaaaaaatatgtagatgggttaaaacctagaataagccactttcctgtaagcaatctagttcatgtataaaagtactccatccattgctagaaaaccacaaaacacgaggtcatttttttttaataaaaaaaattctgaacactgtgattaatgaggaggtgactggcttcaattttatacatgatcttagccaaaaagccaagaagtggtggtttaaatttgatattcagtaagcttactgtaacctactattcctatatcataaaaatatcatgacatctaagttatttccttgttctttcccagtgacttgttttgatatgttgacccacaaattattaccattttgtccattaactgataatcaacttagtgaatcaaaaaacaactatttctagcattaatacatcatttcttgttgtaggaaggattctttgaaagtataattgcttgaccagtgtgcaatgctagtcatttcatttacattgtgcttttaatttacaaaacatctccatatgttttattgcaattgaccccacaataactgagaaagtcatgtgtcaggcctttctgctgacaaatcccaagggcacatttctgatccaactcagattcctgggatccccatttctttttgtttgtttcattcctttttttttttttttttttttttttgggacgaattgtcgctcttgtcccccaggctggagtgcgatggcgctatctcggctcactgcaacctccacctcccgggttcaagcaattctcctgcctcagtctcccgagtagctgggattataggcacctgccaccacacctggctgatttttgtatttttagtagagacagggtttcaccatattggccaggctggtctcgaactcctgagctcaggtgatccacctgcctcggcctcccaaaatcctgggattacaggtgtgagccaccgtgactggcctgtttcattaatttttatacaatcctctcacctcccagcctctctctctcccataggactgactatagaaaggacttatctctgtccaggcatcatgatgtgataagagaaacacacagtagcatctagaaaaatgctgaaataaattttcacatagctaatatcctgtgattttgtgcaagttgtcaaatctctctaaacttcagtttctgaggattcaatgatataatacatgtaaaactactggtacactgtttggtatgtaacaggtgctgannnnnnnnnnnnnnnnnnnngtgactcagttctctttcttctttctccgcttcctcttcctcttccttctcctccttctcctccttctttcctcttatttttaaccactatgggaggtgtgaaatggggaataacaaaagtaacatctactgcaaagtttaaaattatcataaattttagcaggctcttatcataattattgctgtgtatagaactggctgtttagctaaaacagtgtagtacttttagctctttttttctgttgttttataactaccagtggagttaatcaatttgctttttgaaatttatacacttaaagctttaacctgagtcaaatttaaataacttgagtcgaatttatctatttctgtacaaaaaagagtatttacatctgtcctagtaataggtggaaacaaaacaaaacagaaagtttaaaaactttaacctgtaaacattttcctttgtaagtagatatagataaaaatcctaattgcttcctagattttaacatattaaaattctctactgtgtggagctgggcaatgtccaaaatcaggcaccattttaaggacaacataaaatcccaagtgtccagaggaaacttcttttctaaaatcacttctaaatgaatgtaacttctgaactctggtcttttctctgctccagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaagtaaggactgatcttggctcattctattctccaggagaggacaaaagaaaggggtaataaatcttaagagcctgaactcttaagaacataatgaagtctgcttcttttgtcaccgcattttaacctaacttcaggttccagttctgatacctgtggactttttaccttaactgaaattaggagaaataggttagggaagtgcatagtgaaactgagatccaggtcataagaaaagaagaaagtgtttaggaaaagcccataaagaaagggagagaccgaaaagaaaaagaggggaaaaaggaaagaaggaagggctttactaggaaattttgcactatgaagttttatgaccaaaccactccagttatcatctaatccacaaaagcctcctcattagcctcattaacccactccttcccaaatcatttttcaagttcacagaatcgaatcacttgttaaaaatcaatattggtttctcattaaaactttatttatactagatatgcattgtatctgtctagagactttcacgttgtatactcagactgggggcggggaaaatcgtttgtgtgtgcagagataccactcttcgtttttctgttgaattcttagtataaaaggagattgagtgtgtcttgaaccccagagaacacttaggaaaataagagtaaaaaatccctatcttcaccagatccctttctctctctctctctctctctctgtgtgtgtgtgtgtgtgtgtgkaaataaaggaacttccattcaaacttgtttaaaaagaagagaatactggctcacaaaactgggaaatccagagggtatagttagcctcatgcatggttggattcaggttcttgaacaatgtcatctgggttctatctctttctgcatgtcttgaacaagctttttcttgttgaacaatgtgatcagctatagcctgaaccacaatgaatggaactcctacaagaaagatagattttgttaggttaagaatgtgaagaatttggagtagaaaaaacacagactgtaccttccattctcttttacccatcaacatttctctaggcccccagttagcacatgctgacgaatcacaatcccacaatgaataacattgtgggaatgaaaacggaaactgccagaggaaacaaccagtttaatttattacagaatattcttcagaatcaacgtctgttctttgaagaatattgatttggggaaggtgaaaattgtagtactgaagcctcctttctctttgctctgcttttaaactaaggaagtggtcacaacaggttcaggtgtacaacacaggctaggtagtatcaatggagaatgcagtcagaggcaaaagggattgctaagtatggaggcaaactgaaggatgagggagtcacctaaacacatgcaaatatattttaaccagaaaaagtaaacagttctaacaagaactctgtggtggtcaaatagcaggtctctagatgaaattcagtccctgtatctcctgttagaaacacttcctgtagtatatgctgtctatactgagatgtcccatcttcttgcctgatccactcctccttccatcttgaatgatttccagtggtagtacagtacatcacagttttctctgtctccacttatatctctccccttttccttaactcatctcaggtatagctatttatagtctcatgttcttgcttccttatcgcagacctgttgtgtgtctctgttacagagggagcagatctgagcctgagactggtagatggagtcactgaatgttcaggaagattagaagtgagattccaaggrgaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctrtctggcaatgtaaacaccatgaatggggaaagcattattgcaatcacaatgaagatgctggcgtgacatgttctggtaagttaaaaccaaaccaaaaccaaaacactaaacaaaaagaaaagcagaaacggaaagtcctgtgctccttaagagtaggaacgtgctccttaagaagtagaaatgcctagtaaattccttgctgggaattcctttatacctgtaatctttgacacattctttattcaactagtttggaaggttgtctgacggcattctctgtaataattactcagactgcttttatggagcacacttcaaactcagaatctacctggagctcagagagacaaaatttcctaggaatctgtttttaaatttttttaatttacttatttttttactttaagttctgggatagatgtgttgaatgtgcaggtttgttacatgggtaaacatgttccatggtggtctgcttcacgtatcaacctgtcatactaggttttaaccccccatgcattaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggcatttgggttggttccaagtctttgttattgtagatagtgctgcaataaacatacatgtgcatgtgtctttatagtagaatgatttataatcctttgggtatatacccagtaatgggatcgctgggtcaaatggtatttctagttctagatccttgaggaatcaccacactgtcttccataatggttgaactaatttacactcccaccaacagtgtaaaagctttcctatttctctacatccttgccaacatctgttgtttccagactttttaatgatcgccattctaactgggatgagatggtatctcattgtgattttgatttgcatttctctaatgaccattgttgataagctatttttcatatgtttgttgtccgcataaatgccttcttttcagaagtgtctgttcatacccttcacccactttttgaggaatctcttttaaagctgaattgctcatatctttctgccattgacaatttttatcaacccttgaaactacagtcccatttctaacaaaaatttatggtctatattattgtttcttaaaaagtcaggaaataagttacctataattttcaatgcatcagtatcagagaagaaaaaagacaaaaaaaaatcctctggaagctaacctccatatgtatcgatggtttaagtttatgtttcttttgcagatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcaggtatgactttcaatcaacttgttaagaagaagggtgtaaatttccagtactacctttgaaattgaaaagaaacattggtccttatgactagatcactctcaagaaaccaggaaatatctacacaaattccactgggagagtcagataagtttacaattcatgttgcactttagatagaagtgtttgggttttgctcactttggtttttgagtaatttttagatcaatagaggtataagattaaggaggattaaaatttaaaaaatagaattcaatatttctttcacaggatgtcaccaaaagatttaaaaaataaccatgttagataaactgacataaccttcagctccctctattgtactgtgaaagaattttctttttttttggaaaacctgtgaatatttcactgcaacctctttaaaaagctcaaaaatgagttgtaaactggttaggtttgtggataatctttagtattttatgctaattatatytatacaaatgttaactttgttgaaaagtgatgctttttaaataactctaaagtaaatgtaacttttactcatgcaacaaaaaggcttcagaaaacacagtgtacaagaaaaccattaaacatgtagagacctcacagaatggaaacttgtacgtgctgcatgtcctctaaccaacaatatggctccagatacctcccaacctaggcatgcagtgaggggcatttccctgatgttacaaatggtgcttacctctagttaagtagaaattatcctccgattgaaaaaaggcaatcatttaagatataaatttgaatttctatattactttttaaaaaatattctggaccaggcaatataatcacatggtttaaacttcaaaataaaaaagtgtaaactcttcccccactactatccaattcttttcctcacagacaacttatgtggttggaatatttatatatcatttgagatatttcatgtaaatacaagaaaatacaaacaaatctatatatagctatcatttgctttcattatccaaatggtggcatgttgtataaattgttttgtacctgaagtattcacttagtaaaatttcttgatcaaatttcacatcagtatttaaagagctgtctgaaattacttccatatctataacatttcttataatttattaccgtgtgtattcatttattcttttaattttttacctgacaaggttagccattcttttacctaaatttttttttaaaaaaccattatttggattttaaaaaattaatgttacttttatttcctttctaattcattaaaatttacttttctttctaataattctcttcagatttcctaaagtttgatttctttttggcccccaacttcttgagttgaatcttaagttttatttcttctgatttactaatataaatattttaggttatagattttccttctaaatttataatggtttgtatattttcttattaattgtattttacattgattagcattaagttctgctgtatctaaaagagaaacaaataatagtgactgaagaaagacagtgttcactttttctcatttaaaattagtcaaatagataagcagtttaaggctgttttggtgtctctgttgtcaccaagaaacatccagaatagatttgctgcagtaagtatcaaatcctaccggacaggaaggataagccaccccgcagctcagtgagttccttggaaagccaatctggtagacgaagtgctggcctctgagaaggtgtcttctgtccgctgtccttcatgggccccagtgttgctctcagggcagttcttcctggcacattattcttcacagttacatccaagtttggtttggagagtatctctatctaaggacagcacacctttcacaacccacttcctgctaatattggtttagggacctttggattaaagattgactaatcaagggctgatgtcagctgccctcaaattcaacaaaaaagttctttccaaggttactaagcttctagtctacttgctttataacccaatgccatctgaaagtaactatagtccaagagcatataaatatactttgatctatgctgtgaccagcccttctctttaattattgaccactgccttaaggccgtttgaaactgtgggtttgggaggaaggacaagacctaaattccgtctttgccggtagactcattgcctttgtatctggagtatcaattttatcttctgacaaggctacagttttaccaccacctcaatttggggggacaggatacttagagttttttcttcaattcttcaattccaaattataggactcttgattaacaatatacaacacctgcaggcagaccatacccccttataaaattgatatttctcctcccatttctgcttgcattctgactgctggtagtctgaattcatctttcttgtaaatgctaaaagtggcaaggagaatccacgtcatgcaaatattctgattttttgtagttttgtttcttgtactttgcccaataaattctgcattttttaagcatcagtgagcacacggttttcttttcaaagtgaggcttacccaaatattttaccatgtgtaagactccttaggtttttagyctctcacacctgagtcattaatgcattctgcccatcaactccattcaaccacacccatattttaggttgcattactagaataccttacttatggtaacatgttctaaattattcaggattctattcagatgtgtataatagaaatcatgaataacataaatttgcaacttaaggtgggctccgtacttcacagagctgtatttttgtttgctatttgccatgtgcactttttgtttccttttacaaactcttttgttatattgctgtaggttttggaagttcttctacttatgttgggggccttggtttttagctttttacatgttttgttagtaatatagtttgtacttttgtttctttatttacttgatactttcaatgatgacatactgtctctgtcaatgatgatatgctgtctctgtgcctgccaaattcaagctaygaatttgatcatctgtttaaattgtttaacttttatatagtacagggctatacagcttaaaagaaccaggagaattcaactaagcaggagaattggaaacaatttaagataaattgttgacagaaaaaggtctaggaaattttggccacaaaattactttgaatctcagacattttgtttgtgatgtctgtgtatgtactgtagaggacatctgaccttaagaaacagttcatttgagctatgctgtcttttaacttaggatggagaaataattctgagattatgatgatctatacttcttcagagtctgaaaagcattaaatgttgaaaatacattaaagcttctttaaatcataattgtatattttatttatcactaaacaaaaggaagtaattctagttaattatgtctctaattatgttaaagctctttgtagatctatttatttttctagaaaaagaaagaaaaacagattcagttacttatgccaggggaaaactgtagttgttgatcaatggtgctaaatccaggtgcaaaaatttacttaatggtttttatgtaaaaacacagtcagagacttagcagaaaaaaatccattaaagggatacatttccaatattctatccatgtctaaagagtaacgatataagcaaagcgacccataggatagattaacatgttactagcagattcacgaaataaaggctgaggatggagtctccaagtcactttctgagttggagaatttgtcctctgccttgactcaaatatgttagtacaaagaaaacaagaggatacttatagaagggactttttctcaattgcttaatgagttttcacaatggaaaagaaaatatttttgtttgtttgtttgtttgtttttcactggttttcttttggtttattttgttcaagatgggtccaaatgaaagagtaagaagttacaagaaaccagaatttggcttgatctaggagactgcctttacttaaagatttagggctgtccaaaagaggttgggatcatatgaatactagttaatgatatcttagagaaatttcatgcttgaataaagattcaaaaagaagaaatgaaagaccatcccactcaagggtcattaattatttgtattgtagaggtgttatttgctttaaactctgagctatgtttagaaagcaacatgtttttcatttcaaatttggataggaatttgctttgcgcagatttaatggataatgggtgaaattttgacatgttgaggtattctatattgctgtagtacagaatatggtcatattcgaaacattttctaagacatttttgtatcaggtgaaaggtttatgagagatgaaaggaaatcagagtatgtagattggcaagggctgatggtgtatctatatcattgtgatagtaacatcaagagattacaaaaattgttgatatttgatagcaggtatctataaaggacttaagaccttcagaaggtctaattttcaactgcattttctttatttctcttaaagaacaagttaaaagaaatagtttgtatctcttaagtactttatattgcctctgagtattttcaaagaaactcacttatcttgatgattgtgtttcttaacttgacaaagagcatcttcataatataaattccatttattatttctggtgtgtcttttctttatattttaaatttcagctacagtaagttacttataattcttcaatgacaccatgcatttcgtgaccatattccttaaagattgtttcacacactgtgtatttggcaaactcctcatcttttttcaagatccagtttagatctatggtattctctcccccatagtctaaaacagagtgaatgactcctttatttgttagttttatgtctaatacatatttctatttttgggttcatcactattaaaatatgtatatcttgtagtgaactgtgttcatggaggagaaggctattagtgagaaattgaacagccttgaaaagaagtagccttttcctaggtatataaggtagggaaataaattttaagtagagagaaaagtttctacagaggcacagaagcatgaaaattacggcatgcccaagcatctttaggctggagcatcaaattaggttgataaagtaatagatattaaagcttttaaggtaacagcatactattttaaagtgtactaaagaattagtgtttatcacctctccttaattttaatagctggacgaaattagggaatctatgaaaactgtttgtgctgcagtttgctcagaagaaaaatgggagtggtaatagggcctacctcacaggaattacacagtgagctataaatacatgttagctaatatgattatgattattatttttagtattatctatcttcactgacagactgaattctgtggcggcctttttaacccacccatcatcaaatgcctaaaatagagtcagagaacattacaggttgttacattataggtcattacattgatacttttggattaattattgcatacatgattattacagaaattataagaaattatgtaagggatcattgcatacattttaaggaaacgttaagtcatctaaaggaaaaacatcacatgaaaatatttgaaatttattaatatatttataatcatggcataaatttcttggaaaaaagactttgaagcaaggaaacaatttacgaagctattgtagaggtctgcatgacagatgatgacaaatcactttatggcaatagcaacaaatatgcagaagaagaaatatgctggaggaccaacagatatggtggttttctacatgttcaatgtatcatgaaagtcaacattctaggctctggaatatactgtctggcttcaaattctgttctcttactaattctgtagtaatttcttgtgtgaccttagcaaattactacacctcacctctctatgtttcagattccctgtctgtaaaatcagaatgatattaacaattatctcctaaggcaattttaaggattgaatgaaataatgtttgttaaatgcttattggaatgccatatatgtaatataatagacgctcacttaatattcactgctatcattattaccattatttgtggtgagataaagtgggtcaattttaggtggttctaatttggcctgtatatcattaattaagtaaagaatatagtgggcttgtcatacaataattcattcaactttgaatactttaagctccacatgtctaagcagatacgtttgtggatctaaaattaaagaaaaaagtatggatgaaaatatatttattagcagttgagacatgtccattgagcagatgagaaggttacggacagaactttgactcaaggaatacacgaaatgttttgataaagcactgtcagaaagaatggaggagaaaatgggacaagaagggtcacgtataccaaacgtaacagacgtcaaaaggaagaagtctgatgttcattctgaaaattagaagtatattgaaaagctttacatagaacaattcaaaaaggttgagcagaccccagattgcagtacatggaggaatgagtgcaagactaagagatagcgatagtagatacacattgtttgtggtctctaatgttattatgaataaagtaagcaaaattttggaagaacagagttatcattgcctttggggatggttggctgcacaaggtgaagtcccagaattctctcagatggatgagttcagctaggaatggggaggtctagatttatccatacccaactcgaggcagaaaagccaagacaaacaagtgtaggaaatcactgagcaccctggtctccatttcccactccacaccaccttcttcaccctcatcatgaatggaaatctggaaatcatattacctctcactgaaataatatttatttttcagcccacagggaacccagactggttggaggggacattccctgttctggacgtgttgaagtgaagcatggtgacacgtggggctccatctgtgattcrgacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcacccygcccagaaggaacttgtagccacarcagggatgttggagtagtctgctcaagtaagacccagaaaacatctttaattggttctyatactgtgaaagggacagggttagggagtcatagctgtctttttctaaagccctgtctccttccaggatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggtaagaggatgacgggcagccagtgatgggtcttaagagaaggtgtacatagggatgaagaacaaaagtaaaacgcagtgatccattttgaagggtcatgagaagaatgaatactaattcatgcttcagaatattaacctcatttgtcttttcagagggtgagcaaacctaattttgatggacttcttagttatccagtgcttactatgtgccaagcccatctcaaagcacctgatttatttcaaacttgttgaccatccaccttcccctctctctctaagctatgtttgtcctcaactcatccatataacatttcatctgactcccctaaccttttgtgtcttgtatgactgagtaccttggtgtttgcaggaaaccagtcccaaacactgtcctcgtgcaattcatcgtctttgggcccaacaaggcctaccattccagaagaaagtgctgtggcctgcataggtaagactctgtgacaaatctatgaaaatattaataacaagtggaatgctcattattaatagtttcatttctctttgcagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcaggtaaattatgcatatgacctttggtcataattacatagagaaaggactgaggaagggtagtgaggggtattaatcttaaagattttcctgaaaagttgatccaaaaggaactattgtgggagtcaggacaacagaagtctgggtttgatgtgctagtggtacttcatgagcaaggtagtgcaacattgtaaagagaaaagaccagaaatggtcttgtatatcatgaaaatgacaacaaagttaataatgaaggtttttaataaatatatttggggccagatattagatagcgatccaatagcaacacttgataattacagtattagtaaagaagtagatttaaagggacaagaagaaatatatatgttgcatcattctacagaaaaaaagataattactatgcccaagcaatttttcatggcagataaatgagacttacttgtcatagaaacaaaaagtagcatgaggttactgccctcatactgctttgtatacatggtgagttttagaaaacattctgaaatttaaaaatgtactatttcatatgtattatggggaacagaactatgattcagtaacttaaggaagtgaaaaactctgtatctcagaagtgatttattcctattttaatgacataaatctggtagaagacatgcactgcaaaactgtgaagtgtcagcaaatgaactgtcattttaagagatgtacacaaaacattgattttagtgcctgagtgtctaacaattttaactatcaaagacagttgcaaaaaaaggagaatatttttgggaaaaaatccaaactatgtaactgaaaaaagcctattagaatgattgagggtaatctaaagaggactctgagtccaaaaccaaagaccaaaaaactataatgtatttatagaataaataaaatattttaataatatctatgaaatcatccagaagttactaacgaattattagtaactgacatattgtactattgtacctatttttaaagccattcttacatcaaggtaaagggaaggagtctctgaatcttcagaaaagatgcaaaactactaattctatgtttygctgcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagytgggctgtgcagacaaagggaaaatcaaccctgcatctttagacaaggccatgtccattcccatgtgggtggacaatgttcagtgtccaaaaggacctgacaygctgtggcagtgcccatcatctccatgggagaagagactggccagcccctcggaggagacctggatcacatgtgacagtgagtatccatcgacctatatgaaaattccattctgcagcccygctatcatcttctgataatggacactggattttattttcctattctcacactggcttaaattgttagattgaattaagcaagaatgggtaacttgtgggtaatatctattctacctggatagtgtaactggttttatttaatttggcctgtagatattcaggatcagctattattattctaaagaatatcatactccccatggtctgcttgaaagatttattcaattgctttctctgaggaggagagaatatgtggtttaatatttgactgttgaatggtctaccttaccttcccatttttctttcaaatattatcttgttacactaatataaggagaaaagcagtcagaaatcagaaagatcaattctgaagtatttccacattctacaggttttttttttttttttttttttgagacagagttttgctcttgttccccaggctggagtgcaatggcgtgatcttggctcactgcaacctctgccttcttggttcaagcaattctcctgctccagcctcctgagtagctgggattacaggcatgagccaccatgcccagctaattttgtatttttagttgagatggggtttccccatgttggccaggctggtcttgaacttctgacctcaggtgatccactccccttggcctcccaaattgctgggattacaggtgtgagccactgtgcctggcctctacatcttcttaaactgtgagatttgtgacaacctgccagtttcccaagaatcttgcctatttgaaagaatttgacatcacatatttataatgttaactttaatcatttaacatttactgggtcacattatgtatcttatgtgcaggatggaatatacctagttggctgtaatgacaagtcctcttataaaagataaattttgtaaaaatataaattttaggccaggcacggtggctcacgcctgtaatcggactttgggagtccgaggtgggyggatcacgaggtcaggagatcgagaccatcctggctaacatggtgaaaccccgtctctactaaaaatacaaaaaattagccgggtgtggtggtgggcgcctgtagtcccagctacttgggaggctgaggcaggagaatggtgtgaacctgggaggcggrgcttgcagtgagccgagattgtgccactgcactccagcctgggtgacagagcgagactctgtctcaaaaaaaaaaaaaaaatatatatatatatatatatatacatatatatatataaattttaatatgcacattcagtaaaattttaaatagtttttttttttttttaagtttcaaatctctcttttcacctgtgaactcctggaaacttttagaagtcttagaaataggctacatgtctctgatttttcagacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggacccgatatggctcaatgaagtgaagtgcaaagggaatgagtcttccttgtgggattgtcctgccagacgctggggccatagtgagtgtgggcacaaggaagacgctgcagtgaattgcacaggtaagtgccagaagcctggattgagcttggaatctctggcagcaaagaggggttgggcagtgatgtgtgttgtgtaaaaaccggatttatcagcacagggatctggtggggattctcagagaatcataatgtctctactgaaagaatgatgaaaacaattgttatacaatggccttcaccaaggagacacatacaacctatattccctgtgcagagaaagaaagactagaggactctagttttaggtgggaaagagtcatatacttggttgagaggtactaaggggtcagacaaggaaatcagaaggcttgttctatatatcatgcaaagaattaaccctctctctttcttttctcctacagatatttcagtgcagaaaaccccacaaaaagccacaacaggtatatcatggagtttatgatgatgagaccaattatctgcatacatagaatttttcttgtttagaaattttaggtcagacgttctgaggatttgatatttacctcagggatcaagtatttgacctaagagagaatcagtaactagggaccttgatcttttcgataagacatgatcatatctcttgatatttacttttacttaggtcgctcatcccgtcagtcatcctttattgcagtcgggatccttggggttgttctgttggccattttcgtcgcattattcttcttgactaaaaagcgaagacagagacagcggcttgcaggtttgagccaaatttggtttatctaatatgtctacaggataagggggttcttgtaagacgaaaatattagactcaagtctaatggccagaaagatggactctaaaagaggtttgagcagtttctcaaaacagagggaagggccaggcacagtggctcacacttgtaatccctacactttgggaggctgaggcaggagaatcgcttgagtccaggagttcaagaccagcctgggccacacagggagctcccatttctacagatttttttcattttttaaatagagggaataagatttcagaggagaaaaggggtttaggttgcattgatgattccctgtgttctatctacatgcttaactggaacattacagaattgaaagttcagaatgaatatgttagatattgtttagnnnnnnnnnnnnnnnnnnnncatgggacaataaatcttggtggaacttcaagtctagtggaagagatatatatgtaaacaaatacactacaatgtagccattttacattaataggaaaaaggaacaaaagtggcacagagaagggagtaattaactgaaaggggagggggattactggaggcttcaaagaggcttggggacaaatttcgaacatagaggctcagagaattgggtgaggaacattctagagaagaatatgtacaagtctagagaagcctaaaggatgaagcatttcttgtttttttcctgaggggcggggggagaaaagttgagtgtgaggagagaggctgctaagtctgaagaagagaaaaggcacaaattatgaagttcttatgtttcacataagattcatagtcattaaagagtatcatgtaggggagtgaaatggtcaagatatcttttaggaagatcttttggcaacgggatctaggaggattgaaggaggaccacttgactgacaggaatggcattttgtaacagttgaggtgaaaaatgaaaagtactataacatatatagtgagaatggaggggagaggaaagacttttagagatacttaagaaaagctccagtgagttatggaagactgctggcttcccttgggtaaaaacagtgggttgtttatattaatacaatggcagtggggaagatttagccttgtgcctatttcatttgagtgtgcggaattgtaagggaagagcttggtagtagaatgggatagaaacaatagcagggataaagacgaggtatgtttgcagcgcttggaaaaaacacacttacagcaagggaaattttattatgatagctgatccctaacctagggatctctgttttcagtttcctcaagaggagagaacttagtccaccaaattcaataccgggagatgaattcttgcctgaatgcagatgatctggacctaatgaattcctcaggtctgtgggttcttggagggtctattgcccaggggttcagatcagtggctgcagttgaggcacagacattctactttgataaacagttwaaaaagtctaaaaatgtaataggaagcttagatgcatataatggacaagaatgactgaaaattattcttggagaatatcaaaattgcaatcatagggaggcctttagcttaagaggcctgtgattattcctgatagaggtatggaaagaaccatgcagaggaatattatgacttggacctcattttattaaaacagaaattaatcttacaaaagattgtcataagtgacagtttaacttttttctttaaattttgttgtgtatatttaaggtatacaacatgattttatgggatgtatatagatagtaaaaagcttactaaagcaaagcaaatgaacacacccatcatctgacatagttacccttttttgtgttgttcttgtggcaagagcagctaaaacctactcacttagcatgaatcctacatacagcacaatgttattacctataatcctcatgttgtacattagacctctagactggttcattctacgtatctgctactttgtatcctctgacctacatacgtctttcacagtttcttccattcccatttcctgtcattttttttctctagcttgatatttattatatttttccctaaaagtctaaaaccttaaactttcaatatctttattgcatgagaagccatacaaatccacagaactagccttatttctcatcacatcatgctgttttatccttgaacttctatttagcaccagtgcactaattctgcatctgggcaggatgactttactgggttggaagaaatatcccaaaacccattgtctttactccatgaagggtccctgaccttctgagaggggcctgcctcacttcttccrtccaaagaattatgcatctgctactgtgtcagggaacatatttaaggaacatgtactgttactgtgtcaggaaacatatttaagaaataggaaagactttctctgccccttaaatcacacatgcttttcttcctagttatgggtggtgtttttagttgctcaaagagcctcacagttacgtgagaagaggtctggtttatttcccagtaattattttcttcctttcagaaaattcccatgagtcagctgatttcagtgctgctgaactaatttctgtgtctaaatttmttcctatttctggaatggaaaaggaggccattctgagccacactgaaaaggaaaatgggaatttataacccagtgaggtgagtgatgagaatttattagtcattgttcaaaacagctgcattccttttgaggactgagagctcttctggcattagaaagaaagaatgtatataaacatattttatttgcttatgtgcatatgtttgtatatgtatatatctatattgagaatatataaaagcttataaatataactgattcatctcttaattatacacacaaatagtaataacacatccatggagctaaggagaaactgagtaaacaaatacaaattaatcttttgaagacattacaggtatcatttcaggaaaaagataagacatattgtacatctacatcgtataatacatgctatggtaaagactgtacaaggcactacagaaagtttgcctaagaaactttggggttgttgtaagatgatatgatatttaaggtaaactttaaaaataactgaaaaatagacagttccaaagaaaggacacagtatgtgcaaactagaggcagaaaaaagaaccatgcctttagggaactataagaagttttttattcaaaaacatatattgaacgtatttatggtaacaagtggtaccgtgagcactgaagatagagataaaatctactattggcaaagacatgattgtttaataaaagatatcatagtctataggtggtaatatgaagaggccatgtggagagaagagaggtggttagaatctaagctgaaaaggctgcatagagccctgtaatgaatggtcttacctgctatactttatgttctctttcactgggggtctgttgaagaggtgatgatgagctttgaaagtttcagatgagacaagatgattagaattgcattttacaacttgctttcatgagaaaaacataaaaaaaaattcaaatgtgaacaagacgtatagttaagctatacatcaagagaaaaagattgtgaaatgagttactagatacattttctgtttttaaaataataatttggggaagactacatctagaaatgaaatgtagaaaaagtattttttatagaaatattatatattcctataattcatctacatattatatatctacattgtataatacatgctatggtaaagactgtacaagacactacagaatatttgtatatacgaaatatagattaagacaaaggataagagttggaactcttaaagtacatgaaatataaattgtgaatatctataaaatgcagagctaattttacatacyatatatatacacacatagatacatagagttcttakaaactgyacagagcacaaaagggttaatatatgtgaatgtaaattgtatgtatgtgtatgtgtaacatctaatagataattgggcaaagctatgaaaagacaattgacacaaaatgaatttcaaatgacagacatttttaaatgtctggaggattgaaattataattaacaatgagctatcactttatacaaatcagactaacaaaaatttgaaataccatcaatatttattactggcgggaatacagagaaaaaggccatttcaaacactgcttttggaagtgtgagatatggtaggtagcctttggagaaagcaatctggcagtttctattaaaaattattttcaaagattcacagaccctttgacccaataattctatccctgagaatttcttcttaccaataaagtcactagtatgtaatgacaaatatacaaagattcctttctgccatgttgttgaaagtggcaaaaactagaaacaaagtgaatgccaattgatggagtaatgactggaaaaatgacggtttaggcaactaaaaaagaaaaaatcattataaaatataataatattccatttatgtattggctataattaaatacaatgcttacrtctataaaattatgcattcatatgtgcataaagaagctaaaaattctagtgttgtaaactgagaaccatgaataatatttgatttataatctgaagcatatgaatgttttctgatgtgataaatgataattgaactacttttccctgaaagagtaatcactgctgaataactgcttcagaatcacatgagggtgcttttaaaaaatgacgattctttttttgtttttaatctttaagttctgggatacatgtgttgaatgtgcaggtttgttacataggtatacacgtgtcatggtggtttgttgtgcctatcaacccgccatctaggttttaagccctgcatgcattaggagcttaaatttgtcttaatgctctccttccccttgcccccaccccgcagcaggccccatgtgtgatgttcccctccctgtgtccatgtgttctcattgttcaactccaacttatgagtgagaacatgcggtgtttggttttccgttcctgtgttagtttgctgagaatgatggtttccagcttcatccatatccctgcaaaggacatgaactcattcttttttatggctctatagtattccatggtgtgtatgtgccacattttctttatccagtctatcattgatgggcatttaagttggttccatgtctttgctattgtgaatagtgctgcaataaacatgtgtgcctgtgtctttatagtagaatgatttataatcctttgggtgtatacccagtaatgggattggtgggtcaaatggtatttctggttctagatccttgaggaattgctacattgtcttccacaatggttgaactaatttacactcccaccaacactgtaaaagcatttctatttctccacatcctctccagcatccgttgtttcctgactttttaatgatcaccattctaactggtgtgagatggtatctcattgtggttttgatttgcatttctcagatgaccaatgatgatgagcctttcttcacatgtttattggccacataaatgtcttcttttgagaagtgtctgttcatatcctttgcccactttttgatgggttgtttgtgtttctcttgtagatttgttaaagttccttgtagattctggttattagctctttgtcagatgcctagattgcaaaaattttctcccattctgtaggttgcctgttcaccctgatgatagtttcttttgctgtgtagaagctatttagtttaattagatcccatttgtcaatttttggcttttgttgccattgcttttggtgttttagttatgaagtctttgcccatgcctatgtactgaatggtactgcctaggttttcttctagggtttttatggttttaggtcttatgtttaagtctttaatccatcttgagttaatttttgtatacggtgtaaggaagtggtccagtttctgttttctgcatatggttagccaattttcccagcgccatttattgaatagggaatcctttcctcattgcttgtttttggcaggtttgttgaagatcagatggttgtagaggtgtggtgttacttctgaggcctctgtcctgtgccattggtctatatatctgttttggtaccagtaccatgctgttttgataactgtagacttgcagtaagtttgaagtcagatagcgtgatgcttccagctctgttctttttgcttaggattgtcttggctatacaggctctatttttgttccatatcaaatttaaagtagatttttccaattctgtaaagaaagtcgatggtagcttgatgagaatagcattgaatctataaataactttgggcagtatggccattttcacaatattgattcttcctatctatgagcatggaatgtttttccatttgtttgtgtcctcttttctttccttgagcactggttggtagttctcctttaagaggtccttcacatcccttgtaagttgtattcctaggtattttattctctttgtaggaattgtgaataggagttcactaatgatttggctctctgcttgtctattattggtgtataggaatgcttgtgatttttgcacattgattttgtatcctgagactttgctgaagttgcttatctgcttaaggagtttttcggctgagacaatggggttttctaaatatacaattatgtcatctgcaacaagagataatttgagttcctattcctgtttgaataccctttatttctttctcatgcctgattgccctggccagaacttccaatactctgttgaataggagtggtgagagaagacatccttgtcttgtgctggttttcaaaaggaatgcttctaggttttgcccattcaatattatattggctatgggtttgtcataattagctcttattattttgagatacgtttcatcaatatctagtttattgagagtttttagcatgaagcactgttgaattttatcgaaggcgttttctgcatctgttgagacaatcatttggtttttgtgatttgttctgtttatatgatggattacgtttattgatttacatatgttgaaccagccttacatccagggatgatgccaacttgattgtggtggataagctttttaatgtactgctggatttggtttgccagtattttattgaggattttcgcatcaatgttcatcagggatattggcctggaattttcttttctttgttgtgtctctgccaggttttggtgtcaggatgatgctgacctcataaaatgagttagggaggagtctctctttttctattgtttgggatagtttcagaaggaatggtatttgctcttctttgtacctctggtagaatttggctgtgaattcatctggtcatggttttttttttttttttttttttggttggtaggctattacttactgcctcaatttcataacttgttattggtctagtcagaaattcgacttcttcctcgtttagtcttgggaggatgtatgtgtccaggaatttatccatttcttttagattttctagtttatttgtgtagaggtgtttatagcattctctgatggtagtttgcatttctgtgggatcagcggtgatatcccctctatcactttttattatatctatttgattcttctctcttttcttctttattagtctggctagtggtctgtcgattctgtttatcttttcaaaaaaccagctcctgggttgattgatttttgaagggtttttcatgtctccatctcctttggttttgctctgatcttagttatttcttgtcttctgctagcttttgaatttgtttgctcttacttctctagttcttttaattgtgatgttagggtgttgattctaaatatttcccactttctgatgtgggcatttagtgctatacatttccytcttaacactgctttagctgtgtcccagagatttttgtatgttgtgtctttattctcattggtttcaaagaacttcattatttctgccataattttgttacttattcagtagtcattctggagcaggttgttcagtttccacgtagttgtgaggtttcgagtgagtttcttaatcttgagttctaatttgattgcactgtggtttgagagactgttatgatttctgttcttttgcatttgctgaggagtgttttatttccaattatgaggtccattttagaataagtgctatgtggtgctgagaagaatgtatattctgttgatttggagtggagagttctgtagatgtctattaggtccatttggtccagagctgtgttcaggtcctgaatatccttgttaattttctgtctcattgatctgtctaatattgacaatggggttttaaagtctcccactactattgtgtgggagtctaagtctatttgtaggtctctaagaacttgctttatgaatctgggtgctcctgtattgggtgcatatgtatttagtatagttagctcttcttgttgcattgattcctttaccattatgtaatgcccttctgtgtctttttttaatctttattggcttaaggtctattttatcatagactagaattgcaacccctgttttcttttttttgttttccatttgcttgttatgttttcctccatccttttattttgagcctgtgtgtgtcttgaacatgaggtgggtctcctgaatacagcacgccgatggatcttgactctttatccaatttgccagtctgtgtcttttaattgggggcatttcacccatttacatttaaggttaatattgttgtgtgtgaatttgatcctgtcatcatgatgctaactggttattttgcacattagttgatgtggtttcttcatagtatcattggtctttatattttggtgtgtttttgcagtggctggtactagtttttcttttccatatttagtgcttccttcaggagctcttgtaaggcaggcctgatggtgacaaaatccctcagcatttgcttttctgtaaaggatcttatttatccttcactcatgaagcttagcttggctgaatatgaaattctgggttgaaaattgtttcctttatgaatattaaatattggcccccactctcttctggcttgtatggtgtctggagaaagttctgctgttagtcagatgggctgccctttgtaggtaacctgacgtttctctctggtgcccttaacattttttcattcatttcagccttggagaaacggatgattatgtgtcttcgggttgctcttcttggggagtatcttagtggtgttccctgtatttcctgaatttgaatgttggcttgtcttgctaggttgtggaagttctcctggataatatcctgaagagtgttttccaacttggttccattctccccatcactttcaggtacaccaatcaatcataggtttgttcttttcacatagtcccatatttcttggaggctttgtttgttccttttcattcttttttctccaatcttgtcttcattccttttttcagtaagttgatcttcaattactgttatcctttcttccacttgatcgatttggctattgatacttgtgtatacttcacgaagttctcatgctgtgtttttcagctccatcaggtcatttgtgttcttctctaaactggttattctagttagcagttcctgtaacctttaatcaggttcttagcctccttgcattgggttagaacatgctcctttagctcagacaagtttgttagtatccaccttctgaagcccacttctgtcaattcatcaacctcattatctgtccagttttgtgcccttgctggasaggagttgtgatcaattaaaggagaagagccattctggtttttggaattttcagcatttatgcactggtttttcctcatcttcatcgatttatctacctttgatatttggrgctgatgacctttgttggggtttttgtgtaggggtcctttttgttgatgttaatattattgatttctgtttgttagtttttcttataacagtcaggcccctcttctgtaattctgctgcagtttgatggaggtccactccagaccctatttgcctgggtattaccagcgaaggctgcagaacagcaaagattgctgccttctcattcctctggaagtttcgtcccagaggggtactggcctgatgccagccagagctctcttgcatgaggtgtctgttgacccctgcttggaggtctctcctagtcactaggcatgggggtcagggacccacttgaggaggcagtctgtcccttagcagagctcgagcgctgtgctgggagaattctccttgtcaggatctgctgctctcttcagagccagaagacaggaatgtttaagtgcgctgaagctgcacccacagccgccccattcccccaggtgctctgtcccagggagatgggagttttatctataagcccctgaggggggctgctgcctttctttcagagatgccctgcccagagaggaggaatctagagaggcaatctggccaacggcctccttggcctccttagcgctgtcacgggaaaaccgtctactcaagtctcagtgatggcagatgtccctcccccgaccaagcttgattgtccgagttcgacttcagactgcagtgctagcatcgagaatttcaagtcagtagttygtgacttgctgcgctttgtgggagtgggacccgctgagtgagaccacttggctcccttgcttcagccccctttccaggggagtgaaaggttctgtctccctggggttctaggcgccactcagttggaaatgcagaaatgactcagttggaaatgcagagacttctgcgttggtctcactgggagctgcagactggagctgttcctattcagccatcttgccagctcctataaatggcatttcttaatcttactgtatttccatggaataaaagtaattcttatgcacactgaagttaaaaaaaaatagcatttaaaatttctgctcaggaaagtagtataatttttaacataagtgartttctctttgtgttataatgtaatgaattcttatacgcatatggagaggaaaatgacatttttctatttatggttttagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaaygggcttcctaattttttgtagagtttcctagatgtattataatgtgttttatttgacagtgtttcaatttgcatatacagtactgtatattttttcttatttggtttgaataattttcctattaccaaataaaaataaatttwtttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgagggcacaaagactcagtggtttcgtttctcattcctcaggacattataagtaaagcttaaatacatacataaactatgtcttttctatgtaaatataatggttataaagtaagtttgtatattactaaaagttacttatgatacatattcacataaagaaaagatagcatttaaagtagtacaacactaaacttagggcctactaacttgctaaatatcctagttttctatgcaattgatttttttttaattttagtgggtccactgtaagtgtatatatatatggggtatatgagatattttgataaaggcacacaatgtgtaatcatcacatcagggtaaattaggtattcatcacctcaagcatttatcctttctttgtgttatttattttttaaatgacaaaattttacatatttatcatgttcaatatgatattttgaaatatgtatacattgtggaatggctagatcaagctaattgacatatgcattacctaacatacttacttttttctgtgagaacacttaaaacctcctctgagtgattttcgagaatacaataccttgttattaactgtagtcaccatgttgtacaatagatctcttgaactttctcctcctacccaatgaaaattttgtatcctttgaccaacatcctctagacaccttcctccagctactggtaaccaccactctactctctgtttctataagttcaactttttcacattccacttataaatgaggtaatatgacatttgtctttctgtgcctggcttatttcacttaacataatgtcctctaggatcatttgttttgttgcaaaggacaggatttccctctttttaaaggctaaatagtattccattgtgtatatgtaccacattttcttcattcatccatcagcagacacttaggttgattccatatgtgggttattgtgactagtgctacaataaacatgagcatgcagatgtctcttcaacatgctgatttcctttactttggaaatatagacagaagtggaattgctgaatcatatggtaattctatttttaatttttaaggctgtcctaatttgcattctcaccactagtttacaagggatcccttttccccacaacctcatcaatcctcatctttcatgtttttgattatagctatctaataggtataaggtgaggtgatactgtggttttaatttgccttttcctgatgattagtgatgttaaggattttttttcatatacctgtttgacagttgtatgttttcctttgacaaatatctgttgttctgcccatttttaatgaggttgttttctcaatattgggttgtttgagttctctctatattttggatattaacccattatcagtatgatgtaaactcattcgtttacgttcatctttgttgtctgtgttttatttccaaagaatcattgtcatgaaatttcccgtgccccaccctttattattattattgttgtactttaagttctgggatacacgtgcagaacatgcagttttgttgcataggtatacatgtgccatggtagtttgctgcacctatcaacccatcatccaggttttaagccctgcaggttttaaggtatttgtcctaatgctctccctctccttgcacccaactccccgacaggccccagtgtgtgatgttgctctccctgtgtccatgtgttctcattgttcaactcccacttataagtgagaacatgtggtgtttggttttctgttcctgtgttagtttgctaataatgatggtttccagcttcatccatgtccctgccaagaacataaactcattcttttttatggctgcatagtattccatggtgtacatgtgccacattttctttatccagtccatcactgatggacatttgggttggttccaagtctttgctattgtgaatagtgctgcaataaatatacgtgtgcatgtgtgtttatagtggaatgatttataatcatttgggtatatacccagtaatgggattactgggtcaaatggtatttctagttctagatccttgaggaatcgccacactgtcttccacaatggttgaactaatttacacttatacaatgagtttggaagtattcactcctcctctattttttggaatagtttgagtaagattggtattagttctcttctttaaatgcttggcagaatcagcattgaacccattggatcccagaatttttattttttaatgggagattttttactatggcttcaatcttattattgttattgatctgttcaggttttggatttctttattgttcaatcttcgtaggttgtatgtgtctaggagtttgtccatgtcttctagattttccaatttattagcttatagttagtcatagttgccactaatgatccttcgaatttctgcagtaataattttcatgtcttctttttcatctctgactttatttattcggattctccctctttttcttagtctagcttactaaactaaaggtttgttaattttgtttaattttcaaaaaaccaactgtttgatttgttgatcttttgtattgttttattcattttaattttatttatttctgctctgatttttattattttgtttcatcttctaatttcggctttgatttgctcttgtttttgctccagttttttaagatgcatgattaggttgcttatttgaagtctttctacctttttgatggatgtgtttattgatatatattttcttcttaatattgcttttgatgtatccaataagttttggtatgttttgtttccattttcatttgttcacaaaatttttaaattttatttttaatttcttcattgaccaatgttcattcaagagcatattttttaatatctgtgtatttatagtttccaatgttacttttgttactgatttctagtttttttctactgtggtcagaaaataaaattgatatgatctcaatttctttgaacttcttgaggcttgttttgtcctctaacatgtggtctatcttgaagaatattctaagtgctgagaagaatgtgtattctgaagctcctgaatgaaatgttctataaatgtctcttaagtctatttagtctatagtgcagattaactctgatgtttctttgttgattttctgttgtgatgatctatccagtgctgaaagtggaatattgaagttcccaacttcagttgtattgggtttatttctctttaacttaataacatttaataacatttgctttatgtatttggggactccagtactgggtgcatatatatttacaattgttatatcctcttgctaagtcgactcctttattattatataatgatcttccttgtttctttttatagatttgtcctgaaatctattttgtctgatataagagtgactattcccttttcttttttggtttaaatttgcatggaatatcttttctatcctttcatttttagtctatgtgtgtttatataggcaaagtgaatttcttgtaggaagcatgcagttgggtctttttgttattattcattcagccactctatgtgttctaattggagaatttagtccattaaccgtcaatgtattattgacaggaaaggacttactactgccattttgttatttgttttctagttgtttcattggtcctgtcttcatttcttactgtcttcctttgtgtacaagtgattttctctggtagtatgttttagttttttgctttctagtttttatgtatctattttagtttttcttctcatggttaccatgaggcttgtaaataacatcttataacagatttttttaagctgatgaaaacttaattatactcataatagaaacggaaacaagcaaagagaaaactaaaaaatctacactttaactttattctccccttatcattttttgagttgttgtctatatatctttttatattgcctgtatttaacaaatcattgtagttgttattattcttgataggcttgtcttttagtcttcatactaaatatatgcatggtttacacactgcaattacagtgtcagaggtgttctatatttgtttgtgtacttacttttactggtgagttttatactttcaggtgatttcttgttgtttgttagcaccttatctttcagactgaaaaattcccttcagcaaatttttgcaaagcagggctgatgttaatgaaatcccttaggtttttgtttgtcttggaaagtctttatttctccttcatgtttgaaggataattttgctggatataacattctaagttgaagaggtttttttcttcactactttgaatatattatccccatcccacttggcctgtaaggtttccactaaaaagtcaactgccagatgtatcagagttcctttacatgttatttgcttcttttctcttgctgcttttaggatactttgtccttgaactttgagagtttgattattttgtgtcttgaggtagtctcatttgaattgaatctccttggtcttctttgagctttatgtacctgggtattcaaatcttcctctaggtttgaaaagttgctatttctttgaataaaacttcttcactgatctcttattttacatcctttttaaggccaataactcttagatttgcccttttgagggtattttctagaacttgtaggtgttttcactccttttaactctttttttctccttggactctgtctttttaatatagctattttcaagctcactaattcttttttttctttacgtcttctaaaaaaatgggatacatgggcagaatgtgcaggttggttacataggtatatgtgtgccatggtggtttgctgtaactattgacccatcctctaagttccctcccctgactccccacctcccaataggctctgatgtgtgttgttcccctccctgtgtccatgtgttctcaatgttcaactgcaacttatgagtgagaacatgtattgtttggtttactgttcctgtgttagtttgctgaggatgatggcttccagcttcatccatgtccctgcaaaggacatgaactcattcctttttatggcttcatggtattcaatggggtaaatgtgccacattttctttatccagtgtatcattgatgagcatttgggttggctccaagtctttgctattgcaaatagtgctgcaataaacatacctgtgcatgtgtccttatagtagaatgatttatattcgtttgggtatatatccagtaatgggattgccgggtcaaatggtatttctggttctagatccttgaagaatcaccatactgtcttccacaatggttgaactaatttacattcccaccaacagtgtaaaagtgtccctcaccagcatctattatttcctgactttttaataattgccattctgactggcatgagatggtatcttattgtggttttgatttgcatttttctgatgaacagtgatgttgagctttttttatgtttgttggcagtgtaaatgtcttcttttgtaagctcattaattctttattctgcttgatcaatactgctgagagacactgttgtattttccagcttgtcaattgaatttttctgctccagaatatctgctttgttttttaaattatttaatatctttgttaaatttctctgatagaattctgtacttcttttctgtgttatcttgaagtttgttgagcttctgaaagacagctatttttaattccatgtctgagaggttgcatgtctccatcactctagaattaatcactggtgccttatttaatctacttaatgaaatcacattttcctcaatgttcctgatgcttgcaaacattcactaatgtctagacattgcagagtcgattgtttatttcaatcttcacaatctgggcttgtttttattcatcctttttgaaagggcttttaaataattcaaattagaaattaagacagagaaattcacccaaagccatacagttacatggaaattgaat

SEQ ID NO: 17623 - DNA, 93513 bp, Homo sapiens
  misc_feature (1)...(93513): n = A,T,C or G, or insertion/deletion polymorphism (see Tables 1-2)
ctctttgaagcaattgtgaatgggagttcactcatgatttggctctctgtttgtctgttattggtgtataagaatgcttgtgatttttgcacattgattttgtatcctgagactttgctgaagttgcttatcagcttaaggagatattgggctgagacaatggggttttctagatatacaatcatgtcgtctgcaaacagggacaatttgacttcctcttttcctaattgaataccctttatttctttcttctgcctgattgccctggccagaactttcaacactatgttgaataggagtggtgagagagggcatccctgtcttgtgctagttttcaaagggaatgcttccaatttttgcccattcaggatgatattggctgtgggtttgtcataaatagctcttattattttgagatacgtcccatcaatacctaatttattgagagtttttagcatgaagggctgctgaattttgtcaaagaccttttctgcatctattgagataatcatgtggtttttgtctttggttgtgtttatatgctggattacatttattgatttgcgtatgttgaaccagccttgcatcccagggatgaagtccacttgatcatggtggataagctttttgatgtgctgctggattcggttttccagtattttactgaggatttttgcattgatgttcatcagggatattggtctaaaattctctttttttgttgtgtctctctcagcctttggtatcaggatgatgctggcctcataaaatgagttagggaggattccctctttttctattgattggaatggtttcagaaggaatggtaccagctcctccttgtacctctggtagaattcggctgtgaatccgtctggtcctggactttttttggttggtaggctattaattattgcctcaatttcagagcctgttattgatctattcagggattcaacttcttcctggtttagcattgggagggtgtatgtgtccaggaatttatccatttcttctagattttctagtttatttgcgtagaggtgtttatagtattctcttcaaactttatttttaattgatacttttttttacctgctgagtaaaagaacgttatgcaaaagcaaaacaaggattcctcaaggattttaaagccaattattgggtgtgtagaatatagtaagataatataatttaaattgtaccttctacgtactctttcttttgtactcttctatgaggatgtttaacacaaaaaaaaaagacagtcacggataattttagaggattgtttcttcaagtattttaattgtatcccccactgaccatccaatacagttatttgatattagttgtgaatatcttttttccttttttaactttgttttattatggtacaatatacatataaaatgtatcatctttaccattttaagtgtaaagtccactggcaataactacatttatatatatatttttccctttatcgccctccacctaccgtttcctctcctatagtaactaccattctactctctatgttcatgagatttgctttttaagctcccacatatgagtgagggcatgcaatatttgtctttctgtgcttggcttagttcacttaacataattgcctccaggtccatccatgttgctgcaaatgacaggattttaatttttttatggttgaattatattccattatgtatgtatgtttctttatccattcactcattgatgggcacttaggttgattccatattttagctattgtgaatagtgctgcaataaacatgggagtgtagatatttcttcaatgtattgatttcctttctttaggatatatacccacaagaattgccagatcatatcatcgttctagttttacttttttgaggaacctctattctgttcttcatagtggctgtaataacttacatttctagcagcactgtatgagggttcccctttgaccccattttgtcaccggcatctgtttttgccttttttatataagccattttaactggagtgaggtgatatctcattgtggttttgatattcatttttctaatgattagtgatgttgtacatgttttcttatacccgtttgccatttgtatatcttcttttgagaaatatctgtcgagatcttttgccaattttgaaattacattctttgttaggttttagttttgttgctattgagttgtttgagctccttatatattctggttattaatccctcatcagatagtgtgccaatgttttctctcattatgtgggttctctctacatttagttgatgttttctttgctgtgcagaagctttttagcttgatgtaatctcatttgtctatttttgttcaggttgcctgtgctttttaggtcttacacaaaaaaatctttgcccagaccaatatcttagagcatttccccaatgttttcttttagtaatttcataatttcaggtctataattcattttgatttggttttggtgtattggttatttcaatagatgctgagatagcatttgataaaattcaacattcctttatgataaaaattctcaccaaaatggatatagaaggaacatacttcaaaataatgaaggccatatatgacaaacctacagtcaacatcatactgaacacagaaaaaatgaaggcctttcctccaaggactgaaacagacaaggataccccctcttaccactgttattctacatagtgcagaaagtcctggccagagctatcaggcaagaggaagaaaggaagggtatccaaactggaaaggaagaagtggtgagaaagttttaattttatttttttgcatgtagttattaagttttcctagcaccatttattaaagagactgtttttttccattgtatgttctttacagctttgtcacagattagttggttgtaagtgcatggatttatatgtggattctctattctgctccattggtctatgtgtctgtttctatgccaatactgtgctgttttggttactatagctttgtagtaaattttgaagttaggtagtgtgatgcctccagctttgttctttttgctcaggattgctttggctattcagggtcttttgtggtttcttataaattttaggaatttttctgtttcgtgaagaatgtcatttgtattttgataggaattgcattgaatctgtaaattgctttaggtagtattgtaattttaacaatattagttcttccagtctatcacggagtatatttctgggtttttgtgtcctcttcgatttcttttatcagagttttatttatagtttttccttgcatagatattttacttttttagttaaattgattcctaggtattgtacatttttgtagctattgtaaaaggaactgctttcttgatttttattcagattgttcactgttgtcatataaatgctattgatttttgtatgttgattttgcatcctgcaactttactgaatcagatctaacagcttttaggtggactctttagatttttctaggtataagatcatgtagtctgcaaacaaacctaatttgacttcttcctttccaatttggatacccttcctttcttcctcttgcctgatagctctggccaggactttctgtactacgtagaataacagtggtgagagggggtatccttgtctgtttcagcccttggaggaaaggccttcattttttctgtgttcagtatgatgttgactgtaggtttgtcatatatggccttcattattttgaagtatgttccttctatatccattttggtgagaatttttatcataaaggaatgttgaattttatcaaatgctatctcagcatctattgaaataagtataccgtttctgtttttgattctgttaatgacttatatttagatggtatttaaagacataggaaatgggttagatctcctaaagagggaagatggaaagagaatgaaagagtttccagaatatagccctgggggtttcccgcacttatggcggagggaagggagccatcagaggaaactcagagtggccagatagaaaggcaggaaaaagcttaataaggtggtatcatgagaagagagtcttcctagaaggagaaatgcttactcttgataaaaactgaaaaatagggtgagtccacattagaattctcgctactggggaggactttctacacaaggttagagatcacttgtattttgtctactataattttagtgcataatgcatttttttggcatatagtgggcacttatatacatattaatctgatgacatttaataattgagtgcccaaatatttatgtcgagttgagagctagggataggcatgagtctttcttaaacatccttctcttctccttcctccaccccctcacttgccttcagaagcattgatcagagagatagcagtatcttcagttttttttaaagcaacatgaaacacactttattcctgctaacattaggaaaagcgagctgttttccaagccctggaggaaggaaattcagctaactaacgtgaggtaatgtagggtggctatttcttgaaaggtagtgaatcataactataaccatactatggaaaaaagtcctgccttaccaaccactccactgactgcttgtcaccaaaactacgctatgaaacgaattgtgttgagtggctttcattgtaaaagattttggtgaagggagggaaagaaactggtaggggttcagatcagaagatctggctttgccagtttctggagggtgtcagaatggcttcaacatacctacttccttggcctcaactggaggttttgtagctgtaaacaagaaggattgcatagttcagaataacgacactgtaagctcattgtggaactgggttaaaatcagcatgtagatctactaagaaagaaacacactcagcactactacagaaagaaacagccatgggccctgattgttagctttctggaagccatttcatttttacaatagatttatcacacactgtattgactttttccagtatagagtaagagaaagttaatattcctcatgttttgtctgttgacagactgaaaataattgcattgagtttggctagaatatcctgtcattccataaacatctcaaactccacatggctaaaacttaacccatccatgcccccatctgcatgcacacatacatgcatataacttcatttctcagtgtttttttctccatgaatggtagcaccattctctttcaagaaagagaaatacttccccttgggattatcctatctctacttattgctgcaggggcttccaaaattaggttttctgtgttcagtcttgcattcacacttctgaaacccagagctgaccgagacaaattcttcaacttcctgtcagtcccaacatagatttaaaattcctaacctggctcatgaggttcaccatgtattcctgcttccctaagtcagcctcatatcacaccaacctgtgtgtggagtggctaaatactctagccaggcaagctctctcagttcttctacctggctcctctggagccctccttattgctcatcccattcttagcctgattcaagattcctggtccttcaaatctctctttaagtgtccttacctggatctttctctagttagtacaaatttttctatctaccattggagcgaacattttttgaaactttgtatcagtcctgccttactcttggtggaatcctgtggtcctagtcaagtgcctgctccatgaatgtgctgaataaatgaataagcattttaattgtgtatctgtcattagtgtcagatgtgttatttattccagcatggttttagcacacagacacactctttgatgcagacttttcttttctttttacatatagcaacaataaaaaactagactttcatctcctgaaaatatcagtctaataatcacctatggctgtctctctggttgctgaaggaaaaaaaaaaaaaaggcagggcacacctggattgcattagaatgagactcactacccagttcaggtgtgttgcgttgtgggtctccggcacatttcagaggctcattaggaccctgaccccacactggggtttacacccctaaaagcaggtgtgtcccgtggcaactgagtgggtgcgtgaaaaggggggatcatcaattaccagctggagcaatccgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggmcgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggtgagtagagttggactgatgcgccctcagcagctcagagcggcgtgagaatggcgccctrgggattccctgcccgattcaaactttcctccctcccaagraggcaggagggaaacgctgcgagagccagctcgctggaaatctgccagggaaactaacttatcttggggcggcagcgccccgggtgcgttatggtgcaaggtcttggagcttcgagtcgggggtggtgggcggaggaggaggtggggaagctgccctgctgcggactgcacatctgtggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcgaacagctccagctgggtgagttgggtrtgggaccaggagttagtgacctcccgaccccccatgtggaccccaccatagggcaagtcctggaaagattcacgttgyctgttacttctggtttaaagagcataaagttttcagtttcaactccatctcatcttgcctccttaatataaaagggattccctttctgttaatatcgttctcccttttccttatggcaatgattgcagtactctgacaactatgctagagaaatttcttatgataccttctcttcatctctccccgtctctccgtgtgtaaagcacattttagactctctcagcgtattaaggacaggatccagctaagccaagacttgagaattttatttccatctttgacctatcaaccctcttaaagaacaggctaaggagcatatcaggaatagcaattggaattgatcccatatcccgtcgtttaacctaaaggcctaaaaaaaaaagtgatagttttacttacaatatacaatctaaaagaaaaggaaaattggcatcttcatcgttaatgtagtataattttccattcccaaaaccgtcatccaaaactcatgttatatgggtccatctttttgcagtcatttctcaatgtctyagatttgtgacaagttgaaaaatgtgtactgatagaggggagaagtttcatgtttcaaagccaaagacaagtttgttgcacacaggcaagtggggaaagargaaggaatattaaataacaagacctatcttgttccaaagtgttactgctatatatattgcttaacttttttccccttaaagcaaccctgggtcatggttgacattgttcctagtttatgtatgaggactgtggctcagagttgcaaatacctttttaaaagttacttagctagtgactgataggtgggaactaaagtcaaactagggtctgaatgcgtccaaagtctaagccattttcttccatgtatgtatcttcaatgcaaataaaattaagtgaatggtttaatatgttgtctgctgagctgatgggtcatctgtaaacggtgaataaaattggtacttctttatatttctttgctataaatggacttttgagattagttattggatctttaacttcttttgtattttatagtagtctttgctctttttcaaactgtgaagctggttcccttcattcagatgaattcagatagagtataaacataatggaatttttacttttaactcagagcacctataaaagtctacgagttgtctgtagcatgtagaataagccctagcctcttgttaagcatcctcaataccagaaatcacagtaggaatgcataaaacattcacagacccatacattttggaatgattttgcaaagcataattttcattgcatgagagagttgtgggtgaagaattagggagtggagccgacaactttggtctgccagaggatcttggcaaggtctcaggagggagcaattttatttctgttgtcctgtcatagtttcctgatccatgacattataactactgatatttagtgcctacttcctgtctggatggacactgaatctatttctggatgtctgtgtttaactggataaatcatgacataatactgtattaaatttaagataatgcctgtcaatggaaggaaaaaattgtttgggcatgtgtagcatgggagttgactgttctcagagaaatgtaaacatagtagatatgtcatagatatgaattaaatgaagatcttttggatggatgaatgaataaaagtggagtgaaaatttatcaacctgactgatgagtaagataattgattagaaatgatgagccaaactgatttttaactttcaaaattttggccaatctacaaggtatttactgggatgaaaggaaaaaaggcaagattcctagtcagtcaatgagttaaaacattaatagtgatagtaatgccttgagtatttgccgaagagttgactgaagttatttctcatgtaacattctaaagaatacagatatcttttattcctcatgtaaagaaactgcctctctattcagaataaattcagtggtagcttgaagctataaaatagggattgaggctacagtctagaaataaaacactaaaaacaatacattggtaataaagataatttaggattcttaggtttgtgggctatgcactattttgtatgaagaagtttcaagagtgtgtgtaaatatatataagccatcttctgtagaagartgtgtgtgtgtgtgtgtgtgtgtgtgtgtgtgtgaatcttctgtataaaatagcttcagttgtcctgtttcaaatgtgggtgactctaatgtttcaaaaatgcttagctcagtactgacacataatacattcaaaaaatagtggttcttctttattgtttacttaaatctattatctgtatgttatctgtaacaakyaggctgaggttaatagggacaattgataaactgaaccaaaagtttaaaaattaaaaggtaatacattaaaaggtagaagytgaaatgaaacacaatgagaaatttttgttggctgaagaaaaaaatgttataatgattaaagatcgatctgtgattgccatgtcagtaaggtatcttctttcctttggaatagctttacttgctatcaagaacctgaaggtgtagggtcttcaaatggtgcccatctcccacacaattaaaaatatccacatggactagtctttgagtctctgtagaatttcagatcagtggttgattcagatagactcctcccctcaaaagagaaggtccatatctcgcctaccctaccctctgtggacaaggtgtcccatatggtatattcatgccataagcagaagtgagcctgcctgtttatctagaatgcccagggtgagagacgttaggcatgagataccccttttagtcaagcaagttgactgcagagccagcaccaagagagttgcctggatagtaccgcaaggtgcttttcttcctgcatatatattgttggcctccttttacctccctgactccccaagagacatctcttctctcacttcttttgtaccagaggaaagtggtctctctgccaggagggtctgggcccagacttgctcgtgaagactatatctgaggagacccaggtgatttctacatgtccactttccacccgggcactctgcatcatcaggcttgtttaaaggaaactttaatcacagctggttcctaaattaaggtgtcacaaataatgactcaattaatatagttaagcatagtccatccatggactatcaatattcaaatagaacataataaaacatagaaatgattatcaaattacactaaaaagatggtctttatttggttattcaaatatgtttccagatctttcattactttggagttaccactgaaagcattatacacacactaactctcatttgggtaatagtctaaagttatacaattamactatccagtatagtatccactaaccacaggtggctttgaacacataaaatgtggctagtcagcgatgagagggctgtaatgtaaattacatactggcttttgaatacttagtataagaaaactcattaatttttatgatatatattgaaacaaacactttaaaattattgattacataatattttggatttattaggcgaaataaaattttaggttaaataaaattaattttatttttacttttttcatgtggctattataaaatttaaaatttccaatgggcttgtattatatttctattggacagcactgctgtagagaaacattaagttctctgtgtaaaaataacgctatctctttaggagatgctttcctgatatttatgcataaatgagtagaactttcactttcttttctagactaagtgttctatagttactgggccttcaagctgcctgcctgtccctctcttacaggaaagacccatctcaagttagtcaccattacccatatttagatttctttctggaaattttattaccttagccagcctcctggttcatattatataacctatttgaaagaatttaattagcattgcattattaaactaatgattacctaatcctcacttctacttgattcataggagttattagcttaacattaaatagcaaatatctcactgttgaaacttcaaatatgtttttcttgataactttttactttttcatttgcaatgtgctttaaattgtagcttatgaagctgagattgcagattggtcattttgaaaaatcrtccctgaatgaaggctgttatacaattatgtagaaaatcaagacagagagcttcactaataaactatcaggttaccagaaagaagtttccttatttccagcagtttcccaaactttatgtcccaaaaggatgaggtttccacctaatttgagagatgaggctttctaaatgcactttagtttttgccttaagtttacttggtcactgagtgatatacccaatgacttgaaaatatatccccttggcaacagttctagggtcagatgctgaaatccgttgcacatgtgggtaatttatccattcagttgttcattgagggatgcctaagggcctgaacctgggcatacaaaagaaacatactccttgtcccaaaggctttaaagtttataagataggttattataggaaagtatggtgagatttaatctaggtaagacaataaagtgatgcattcctgaagaattggtgttcaagtgggggaactgaaaaataatcagaagttagccagaggaagaggctatggaaaagtttgccagaaagagcaaactgtgtgtataaagaccctgaagtctttgagagcacgatgcttttgaagaactaaaaattgtgtacagttgcactatggagtgtgarctaaactgtaggttagagaggcaggcaggaattacttctgatacaactctaagtatgaatttaccctaggatatttaaaactggggagtgacatgatcagatttgtgtgtttgacagattctctggttgcaggttagtgaatgctttggagtaactgggtcaagactgaaggcaatgaggcagttgtaggaagattttgttataatttagactacagatgacaagtgtctgtacaaggacactggcaatagcagtgragaagaacatggagattctgaaggtatttaggagatagcacttggtaattattgaatgaaagagatgagtgagaatgttccaaagatgttactgaagtttctaatttgggctgtgacatggatgatgatccaatatactgaaaaagggaagagcagcaggttttctggcaaaatgatgagtttcgttggcttgagattcctgtgagacatagaagtaaaaatctagtgatcagttctatgatcagttccatgtatgggtgtggtagacagtagagaggtctgtactagcaaatcagaggtgagtaattgacgtaaccccattcacctccaaggctttgattaccatctctctggggtaaatagatcaaatggccaatggcaaatttctaaggattcctacagttcgagaagtgattagaatagtgctgctcaagtctggctgtaacttaaattctcatgcagagcttttaacagttctggtggcccatctcaaactactagaatctctggggtaagtctatagggcaccagtagtttccagaggtccccagatgattccagtattcatccatgcttgagaaccgctggagaagaaaagaggctgaaaaaaaggctaagagggtgaagccaaagaggtagcaagaaaaatcaggtcaatctgacattaacctgattaaaggaagagagtgttttgagaagaggtgagtagttggcagtagtaaaggttgccaagacatcaaccagggtggtaaattatgaggtctcattagatttagagaattagttcattagtaacctcggtaagacaagctttaatggtgaatccactgcagagggttgagaagtgagaaacaatagcaagcgtcaataacttttaactgggttcttccttcattaatacattttattgattacttatgtattggaaatacacagttgaataaggcatggttaaagcccttgagtaactcagttgagatgatgggagagacaggtaaatggacaattaattatgagataatgtaataagcatgacaatagacaggtacatagtgatgagaagaaatgaatgggagaaggcttcctggaggagtgaaatctgagtagtggacccagttctgactggttttgaagagcacatgtaagggctcaataaatgtgaaataattttcatctttttcacatttgggcaaaatcccctgggatttgctgcacatttcagcctcattccaaagtgtctaggtcygccttgggttccaaagactcatatcaggtagttcagacagtaacacctgctcctgaaatagggagcttggaaatgactgtctttaaaagcagggatttttaattttgagattagctggaaacatcaaattagaatatggaagtggacatacaggtgacaggtctgggctcagtgtgcttgttctcaktttacctctgagaatttttaaaaatcatagaaaatcttttttatataaactatgtaaaacactataattcacaaaaatgttcagaaaatagattgtagacttagttctaaaaaccccttttatgggactccttgtgtgcagtggattagacatgttcttttgacattatgccctgtgtagaaaatgctggtcaatgtgcaccatctgtttgtgaatcccttcaaggtctacctcaccacaataccagtctgttttcttgcggaagttttctagaagtcattagactacaatcattttgtctgccagtcattgtcaatatcacattttatcctttaaactctgcccagagaaacgtcctttgatatctgtaactcctcatctcattctgatcctctattggccaggataatatgatacattcctcactggtttttctcatgtatttttaagccttcctatcttcctgacctcctttaattctttcattgctgtctttttttctttttctttttcaaccatcctaccctgtggattccaaaaccaagcatggaactttaatactgaccaccaagcatatttccctggagtattttctgtttacatttttgtattttcttgtttcaaagatagacaaagtggcatccacacattagtgattgtttttcaaatgaatttttaaatccaagagattaattgaaaaccatggaggttcagaattttctttccttattttctaatgttagaggtttaaatatgctcttttaataggttgtttcagaatagtataggtttattcaaaatgtccatagttgaaaataatggaaaagtactaacaactaattgtctggcagcatcagatggtggttgatagtgtgagttttaatcccttccttccccacttacaagtggtgtgaccttgggcaagtgcttagtcatcccttgtttcagattctgcatccataaaattgggatgataatagtattgtctacttcatagggatgttatgaaaagtgagttaatacatgtctttgcatgtattaaaactgtggtacgtagtaagcatgcaataagtattagtaattagagactaactttccctctttaaattatgcttacaaaatgtatcagctggggcacatttttcagctttagttattaaaaagacttgcgtacgttttctgtgggattttgaagaagtcctggcagagaccccaaacctaaaatcaaacccagaagtgacctagttgttagagttctgaggcctcatgatgactcaggatcagcccagatttataaaattgcaaccataaagcttggcactactctctggggacatttacctcttgaactctttctaaatagaatagaataagataaaaaaaaatagctgaaataactggctttttcaggactacaattatataaactgtttctcacataaattgagcatgattattggccattgtgagattttatttaggcaatatgaaaagatgacatttaaacacatttttttaaaaaaacatactttgagaatggtttccaactttgatgttttgctcttttgactcttattctccactagactagctggaggaaaagagttctagaagtttrgtacttttatgtcctgtatcacctctaaaacccaaggatattttactttccatcacccaaaattatttttattgtagaattcataaacatcattatcttttagaaacattgccaccaggtttaactagatgtgtgaaaagagtacatagtttaatatagtcaattattatatgaattagtattaatggatttagtaagtattaggacttaaaaggaaaaactaaattaaggggccattttaattaaaaagctaaagactgctgatcaattcttgcagcattgtgagcgccctctgctggctcagttcaaagcaccataatgcacgtaccctgaggagcagaggcattgattatttattgaccacctactaggtgccaggcattcttgcatacacaagcataagttttctgtcatcctcatagccctgcaatggtaaattttgtcatgttctcatatttgaattgattttctcacttttaatatatttttcctaatctgaagttatgtgagtgaagggattatatactttaattattgcttttataaaaaatatcttgaatgaatgactctttataaaatatggaattggaacaagggtcattcatgttttaggattaagaaaaactttagagtggaacaatttgaaatgtatgggttttgtcttacaatggaatagagcttcagcttaaaaaaaaaagacagttggtggaaggtaagggcttttactgcttttctgaaacttcacatcacatcatgagttttgaaagatcaggtaagtatatatgttgtcttagtagccagaaagccagactgagagccccagtcaaatgtctgaattggtggggaagtgacagtacgatgacgcaggtagataaagcagrcatttacttgcattagaaagtcccaagctctcctagccaaaaagtatttcactagcactgtcaaaagttatatagaaagaagaccttagagtctgaccttttccctggtccttctttctttagtggaaatgccaaaatactgagaaccattctaaatggaggaaaagagcagggcaagatagggaacaagtaagtgaccttttycttgaacaagtgaaagtcgattgtacagtctgtgggcatatttgctatattttatatattttcagctaaaagcttcagaaagtggaatagatttcagttaattcatatgtctggaatatttctagagttctatgctatagagtgaaataacttagagatcaaagatgctattttttaattctaatctttccacttacggatttgggcaagttatttgattcctttaagactcaattttctcttctgtagggtaggattaataatacagcaatcctctgctactactgtgggtgtaaaatgagttaatgtgtatgattacagttccccaataatgatatgccacatatattttatgagccaggttatatgctgcattgcatgtgcagcttaatatgcttacattaatctttaatatgatgatgccaatggcaactaacatttgcatgttttcgctgccaggctgtcatccaagcacgtcacacatatctcatttactccacagtccttgcagaaaccctcggagataggcatcttctgaggaccccagctgattctgtcttaagtcatcccactcacaaatcatcctttgtaaagatcttcaaactcagagactgtttcctttcagaccatctgttactgtcttaaaattgaagaaaataatattttggaagagaagtaggggagaatcatagtaaagagaaaagacctctccaaagcttagatctctgagagtttggtgataattatgcagtagtacattctagtaaaggatttttttgtggtgatataatgtatttcaaaattccctccctcatacatactgagttcctgcctactgcatgtaaggcactatcttgagctgtgggaatgctgctgtcaacaaaagtcaatctgccctcatggaggtgacatacaaggtcaaatatctaatctcccatagtccctgtcacacttggagcaatgacactaaaactggtgatatgaataagaatgaaagggggaggagtaaagaatgtatttaactagctttgtagtatttctttgatcaaaattcctgttcatttgcatttatatacacatttatatatgctgatacncatcagtaggaagaaataaactgtagtaagcatgcatttttacattttctttcccaaattaaaaaaaataggaaagagaaaggcttaaaaggagatggtttttaatgtggctttgttttttaaatatctagtggaaaaatgcattcaactgtggaaagaattagtcattctagttgtttaaaagcagggaaaattatcaccatgttaatttctgctgacctcttttatgttaaaccatgtaaagtactttttcaattatggagctgatttgatttactaagagtttagatgagtaatttatgaactgaattgaaaaccagattataaatcacttcagcctgacatttggataaaatataatctgaggttgtttatggtgttctgtcagagaaattcatgagaattagctctcatggcagttctaataatcgtcatttttgaccaacttagaaatattgtatttctacccaaagacaatttgcttaacatttgatatttcaataggtaactaaacaaagggggaacaaaggatattacttttatttttaaaacagtaggtttttaaataatacaagaaaaggcataaccatctgttaatacatcaagcttgtccatgtggtccaggatggctttgaatgctgcccaacaccaatccgtaaacttagaatggcgatcattaaaaagtcaggaaacaacaggtgctggagagattgtggagaaataggaacacttttacactgttgatgggactgtaaactagttcaaccattgtggaagacagtgtggcgattcctcaaggatctagaactagaaaataccatttgacccagccatcccatgactgggtatatacccaaaggattataaatcatgctgctataaagacacattcacatgtatgtttattgcggcactattctcaatagcaaagacttggaaccaacccaaatgtccatcaatgtagactggattaagaaaatgtggcacatatacaccatgaaatactatgcagccataaaaaaggatgagttcatgtcctttgtagggacatggatgaaattggaaatcatcattctcagtaaactatcacaagaacaaaaaaccaaacaccgcatgttctcactcacaggtaggaattgaacaatgagaacacttggacacaggaaggggaacatcacacaccggggcctgtcgtggggtggggggatgggggagggatagcattaggagatatacctaatgtaaatgacgagttaatgggtacaggacaccaacatggcacatgtatacatatgtaacaaaccttcatgttgtgcacatgtaccctggaacttaaagtataataataaaaaaaaaagatataaatgttggcaagaatgtggaaaaatggggaacccttgcccactgttgatgggaaagtaagtayaactataatggaaaatagtatggagattcctcaaaaatttaaaaatagaactattacaagactcagcaatctcactgaaggtatatatccaaagaaaataaaatcaatatgtcaaagaggaaaaaaaatatgagattttcttgcaattttttttttagctgatcagttatcattagtgtcagtgtactttacgtatggcccaaaacaattcttccagtatggcccagggaaaccaaatattggacacccctgagctacattgtagagctattgttcacaagcccaaccatatgctacaactacctggggggcttcaaaaaaattcttatgtctggttcttaacccagacatgtcaagtctgagcctctaagagtggggcccaagtggaggtactggtttcaaactcccttcagttgattctaacgtccagtcaaggctgagtactgagtggaaaaggagtggactcaggatcacacaggttaagggagaaaagctttggagaaggccatgatcacaagctgatcatgtagcagtcttacttcttctaccaagattccgcaggcacaacaaaagaaaagagaagctgggcatggtggtgggcacctatatccccagctacataggaggctgaagtgggaggattacaagagcccaggagtttgaggctgcagtgagctatgatcacgccaatgcactgcagcctagatgacagagtgagatcctatctccctaaaaaataaaaagagaaaaagtcccagaaattaagaaaaaacccagaacactaggggaaattacaggatgttctctgaacagattctaacctgtaaccagtacttgaaagttacctcaatattattgctgttgggggctgcctctatggtaaaaacagtgttaagaagtgaaaaggggaaacatatctaaatgtagtatatgtatttgctcacttattaagattggtttttcttctgtggaagaatgattgtttcatgactatttccatgaactttctttctggctatgcattcattctttttacacacattttgaattaagatatatgaaataagcagaagatgtttagtcaaaccataatagaagctttgaattgtttttcgtttactgacctttccatttcagcacccatttctgggctgtttgtcgggggtgggattatgacaaagatacagtcctgggcaagatgaatgaggtcactatttactaagccttggaaataggccagaaacattgtaaataaataaatgtagttaaccttaacaaaaatgaaaatacttattcctacaagatattaatcaatttcaccacaatttcctctgagtgatcgcatcctgtgtgtctaagaacccttgagtgctgatgttgagagtcatctttcagtatctaagagtggattaactaacaactgtataggagatatttgaaaattaatgaatcagaaattttatctatatattagaaggcaactattgtttggaaccacattgtaacagatatgagattacatctagtggcattttgacccccaccccaccaatttcccacttasacacctgccatatgtttttctatttggaatctcttcygctcacgggtgaatgaaccacatcactggcttcctgggaaagctcttcctacatttattcttaagtaaacatctctttcttgtggcttctggagggctaattgttctcctatttctaagaatcattatttttagcctagaacaagaagaagggaagggcatgagccacactggaaataaagtcccaggactttggtgagactacatgggacacatcttaaaatagcctaatgatttagtggcccttttcccagagagctgagaggcactcatgtggagagaaagaagtttcagggaagtgatgttagtaagtgagaaagtgagtagtttgkggtgtgtgtaaacctcagtgtgagcctgggcagtgatgacattgtgatgttacctgatggagctaaaactaaaacaagaaggaggcaatgcagaatattaaatagataagagttcataatgcaagagtttgtctagtcttcacttagaaatttacaaaacagttcagctaagaaaccgataacaatacactatttttgcacataattttttggccattttcattaagctatttacatggtacattgtggttctaaactattgtctttttaatcttctgggtggctctctctagaataatagatttgtttctaaatattggatgtaatcgtaatgaaagtgtctattatacacgccatattatttgtgacccccatcctctcctgtccttaattttcttcttgctcaattgtcttaactgagtgttgactataaattcataaaaattttagtattttcagagggaacttattaacatggctattgtagtaaataacaggaacttcatgtagactgaatctaccatttgttatctatttttgacagtaaacaattgattttagtgaaaactgaaaattgtattataatgaaaattaaaatgccttgtttgtcattctcttttaatttaaattttgttggtttggcattaggtagccacaataacaactccctattttagaccttacctatctcccacacacaattttttttctcctaccatcttccctctgttttccccttctcttttcgtgtcatttctctcttcatcccttcctttctcaagttaacacggagaccttatgtgtccacctggactgttctttaccaaggtttgggccacagcaagactcctttccaattctaatagcaaccattgccaatcaaccccagcattctttgtccagacctagtcttagtcctcctcccttcagtctagttctccaggaagccattaccagttagtgggggttgccatttattctatgtgtatgctgtcgagaaaaacattctctgcatttcacagtaacagtgttcctgaccatgagaaccacttagggcaggggtccccaatccctgggctgtggatgggtactggcccgtggcctggtaggaactgggctgcacagcaggaggtgagcagtggaccagtgagcattcccgcctgagctttgcctctgtcagatcagtggtggcattagattctcgtaggagtgcaaaccctattacgaactgcacagccgtgggatctaggttgtgctttccttagcagaatctaatgccagatgatctgaggtggaacagtttcattccaaaccttactactgcccatggaaaaaattgtcttcacgaaaccagtccttggtgccaaaaagattgggaaccactgacctagggtaatcagggcctcacctggatctgctggagcagaatctccagaggaggagctcaaacattttcttcacttcagttgtgattaaaggttttgtttttcctgaatgacattttagaaaacgaaagtataaacaaacatcttcccacactccttaaacaaaatctctcctacccaggagacttagtgcaaataatttcacttctcaaatattagccttaccaggcatagtggcttatgctggtaatcccagcactttaggaggtcaaagcaagaggatcacttgaggcaagagttcaagaccagtatgggtaacatagtgagacccccattggtaccaaaataaaaatattagtttgtatctctgtaagtgttctgagtttgcccaggaagctacatttaggggtcaacattataggaggagacaaagtgccaatgatatagagaatggtcaccataaattcatgaaaacttggtacctagtgactagtgttcaaaattaacaaaccgaagttccacatccttatccaatcaaattgatgctaatgtatttatctgccaggaattaagaacagatgcaatagaattgtcatatgccaactgaagagggtgaaaagaaagacagcaaaaagaatattaggatactgcatcttactcttccccaaagtaacttatttaaaattacttaacatgggattttaataggaacccagctataacacaaataattttttctaacaaaagaaaataatgatcactgtgaagaccacttcttatatagtatagaagtactatctagtacatgagcattttatttatgtttggctattcatgcatttgccaaagtatctattgaagttttttgtttactactgagataatctggtttccaaatcacttttatctctgttgaaaacatgagtcatattccaataaatgtaaacatagggcagtttcttataaacgcaaggcattattggtatgctaattgtatgttccactttctgcatgcttaatcatcaccttccagctccaataaattgtaccttaattgctgaggatgtattatagtctttctattcttaatatctcagtagaagaaacatttttaaaagtgctctgataatattgcttacgttgttagataaatggctaattcttttccaaacgttagacacagcagttatagttgcacaacctggtattagctttaagtggttttccccactcctagtcctgttagctatctcttatatgattgagtctatctttttatggtgctaccagtcagaggtcatttctacaaccaaagtcaccttgtattagagaataattagttggcacagagtaattcacatttatcctcacattgtgcactgaatataagatagagaagtagttaacagaaaaatactggggatgagtgcacagttttctcttcttttgtagaatgttttcaatacaactgataaaattattttcacatgctataggtagccctaatggagaaccttgtggaaagacttgtttggaagagagagacaatcagtggttgggggtcacactttccagacagccaggagaaaatggatccatcgtggtaggtattggaactggtccacagatccatcgtgaaatcagctatcctgggtgcagctttcacatcatttggtctacttttattttattcagacttgtgggcatagatggaaaaatatattttacataaagaatgaaaataagctccccactggtggttgctatggagtgccccctgatttacgaacagaactgagtaaaagaatagctccgtgttatcaaggtaaggcatgattttgatacgaattagataaagataagtaagtgaataccttttagtgttttaaatttatgttcaagtttagatgttcagaggagagggagatcttctaagtaattatgttctttttaactactcaatttctttctttacccaattgcaatagcattatttttcataaatgcactttgtgctataaaaattctacaatttgrataactctgaaatctagctctttaactacccacttttgcatcaaatttactttcaatttggtataggtgagactagtacccagcaaatataggacatttaaattgtgaaattatattggaagtctgattaaaaagaaagactttaggtttccttttttacctttagcttccaggagtaattgggaagaataatcagtgtaagcaaatctttcattcgcactcactatctctttttctaatttacatgttttccttcaagcagcaagagattcgtgtcttgagtttgaaacatttttctcatggtaactctatgctataggtagcatcagcaagtacagagctaggacataacagaagtgagcagaattggggtgaatgtcaacagagcatgtcagaggatatctgcagcaaaactaaaatccaacaatgcgtctttaggagctaagaaacatatgaatgcaaattcataattttctaaccaccctcactcaaaaaaaatccctcagcacgcaaagaaaaattttattggttggcaaaactttggccaagtatttgagttcaattatgggtgctaataagactttggtctttcttccttggaatgtgatgtcacagagcagcttatattacatatattcctattttgccttcggatacccaaaagataaaaaagtgaatattgattctcagttgcaataaaactcagtcttgatttctgtatgtttgctgtcttctttttcctaatagttttcggtttatctttaaaatattttcatagtagagtttttagtttttctcggatatacatagccacatactacaaaaatctcaagatgccataaacctaacccatctacaattgtaaaatacaggatcaggtaagatatatttttttaaagggatgaaaactcctgaccagaaatggtcattataaatgacttaccaatttattgaagttttctgcttagcaaagccaaaaggaagctgtggttccaattcttattttcatagaagtttacttatatcattttttggaagaagcaaagctttgcccccttagaaagttccaaaagcattcattcatgggactttgtaataatagacctttatgtccatgcagatcttgattcagtctatatttcagttgggcaaaatctaagaaaggacactctcttcaattaatggtgttagcaatagcaaagacatggaatcaacctaaatgcacatcaatgttggattggataaagaaactgtgatacatacacactgtagaatactacacaggcataaaaaataacgagattatgtcctttgcagcaacttatatggagctggaggccaataacctaagcgaactaacacaggaacagaaaaccaaataccacatgttctcacttataagtgggagctaaacattgagtacatatggacacaagggacacaaagyaggcacaaacactagggcctacctggtggtagacggtgggagsagagagaggattgaaaaactrcctatcaggtactatgcctattacctgcatggggaaataatctgtacatcaaacccctacaacacgcaatttatctatgcaacaaacttgcacatgaaccctgaacctgaaagtttttttttaaatgcctttgggaaaattggctatctgcgtgcaaaagaatgaaattgaacscttatcttagcaaatataccaaagtcaactaaaatggattaaagacttaaacacgatacctgaaaccataaaatttctagtggaaaacataagagaaaagctacttgacattagtctaggcaatgagtttttggaaattacaccaaaagctcaaacaacaaaagcaaaaataaacaaatgagactatattagaaagctcctgcatagcaarggagataatcaacagagtgaagagacagtctgcagaatgggaaataatattcrcataagtcctatatatttaaaatgtataaggatctcaccaactcgatagcaaaaaaccaaataactgattaaaaattagtcaagagaccaaatggctttctttccaaagaaggcatcaaaatggccaataagtagatgaaaaggtgcttaacatcaccaatcatcaaggaaatgcaaattacaaaccactatgaaatatcacttcacacctattagaattgtcattatcaaaaaggcaagagataacaagtgttggcgaaggtgtgaagaaaagggaacccttgcacactgttggctggaatgtaaattggtacagccattatagaaaacagtagagaagttactcaaattaaaaataaaactaccatatggtccagcaatccctcttctgggtatatatccaaaggaaatgaaatcagtaccacataaagagatctgcgtttttatgttcattgcagcagcattcacaatagccaagttacagaaacaagcttagtgtccattgacagatgaatgaatggataaggaattgtgtgaggtgtrtatatacacacatatatacataaacatatacaatggagtattattcwgcctttaaaaaaggaaattctgacttttgtgacaacatggatgaccccgaaggacattattttaagtgaaataagctaggcccagaaagacaaatactgtatgatctcacctatctgtggaatctaaaaaagtcaaatacatagagaagaaggtgagcagagagagggttaggaataggaagatgttggtgaaagatgttggcatttgtgtaggatgaataagtctagagatctaatgtacagcatgaggactggagttaataattgtgcactggaaatttgccaagagagtagatttcactctaaatgcacaaaaaagatgaccgtgaggaggtatgtaaagtgtagtaactgtttcactatgtatacgcatatcaaacctgatgttgtacaccttagatatacacagtaaaaagaaagcatgggctcaaaatcacaaatcctacctctgtcttactcatttgacaaaaattttttgagtatatgctgtgtgtgcttcctatgaagaagcrgagggagatatttttattgccatttcatagggatattttgaatactaatatggaagggatttgttatatcaaggttactggtttttatttttaaaaaatacaaactrtagaccttaaaggacatttttgtaaggatttaagaaacaaattatggagattttatctttaagataaaattctgagttgttttaatatttcattttagattatgtgaaaaaatttggagaaaattttgcatcatgtcaagctggaatatccagtttttacacaaaggtaattgttcaaaaaatagctgctataaatgtttacatatagaatcttaattcttctcatggtttggaagactgatatgttttaaagtaaaaattgtgtaacatcttcatcatgtctcttaaacttgagtattacaacttaatttttgccactcaaaattccacatatatttcaataaaatatcaatatttaggtggctatactgcataagatgaatgaaaatctatactaaagaacatttctttcatcaacaatttaatgaaaatcaaaagtagctatggttaattgtcttgttaacttaggtattgaaaatatcaacccaagtatgttattttaaatttctagttgaggggcaaaggaagaatatcagtctatatttttcattaaattatgataattgggaaatttaagaatttaatatccccttaaatcagatagacaatattcccaagatttcttactctctttctaacattctaggatatgtatgaaagggcacagttgtactcaaccccaaatctctcagttttcttaaaaacacactgtgaattcaggaatgttttttgactccatgaagatcaggcactatatcaagtttggggttgacagtgtctgcacatattaacagttatattaaaatgcttacaaagaaaatgctttcttcagtttaagttgactttttttaagtttaggattgtttaggagtatagaaatatgctaaagatatttaattgctgaaagtgttcatactataccaggcaagggcatgctcattccaatcttctcctaaattttcctctgtataacaaaatatgccccacattccattggacttttttccctaagctaacattattagaaatgttttccctaagctaacattattagtcaggggttctttgcaaatagaagtaaattaagtctactttttattctttggcaacacatgattatctccataattagcactaatgaattacccacatacgattttctttaataggaaccacattgcctttctcccaaaagcttactctagcgttcagtacttgtcccttcaacttttgaaatccactgataaatgcattgaatgagagtttcagagtttcttctctgagatttcgcttttagaaatccattagccaacttctctggctttttttttttcctagtatgttttaacttcacagaatattcctacttcaggaattgattattataaaaatatgttctcttcactatcgtgtatctggaggaggtttggggtggtgagattaaagtttaaataataatagttttttttttcttacaggatttaattgtgatgggggccccaggatcatcttactggactggctctctttttgtctacaatataactacaaataaatacaaggcttttttagacaaacaaaatcaagtaaaatttggaagttatttaggtactataamaattgacaaacttaaatgatctgtgccttacaaatactagtactgtaattataaataaggaaaatgtattttccaaagatctaaatggccagtataattacagtaataattaggcagttcagaaactgtctcttaaggataggatttatgaaacttcagtgaactcagtattttacatttacacatgtgactaaaatcatcaatatataattcttaatagaactcctagtttagtttactctttgtagttcactttaggaaacactagtaagtttctatctctatgtagtcaactgattatacaggttgtttctgttgagtgcctcccatatctcaggaactttttgtgagaactttacatgaattaactcatttaaacatctgcrtaagtaagtatagtttccttaagcaccaactgaaagccagtggtactgtccaccacattctggatgaggggctccatgaagcacatgggtctaaaaacagctcattgaccttcacctcataagttcttagaatatttcccagagcttaactatttttatcatcttcctcctcctcactgtcatctcataagtcaatagtaggatactttatcatctgtatttcaacagaaatgcaaacttttctggcattaatgtccattacaagaaaataaatgcttttcctatagattttcagaaaatccagctttgtttaaactgtatgtgtgtcaaatgtgagcatcttacactcagaaataattataaaataagcactctttctttctattcaaacagaagaaatttcaagtagaagaatttgttacaattcaatgttttcttgtttatgatgaaaggatactttgaaatmgttcaagaaatataacttgttacgccttttatcacataaaatacgaacaattttttgtcatcgaaaagtcatcacaaagatttggtggcaaaaaaagttgaacttcagcaagatgtttatttaaagtttaaagttttcatttcccaattgagattttatatttaatatactctaaaatatgtctgttgtaatcctagaaactgattatactgcaccagatgtaaagatgctattttcaatttctaggactcggaaatacataccatatgactgcagttttgtaaaacatatcaaaattgcataaaacataatgaatgaccaattttgagtatctctatgctaaatattcttaactgcttaatgtagtgattttgaattcggtatcatttaattttatgatctattttacccatattaccatatgatgtactttacccaggactctcatactttctcccttttcttaaaggatattcagtcggagctggtcatttycggagccagcatactaccgaagtagtcggaggagctcctcaacatgagcagattggtaaggtaagaattacatttttatatttatttcttcacaaaggttcaaatatattgcatgaataagatattaaaggagaaactgtgaatgttgtaaggaaagaaagattagaaatgatgaacrgattattacatttagyggaattggtgaaagatgttatggttttagaagaaatttagcaaaaaactttctgaaaaattacaaaagtcaaacgagacattgttttaagaaaattataagatagaactatctaaaaatgtccagggagtatatggtgaacagtttcacagctgaaaagaagttgaggtagctacatattttgtagtaagactagaaagaaggaaatattattcctggttttagtttttgctgtgtcgctatgtgaacattggtcacccagcttttctgagccttacttttgaaaactgaggcaaacaacacttccggtgccccctctataggatcaataagataattcctgagaaaatacttttgcaagtaaggcatattaatgtaacagtggatcccaaayccttttgtgtcactctyaacaggatttatttttatatttgagcaattaactgcaagttgtaaaaattcatgttttgatcaaacagaaaggagtggtgttttaaaaaatgttattcctaaaaacttttctaattcyttccctaattacaggcatatatattcagcattgatgaaaaagaactaaatatcttacatgaaatgaaaggtaaaaaggtaatatgtctctacctttagtatctctgtgggcttttgcgagtaaccctgcttttttctcaatgagtggatctggtttgttttgggacagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcggtatgtccaagtgccccaactggaagccatttatggaattatgatcaaaactcaaattggtcttattccagagatctgagattgttttcaggtttcttttattgacaaaagttaaaattctaatactgtactgatgctctaaaaattaaatggaatatgatgatgaatgggaaagtttcccattttgatattccagaacaatctatgaaatagattgttagggagtttctctgttcacagcttgtatgtgttcactctggtagctgaaatttctttcagttttatgttgatactaatctaatttgaaagaataattttcatacctccttcaaaatgtagatttcttaatagttctagttaaggtccttatataaattataaaatattactaggactagaagatgaagaattaagtattttcaatttcttaatttgaaaacaattagaaacaagatgtgttttgttaaaacattaattttcataattcatatatattatgctcttgataagaatataaaattggcaaggtttattccacagtggatatattagttgcataaataggtaattactgactgtgattcaattttaaattattagtgataatttgtggtagaaactgaccacttgataattcaaagacttctggccttatcttgccagcctagattcttggcgttaagtcaaaacaaaaaattggtggagtcttaatgaaatcttcttggcccgttctttgatttgaaaacaagagtgggcttgtgagaagaccagttcatttataatggcatagcatttttcagtcaggattcaacaaagtggactctgtttcaagaaagtatttgtaactatgttcagtcaatggtttcagagcatttagcaagttcttatattaagcatcagactaaactctacaatttaagaaagaaaacatctagtctcataaatggaagattctctaagtttrcaatatagagcagggaagttatttatgctttggtatttcctacactgtatttaacctacatttaatagtaaaagcaaattatctacacagtgatcattaaatctcatagtagtaatatcagataattttcttccatttctatctccaaaaatagtggtctttgtacttgctacatcctcgtgctgcaaatttctcttattttcctctttacgactaaacatccacatgtatacctaaagtaaagcaatatagaatcattttcccccattgaaatcttaatctcattaagaaaaaacagataaacccttctacccacttggctaccctccttttcttccctcatgcctaccctgaggcactactcttatgaaacacttggattaaattaataattgattccagcttttaaatcctctgatgtagattagtcttcctttgttccatctaacctctcatttctcaactctgaaatggcactaaccactaagtggcatttatttacattgatttgatttggtattgtstgttcttctactgtagtatagatgccttgtggagagagattgtctgtcttgtttaccgtggtttcatcagggcttggaagagtcctagacaagtaggtgaaattgtttttgaatgaactcaagaaagaatgatacttgagtgactggcttctgcctacttgtactaaaatagctctcaggggttcctagcgaactctcagtcaccactctctgtgactagggaatacttgaagaagagtgatcacctcttcctattgaaactctccttccagaacttcagagccattgcattgtcttaagtctataccttgtctgttctccctggagccttttcacccttccactccttaatttggacatttgcccaggagccaagctgttttatccctgactcctttgaatcaatcattcactgcttcagtgtcagtgattatatttataaagatgattcccagtcatcttagttcatttaaaataaaataaatgacatttagtgagtatctgaaatgtaaccaggactataaaaagagctaataatcttagagctgaccccaggacttcaggatctttgtgaagacaccaatgggagtaaacaattgactacaacatggtacatggcacattataagtacatacaaagtggaagaagtgattccctttgggtcaagaagcttttacagaggaagtagtgtttgagaaagacaaaaatcagaatttttctattggaaaattcacaagtgaagacacttgacaaagagcatgtgtatgcttaagaggtgccaagtaaatttgagaagaataaaggacatggcctttttttctttttaatacaaaagactgacatgatcaaagtttcagaagagaactggtagctgttattgcaacagcccattattacattattgaatgtcttattgtagtaactcatcttcctccttcctagttatcagttgactaatctatgctccactgctgctggttccaaaggccagcttcaatcatgtcactcctcaactcagaaaccttcagtgtttagtattattccctaaattaagagtaaattttcctcgacaatcaagacgctacactataagactgcaatctgacatttttgtctcattcattatacataccattcattagagccaaattctttggaatttgttttgctgctagttttctctgtatatcaaaattatgcttatccttcaatagcctccwggcatgccatttcctttatgaaatgtcttctgttataattagattttttttttttgcrtctcgatattgtaaagcagtttctacttctcagtcatttatatgcttgtgctaagccttccctataactgtgggcttattgaagaaagggaatgtgttttgtgcacacactgccttgccccttttcaccttttcgctctttgcacagtgtgttgtctttagtagaggctcaataaatatttgctaaattgaattatcaaaatgatttattggattttcaaagctagagatcatgagtttgacaattttttatgtcctctgaggtctaatcatactattatgtgttgacagactcaataaatrtttattgaattgaactgagatgtgtgtactaaagctcagtctgtagtttgtccaacttgtttgacacattagaaaaaatccatatccaattacaacagtaaatcgtgtaaagttgtcagggagtgttataatgacacgttttctctccctttctatctagggagcagtaatgaatgcaatggaaacaaacctcgttggaagtgacaaatatgctgcaagatttggggaatctatagttaatcttggcgacattgacaatgatggctttgaaggtaattaaaattatcaaattggtacttgatttctgcttttaaaatggtttatggaagaaaatatgattaaagttttgtattgttttccttcctatagaagatggagccagaatggcatgctaagttttttcttttctttagtgttatatatgacttctcctcaattgtcacccattgatctttaccactgttaataatggatgatattcaaaataccttatttcagtgattctaaggcaccattgattagaaactgcattattatttatgtgtccctaaaagctacctattaagctgttacacccaccatttttctgttaaggaagatcctgatttcagaaataataaaatatgggcaggaaatgtgttatcatagactcattggaccacggtatttaactatcagtacaataaagacactgaccaaacccaacagaggctggctgcagagctggagcagggttctggaagcccctgctctgccaggcattccctayagctatgttgtggaggatctggggaattcaagaagagattctgagcaggccactgggaggcctggggacagtggctgtttacccactgatattgamgttttttattaattgaatagatggtagtgtggtaactgtkcatattgccatggatgtcagtcctgttgttgaaatccctgcatctactagcatttactgttaaaaatttgcttttatcaatctagttctaagtggtaagtaactgagtctgttaaaactgtgcataaaatggtgaataggtttaagaggagagtgtgcagtttcatggagttcagcacataagtatttgatacttatttttagggttcataattgtcttcttgataaggccattggcaattagtatacggtagttttaggctaaagctttctcagagattaaagtgctggggtactataaattctcatctccttaatgtcttcttgtacctagataccacaatctactttaaatatataaaatgcattattctacataaaaagtcagttattgaatacatgcttccagtgaaccttcttaaacgtaaratagtgtaacttgttatacaagtattactgttctggattttttgtttactattttaaaactgaaagaaaaaaataggtgtatatacttttggttattacgattacacataatttttttaaaaaacatgtatgaatgggagcctctctgtaccccacccatcactagcttccccctacttcccttaccctcccaggaccccaggttgggcattggctcattttcataaataacctcatcccagacaggggtragggaaggtgttgtggctgttttgtttaaattggagctgtaagagggatcatgtcatattttatgcccttcctagaaaggggacgggacacctggtttgcattcctgtattgaccactgctgccgtcactcgtcacattgagttcacatctcctgagagtttgtataaattcaggtcagcgctgctcctatgcagccatccagtgtcatagaaaagcaattcactgataactgatctctccattcagaagtgtgcagttttaatrtatagcaataagaaattgttatttatctattacaagcctggtttgattaaaaacaaaaaataaaatgttattatgcttgatgttacatctcataagtaaccagcaattctgtgatatttattgaacatttattttgggtcagatgtaccataccaggtacagaatatgtgccrtaataaatgaaaatgaagaaaatagtggcacccttttttatagctctaccatcaagtagaaaataaaattaatacttgaaaacataagccttatttcgtggcaagtttaagggttctacctaataaagacctatggataaaaccatgtttatgcattttgatttgtcatgtgtgttgtatgagacaacccaattctttcttttaaaaacrcaaaatcactgtttagtaaaacacttattttgtctatgatttctctgtcttgttttaattgacacatttaaagaagaccattcactatttttactcttttgaatgtgaaaartatatgtatgtacacatgagaaattatttttgtggcatcaaaatgtcaatgacaaatttgaattattgttagagctgtaaaactgttgtgagcataggcaaattcccttatcaaaattactctatacctgggaaaagcccaagtaattttccagtggtgtgaaggacagagagtgttcggtcgatgagacttaggaagaggacttcggaggtgactttcaggggacagtgcagtctctcaatttgtatatgagaccctgggcttcacacagctcttgtttcactgaaatccctcagcactccactcctaaaggtaatacctttatgtctggaaggttattatgcaaatgattttttaaaatattcctgcatatttttgtgctatttataatgtcatttataattcaccgcatatttacatttagtggctacattaacacttcagtgagtgtttataatgccatatatctttttctrcttggtccagttctttttttattttattttttttttgagatggagtctygctgtgtcacccaggccagagtgcagtggcatgatctgggctcactgcaagctctgactcccgggttcatgccattctcctgcctcagcctcccgagtagctgggactacaggcacccgccaccaccccmgctaatttttttgtgtttttagtagagacagggtttcactgtgttaaccaggatggtctctatctcctgaccttgtgatctgcccgccttggcctccaaaaatgctgggattacaggcatgagccactgcacccagccctccagttctaattttatcttctattttgcccatgagtaggcgttttctatattttagatattagcaagaccattgctgatgtggaaacagggccagtgtgtcctagttcttggctgaggtcttttattccattccaccatgtctgcctgcatgaggcagcaggaatttacaagttatttttctttatgtgtttctttattactttgccccatcttctcttattttatttttctggggtggatgggtaaagatactttgtgttcatggcaagaagtgtaggattatgaagaaagagactccaacattggatgcaaatcacacttaatgtctttttattatgcaaatttttgtggtactttgcatagcaaacctaagttatcttggcatttgtcatatcacttttcaattgttctcaaatggaaaaaaaatcagactctatttcctgtgtccttagaaaagcaacacaagccattttctaaaaagatgaccaattgatttggcaaaaatttagtgtaaaactcatcaaaagcatgaaaaaaattggtcagacagactaatgtacctgacatgaccaacagcagatcacattttttatttcatatgtaaaatagacttgaccactatttatcggtttagtttcttttttcaccttgagccttattatctgacttttagactatatgtytgaatatttttagagcagaaccataacaagttctacaattgtaaattacaagctgtactattattttgtgtgcacctgaaatattaatatatcgtcaaatcattaagtgagcacttctgttttatttgtttatagggtacaagtgaaattttgttacatgcatcgattacatagcgatcaagtcagagcttgtgggtatccatcatccaaataacatacatttttacccattaagtaatttctcatcatccaccccacacaacctctttcccttctgagtcttcattgtctatcaaaatgtagcaggacgagccacagacaaaactcttcggacgccgagttaaagaaggaaggggtttatttggtggggggcatcggcaagactcctgtctcaagagccgagctccccaagtgagcaattctgtcccttttaagggctcacaactctaagggggtgcacgtgagagggtcgtgattgattgagcaagcagggggtacgtgactgggggctgcatgcaccggtaattagatcggaacaaaacaggatagggattttcacagtgcttttctatacaatgtctgtaatctatagataacataaccrattaggtcggggtcgatctataactaccaggcccaggatgtggggccaggctgtctgcttgtggatttcatttctgccttttagtttttactttttctttctttggaggcagaaattgggcataagtcaatatgaggggtggtctcctcctytaattctactttatacatccatgtgaacacatttttaaagcactgatttatgagtaagagcatgtgttattttactttctgtgcctggcttgtttcatttaagataatgacatcccccaccagttccatccctgttgctgcagaatacatgatttcatttttttttttatggctgaatagtattcgtgtgtgtgtgtgtgtgtgtgtgtgtgtgtgtgtgtctgtgtgtgtgagagagaacctctttgacacagaacaggaattggtattaggaagggaaatttgggggtatgacctctgttgttaatgagtctatagagcatgggaatagcacaggatctggaccaggctgcagggtttaaatcccaggtccacaacatcctggctctgtcaccttgagcaggttataccttgtgcctcagtttcctcatctgtaaagttggagtcagagtatttatttaatatggtggttgtgagarttacttgggtaaatctgcacaaagtccatatcacagtgcctacattgtaaacatagtataagtgttggctgacatactaataattttgatttatactaaaagaatgaaataaaatgttcagataagaagtaaaagcaatcattaaatacctatgttctgtatattgtgtcccaaattaagttgcataggcttggaaaacatttattgtatatatttcaaaacatatctttctcatttgaataatgatagctagaactttattatataacagatccaagcgtaatccaggaagagtctgaatctatatatgtgatagccagagattgaatatacccaagtgtcctctgtatggaaaaaaatttatctgggcctttttaatattttggctgaaaaggctcatctgtatttttcctaaatatttgccttaatctagatcactcttgctaataacaggtactgtaagaattacatcgccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacaagggaggctgaggcaggagaatggcgtgaacccgggaggcggagcttgcagtgagtcgagatcgcgccactgcactccagcctgggcgacagagctaaactccgtctcaaaaaaaaaaaaaaaaaaaaaaaaaagaattacatcaaccacttcactaccaaggcttgttatttttttcatgtgttatgaagaatcaatatataggaaattctagagatgtaaccacagtggtggaagtataaacccagccctgattaaataaattgctgtcttcccttcaatggctataaaatacttttccccactccttcttctcacatccctcttctcctcctcctcctctttstcttccttaccattcctgctcctctgttcctgtatgtatatattctgcacaaatctgactccagttattccaaaccaattgccattcttcacatgtgccatgctgcctattgcttccctgcccttgcacaggcatttccctgcctctaaattgcatttccccttttcttcacctgtctatgacctatggatactttaatctcatcttgggcatcattttctatgagaagccttttctaatttccaccacttcctcctcatatgctgtgttattagtctattcttacttgccattcctccccactagacaatgagtttcctattgtgatactgccctgttttgccagctcctggcaattgcctggaatatagtaggtgctcactagctgtccgatgaatgaataaatgagtgggcatatttgtatatgaaagtttgaaaaactttgtacaagtcaaaagaggctagcctttgtatgtctaaacaaagtaaatataggtgtctaccatttctttttaactgaaaatagaaaagcttttgcatttttaaaattttacattgtttagcatggagttatatatcaaagatatttttatcctcattgaaatagtagccmaaaattaccactatagttgataaaatgattttcaatttgatggtaataagtaatatcatgaagacaaactactttaggtttctattaaataaaccattgcatataagtaaatatatgcataaatagacaatacttggtaaaataatgaaatgctcttgcaactgtagaatattatttttctcctttgtgctatatatttatagcatttaagcaaccatgtcatttactcaggttttcttatattagttgatcagatcttttttcccttggtatcatagtctgacataattatcaataatacagaaaggtgatawaatcattattttacagaacaaatcctttttctgaaatcctgtgtgtctgtgtgtgcagatatctctaacagataccttaatcattttcattggaataggaattaaragtcattttgcaaataaggtaagtctagactcccaaaataaaaattcttatgatcaaatattcatagattatgaggttattacatgcgaggcactgctctaagcactttacataggtcatatccttttatgctgagagtggtttttattatgatcccattatataggtgagggaattgaaacacagattaagaaatgggcccarcctagtgtggcagtgcccagtggcagagctcggatcagaccccagtggtctggctgtagagcccgygctctaatcattttgttacactgcctctcagatgcttccactctgctttcttccatgtgcaaactattgtgtgcaatcctgtatatgatgatgatagtattttatttttttctgtctgagaagactgttatttttcataaaagagagttttcttatgtgatatgaattaaggttcataaggttagttttcgaagttgcattctttgtatcaagaatttatttttccattgtttaaattattggatagatgttgctatcggagctccacaagaagatgacttgcaaggtgctatttatatttacaatggccgtgcagatgggatctcgtcaaccttctcacaggtaaggtactattctatttccaaaagaagcattggttataatgcatatccttaaaacttccagggtttatgtggacttatttttcttaattttctcattcaaatacttaacactttatttcaccrtttacttatagtggcaaatgatcttattttaagggattaataactcttcaaactccctttctccataaataagagttgtagttcatttccaccctagcttgtctatagcccattaaagatttctctttgtatttcattaaattgcattctgaggtaatatccatatgattctaaaatatgcccatttggatttgattaactgtgtcttggccttgtggctagagccccatattttgtgaagattgcacagggagatcaaacacacatatgattctctgggtttttttcactgttgagtagtaagatgatagcactttaataatgtctcaggatcttactctgacttcacttttgtatgttgaaaaatcatggcatttcagtgcctagaaaaaaaatgacattcatatgcagagaagaaaagtttttcccttgatatttgcatggaaatattagctggcacagttatttttgattagaaaaatgagcaaatggttctctgtaattgacataaaagaaatgtatttgtctagtaaaaaaactaattttcttagcacgaatatcagcttaatatttataaacctgtatgtgaacatgaaattagatatgtggamtagaaagtacatatctggctagggttgttcttgttaaaaagtcagcttttatcaaaagcctcagtcataggctccactaagtgattatagacatcttgttttacaaattcttatttagttattcatgttgggcaaggaagtaaatagagagcctgaagagacctaaggaggccagacatggtggtacacacctgtaatctcagctactcaggaggctgagctgggaagactgcttgaacccaggagttcarggccagcccaggtgccatagtgagacccccayctctaaaagacttgagagggagtaaagactatttcagaaaatctgtacagcataattttccctttgctcgcaaagtaaatttttttagtcacaaatgtcacctgttcatttcaagctggaaaaattttgtcacccttagaagtatttgatttaactaaaatgcagctttgttagtagatgtgccaaggcatgcctgggaaagctcattatttagctaaatcattgcttctctggtatattagtattcaaaaactasttcccactcaactttcctatttttcagagaattgaaggacttcagatcagcaaatcgttaagtatgtttggacagtctatatcaggacaaattgatgcagataataatggctatgtaggtgagtaattagtttatcataatttataaattggaataagctctatcatagayactgctttatagtgaagtacrtaaaactggtatgaaagacttcatcttactgataattttttttcttcatttttaaagttctccttaattcattcctaaaatgatcaagtaattcctcagcttaacagtgctagttacacaatgttatagtctgtgtttttgaaaacatgaaagcactcatgaaaatcaaatatatgaggaaaagaaagaaaatttttatttagaaaaatttgagtgaatgtttctagtccaaaaattgaattttgttttagtaaacttgtttttgtcataaagtttatgatatatcataatgggatgaatgttgtacatgaatagattcagagaaaagtggaaagaatcgtaagatgttagcatatattctctaattttctataaatagtgttttaggtagtcaaaggtgatacgtagttaagtatttatggctgaaaaataattctctttgactaatgatgatcattaatctgtgttgttttttawcctccagatgtagcagttggtgcttttcggtctgattctgctgtcttgctaaggtaagactgatatatttcactgcttaattgcaatttggyttaattgtaaaatgatgggaggtggtgtttaaaatcagcagtggtagtgacctcatgatgctcttttggtattctgaagcttaattattgatttttagggtatttttttcaccttacagagatataattaaatcatcaaagtcaatatttttagacatttaaataaaaagttattttgccctgtgcacagaaatgtaattagtatgtacacacataataagactcatgaaattacttggtgaatgtaaactgaaaaaacaaacgcatttctctccttaaggaaaaataattctgcaattaacattgctrcttttrtttccttctcaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattggtgggtatgccctacaatattaatgcttgatggggtgcggttcattcattaatcccacaatcctgcttggagccctcaccggttttcaccacggagatcttctttagagcgggggagagaagctacctgatgcatgcttttcctctccatcttccagattcttgcgttgttctaaccaatgagttgggcacattagaaggctgtagttgtttagagattatgagaagcaaaggacatagtatcacttgctatattagtttaaggtaaaccaactgagcttaacctgtgaaatctctttcttcttgacattggataaaattgacattttatcaagtgtcaataattgaggaaagccaggcatggtagctcatgtctataatcccagcacttgaggaggctgaggcttcagcccaggaggtccaggctacagcaagctgtcatcacaccactgcattccagcccgggcaatggaatgagaccctgtctcaaaaaaataataaccataaaaataaatattaaaaaaattgaagaagctagacttgattctgatttctataaataatatgcttgttaataatttactgcgactacaagctcctaagaaccgtcacctatgtccctctgtataggcaactctcaattatctgctctggagaaagtatcattgatatagctcatccaaaatattgtggtggggaatcccaaatcatgtatatatgactttataagtatttttgctagcagattaatgttcctaattatgttttatttaggctaatataagaataactactagtgaaatgagcctgtggtaggagaagagcatatctgggcatatcatttagagattaataattcacaacgtttatgatcccctattaggacctgtcaagagtttattgtattcatgaccctgcaggctgctgttatctaaacatcgtgaagggcccacatacttattaaataatgccatggatatgtaatagaggtcttagtatgcattaggtacacaatgagcctgtacctgaaaggtacacaatgagcctggcatctctactttagatcagactcatttttaatagtgtcctggaaaagtcatggccagagctacagtaataagagggtggacaagccttcatctagttattgattggaaaatggcaatttgagagcctgaccacagagtaaattacacagtaacacagacaagctgaaggataatctgaaagacacacattgagtagatgacgctctttccttttacataaaactagtgtttcctctactaacaattccattgtgaccagatatttttaaaaatagttgaagacaaacatacgaaacacataaataatcatcacattattggagaagcataccttataattatcataaaatgactcccaggagaaataattcacatggcaagcatgtttaataaaaccaggacattttaactcttactaatagtggattttttttcacctttttcatttactttttttctgaactcagggcaatgaacttgtagacagctatatcaattgcagtgctatttctctgaggtattgaatctcagttattataattttgaaatccaattggcttggacttcattattttccaactaaaaagatgattgaaggatttatttgaaatgtgtaaagagtaatatagattttatgcttatgtttccttgaaaaaagtaggtaaaattcttctggaagtgttactcctaaaatacaaatgaacatgtcaagaattacataaattctttaaactatcacttatgaattattgcctctatgtagtgagtgacacctcagcagactattagatttagcttgcatggcaaagaactcatttagattcatgaaatggttctcactttcttggtaagatctggcttggacgtttttgttaattttttcttttttccttttttttttctttcaaatttggagatcttcatgagcagatgaatatttactatttcagatttgaaataaaccctgccaaactgctagaatatttattgagagaattttttaaaaattgcacaaattaacactggaaggtcaaactagaaaccaataacacacagaggaaggacagataatcagggcataagactggaaagatgacatttttaagaaaaccgtatatatagatttgactwaatcatgtgttcacttcatgtataaaaaaaagccttcaaatcagaaacaaatctaaaatataaaaaagtcatatataaaattagtcatataaccacataagatagaattattccaagtgacatttgagcaaagtgctgtgtctatacttccttagtcaatgttctgagaaaaaaaggaatatgaaacatgcaagacwtttattagcaacaatttttatatttttgaaatttttatataaagattaagcaaataactaaagattttaatgttgttaatagaaacctagaggaaagttcataaatctttataaaagcaatttttaaaatttgtatttttaattgttccctctttcatatttcaggttagtctttaaaaagctgtttaataaagagaattccagatattatttccagtagtccatataactttaactattatcacttcaaaaataacaatagatgtatttcagtaattagattaattgcaattctctatatttttgcagttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcgggtaatgtaagctattttttattaatgaatatgtgaacttcaacgttgttgatagagagcaacttattgtattsgtatctttttataaaatgtagataaaagcaactgtwacccctcctgaactatracctgttgctccagttaaggtatgagacaatctcaacccaagtaattcagagtcctcttattgtatcatcctttttcacatttatcacatttgacctcatcatttgaaaacacttgccttttcctttctaaaatttcatttctcctatccctctttatctacttgcctagaaatatacatcttcagtagctcaactgagcctcaaatctattccgtggtacgttttttggggtgggtcaggggaggcagggaagttagtttgtttttcatacgactccagcgaagcagaatccaacatgactgcttttgggttatgtctttgtttccgtgccagctttgccagtgatgtcagtgggaactcacacagttgtagcatggtggggatcatctgtgggccaggacgatagctctcatgatggtttggggtatgtcctgccaaagcacagccgatttcatgtttcttttattaaaacactcattcccaaactgatcatcacattcctcacattggtcaaattttatcatatgaagctgtgccaggtctttttcattagggaacggtgtacttcatcagaaaatctattgtcacaaaaaaccaaactattcccaggagccctttctgggatttcaaatagtagcttcagcttagggcttaattttcccttagatacttattccaagcaaatgcaagcaagcatcaagactccaatacgctattaaatgctaagagcaataatccccatgctatttcctcatttcccttaacagtttttattgttgtactagaataaacctattagatggttcagagccaaaagtatagaatattaatgtaaccatcatttatatggtaggaattaaagaggttctttttttcatgcttcatagatgtcgttttacttaccttagtcaattgtagagacaaatattgaaataattttaaaggcaataaaagggccaacattagatgttcacaaagaaatacattgtgttaaatttgtaaaagtgatctggtttatttagtcctgtgtttcttggcatcgttcctgtaaataagggatcatcaaaattgtacagctttttcggagtaaatttgtagcagaaatgattagcagaggtaagtgttgtgttgcatgtatatttgtagtgttaccatggttttgatggtagcaagattcagccattgcctttgtaccatattgcaaatattaaatgatagcacttactgctgggattgtacatggcagggactttttaagaaatgctcgtttccttcagtatctttttctcttcctaagttaccttgcttgtgtttggaacacttttaaaactcgtatatagaaaggcaaaaagttactccaaccctctcctttgtaacaaacccacacagaagataagaaccacagttgcagctaccctgaacttgagttctgtcaaggagctgtagctgttacttaagaaggtataggaatgtaatgattgtactttcccacctccaccagggtaatagcccaaggcattaggaaacattaacactcttaagtttctacagtctgaaagcataagacagcaacctgaattcttccatcttcctagaaaagaagacgcatagcggttgggatgcctgggttgctcctgtgttccataaaacgcatctggtaccatggtaccaggagtgggaatgttaacatatgtatctattttatctctgcattccttacaatgaaatgaagtggcacttgttaattatgtactggggcccacaacccccacttgtcagaggactccctgcctgtctgttggttggacatggtttacttgtgtagatgtccctactggccattcactccattaatttgataggtatttattgagtacccacattgtgtcaaattctgtatataccagtgaataagacataaaaacatcactaccctcatggagcttatagtctactggggtgagaaaaaaataatatgataaaaatatacattttatagtattttggaagatacaggtgataaaggaaaaaggagggcagagtacagaaatgtgcagtgctgcagaaggagtgaagcggagaattttaaataggatactcagagtaggcttcattcagaaagtgacatctgagcaaagacgtgaagaaagtgaggaagttacccatgtagatatctagggcagttgttcttagttttagggtgtaatagcaacaacacctgtagggcttctgaaaacacaaattgctggcccccatctagaatccctgatttagtaggtctgcagtaagggctgagaatgtgcatttctgcaaagttcccagaggacccatactttgagaacagctggttcaggagaagagtattccagcgagaaaagctgagtcaaaaggcctcaagaatgtacctggttattttaaagaacaatggggaggcaaggatggctagaaatgtaagcaaagggaagaatggtggaasaagagatwatatagaacctgtggctttttctctgagagaaagggggatctataacagcattttggcagagaagtcacatgatctaacatacgtatacaaaggaacactctagctgctgtgttgtgaatagagtaggagatcaagattcgacacatggagaagaggctactgtggcaacacaggtgagaggatggttccaacaaaagtggtggcagtggatatggtaagaagtagttgaagtcaatttgctgacatccaatttacaatttgctgagagactggatgtctggcatctgagaaagaggctctgtgatgactccagggtctttagcctgagccacttggaaatgtagttttcatcaattgagacaatattgcaggagaacaccttttgagtggaaaattctagagttcagtcgtgggcctgcttagctagagagacctattttaaatgtaaatatcaactaaggctttgtacatactcatcttgagttgaggacaggcagagaacaggaaaggtaacttaatatatctttggcatatggatggtatttaaagccgtattaagatggctgagatcagaagagggccaccgtctgtactctgggccgctacaacatgaagaggttggcaaaaagaggcccacagaggagataagaaggtccaatcagtaagaaaggaagaaaatcaacagtgtggcatcctggaagtgaagtgaaaaaaggggaaagcatgatgatgttttctatactgcagcttgatcaaataagatgagggctgaaaactcaacattggatttataatgcagaggctgttggtggtggtgacaacagcatttcagacattagtgggggaacggggggaaggaaaggaattggaagcgtcataggttattctttcaaaaagttttgccacaaaggtgaccaaagaaatggagctgggggtcagtagctgaactggagtgaagagttttttggggttttgtcttttaagacaggagaagtattagcatgtttttatgctgataggcatgctgcaatagagtgaaaaacttgggatatatgtgacaggggagaagagctggaactaaattcttgaaggcaaaaagggaaggattaaatgtacaagtgaaagggttggttctagataggcatgtgcatgattcatctgagtatgtgcttgcagatgctgggtagatgtggtgatggggactatagaagttcttgtctgattgctttaataatctcagtgaactaagaagcaaactcatcaactggagtagggatggaggaagtggcatttggagtttgggaagatgtgaaatagtcttctaggagaatgggagagtaacaaaatacaggatggttgtcagatggtgtttgggaccacttgcacttattgtcataaactgagtgtagcctgtgtgcttgtgttttttttcccagtcacattcagtcttgcaggagtagatgaagagttacaattaaccagggttgtagtttggtcaagagagtgaagcaagcaaggagcatgcagcgggagggaatgtacaagggaatggttatatttttagttgtgaagttgaagcaggctaaggaggggagggggcacaccaagacggtgagggaccaggaaagaaatttgaattggagatcccaggacaatcagcaaattgttggaattgactattaaacggatcgagctgcaaagatggcatagatattataaaatacaaaagcccttggagacctaaaagtgagggaaagattgaattttgcttttatttttgctgacaatactttgattaccttatgcaaacaaaagcctttaaatttacttacaaaatccattgcgttctttgatggcggggaattcggctgtcaaaaagactccagatcttaagtttaaaaaattattctcttttaatcacaattctttagttttatgctagatcttcttggactagaggtgcatttttaatagtctaataaggatctatatcactggcatgtagatttttgttctggcatgttatttttctgaggctatgttttcatttatctggttagtaggggaatcagttttcttaagtctaatcataattaaaagagtatcacacaggattactttgcttaactggtcaaaatttgttcctcataaaataagaaagaaggaagaaattgtctttttttttttttttttttttttgctttaaaaaaacctttgtattttagttgattataattatgccaagctttaattttggccaccagagccatacaattattagattttgctaatgagttagaatgatatttctgtaatataaaggaaatggttaatttcatttatatcttttagtgttttatctattgaaatcgtcttctattagacattgctttttcctctatgaaaagatgtttccccatttatgtaagtatatgaaaaatctttgtttttgctttatttaaatatacaacttcatcaaattgtggagatttcttaggacaagggataattttgaagcagttttgatttagggaaacccaaactgtaacttgaagcagtttttagacatgttagagcagccatggtagtgaaacttcccttgaaattttgacagatgatatctcttggttgaacttgatggatccctgcatcaaaatatccactgatatttgagaggagaagaagggtgctacattgggataacaaaagaagcaatgagatttcctgtttgtctgcatttccaacaaagctagaaatactggcttagttgctgaacaaagaatgcctgtccccagagatattctgagagccagtgaattcagtggccttcrcatgttttattaaaatcatgacatcaatctacctgggtagattagttaattcttttctttgatttctcaaatttctgaattttagatttmtgaaatgtgggtttattttgttatgtaaatctttaggtgacttctaaaactcatcttttttccatagtagtttcaggaaaacgtgtatttgattagtaaatacatttttttgtaattttttatttcatttgcttatattrttgagcaatacatgcacatagtttaatgaaatgtcatttactccaaagaagaaattttttaacaatagcacactatggactgattcatatatgcagacatttctgtggaaaatctaagtgtgagcaaactatatcactgtactaatattatggtattctaaaagtgaattgattattataacatgtgaattcttcattagattgcaagatctttgaggcaggatattatcttttgcatatttatattcttagagctagcacaatccattacataaggcagaaacaataaatatttaacaaatttatggatgctatgttcttggtgctatttaaaaaattctataagaaaaatctgagaatgttctattggtataatggttagggcatttgtcttaggggtgctgtcttttctcaggaaattgtaatgctagatgtctgactgttctgtaccacttgagccaagcttactagataaagggactgcaattatacaagatggtgatggttcaggtaccaacctgtgtcttggtctcagcttttccttcccgagccctgcattagcaccagagaggtgtttccaaaatctagtcatattccttgcttaaaatcttcctatgtaagagcctccccagccccttttatgtgtagattaggtggccctacttcttctgtatttagacatgcctctgtcagaatattcatgccccacactgtctatgtggatttgtggaacatagatggtgacaggtactgactttcagttttgtatccctagagctgccttggacacagtaggcccatgaatagatatcttcaaatatttattcctgacattattttttatttagtgatatcttataaatttttttgccccaccaagttaacaggaggacatgggcctgttgctcagctctcaagttggccagaaatacagatttccatgaaagtcaagcaagaagacagacgttatgtaatttcaggcatgtgctaatttgcatgcttgtgggcaccctattttatgtaattgtccataaaaatgtggcatggaatcttcattatttttaatatagatagcacatgcccatccaaattttaaaatgtaaacaaatctacttttttactcccaaatatttaattaatcacttcaagacatttttgatattacagcttttgtccttaggtggagctgttaaagttaaataagtgtgaatatctgtcaaatacagtttttgcaagagtgcatgtacattttatatattgtaagaaaagcrtaattaatagctaattaggataatgaaagtaatatacaacagatgtagagaagaccttgtggaaaattagtatgaattagatagcatgtgatttggtcaaagtaagcttgttgagaagaattaaaacagtggacatgtggagggacaatcagtggctgtctagctcctcctacacctagggaatgatttaatcaagtttgctattacttgaatactcagggcttcaagctgttccgttttcacaagtcgataacttgggatttggccttgatttgcagcattcctatacggtcaaagtttcatgttgagatgatcacttaccaagtaatttaatataagaatctctgtataagaatggaaaagtaatcagggatcttgagtactctcaggctccaaatcttctaaataccgtttaataaatagagctctattccttgttctataactaattttctatttaatgttgatggttggcagtagtagttcagttttcttattccttccaaatgttcaccagaatctcctattctaggaaactgaaatttagtaatttcttagttggcttatatacctgaaatttgaagcaacatacaaatcttgtcaggtctgctttatggacattatgtcatttaatcatcacaacagtaaggtataagtataaccaccataattgttattattcctattttcagatagcacaactaagccatagacaaattaagaaacttgtccaatgttatgtagataataagtggtggaccccagatttgaacaccagttcttcaccttcagatcactattgcttttaaccactatatacataaattgataatgttgtaaatgaaaagagaaaaaagattacatcctttttgtttataattacataaagacatagaatagatatagtcttttatgtggtgtgtgtcatctttattaaattacttcgttgatttttatcaaaagttactatataaataatatagcaacacagcaataatttgtgtgatagggatttattccctatttcttaaggattattaattgatgagctttgaaaataatctattccttatctgctttggggcagtaatgtttaagccatattgcaatcctgaaatgtctatagataaatagaaacctggtccactgacattacttagtaggaggtctgtcaattgcagtgtcatgggtctaccttgaggaactcatctagcataatataaaccttaattatggttgaagctaatatgtctagcctgggtgaaaatactagactctttaatggtcaagagggaatttgttgaatctattttttaagatgagaagaacttatagattgaaacagccatatgaaaagtagagtcaaaaactgagccttaaattattagtatgaaagacatcacagtctgtgaccaattcatcaaattatctcctgcgtatagcaacaattctaataccaagaaaaacaaaaactgcatagattttctccacttgtttccgtgtaggtgggctatatgtggtgatgtgaactgctctctcatatcctgagatcatttctacttttaatttttgcagtgtctaaatcttattttatagatttctcatcgacatgtcttactttaggtttctcaattgaattctgttataaatcctcttaggttactttagtagtaaaatcttattagcttacccttttagataagsagaagtctgttttgttgagtaccctttgaaaatcacatttctgtctgcgtagtgcttgaacaggtgctttctaagagacactgtgttttatatgctacctgattttcatatacatttgccctgcagtawccmtgggggattgattccaggacyccacttggatacaaaaatccaaggatcctcaagtcccttatataaaattgtgccatatttgcacttaacctttgtaaatcctctcatatactttaaatcacctctaaattacttataacatgtaatacaatgtaaatgctatgtaaatacttgttatactgtattagttagggaataatgacaagaaaaaaartctgtacatgttcagcactgatgcaaccatccattatttgccaactatttttgatccaaggtggctgaacccacagatgtggaaccgatgggtacagagggctgactctctttgttttcatagacttgagagtctaggacacttttactatctagtgaagtgcttacttaatcgaatgacaaatgctttcaaagatttttttttgtttatttcactgtgtgtaagcaaataattttgaaaataatgtggaatttttttaatgaggatagcaagtaatcaaatgaaaagaaaatcatttgtaagttgatagaaaatatttttaaaagaaaataatgtctgcatatagaaataaaggttaaaatgtaagaattgtcaatcagttgtaataaactcgagctgtttctttggagacagaagacaatgaattttaaaaatctgattattgaaaaaaaaaacttgtgaccacatatcaacaagaataggagtaagaaatgctgtgtagacataagatattaagtttaaatgaatgttatacagagcagaatggattgtgaatgggttacaatttctgtgtaactggtaaataaattcaagagttctttgtgaagtataaaagcacaataaacttagaaaaaacaaaaacggctgggcgcggtggttcaagcctgtaatcccagcactttgggaggccgagtggggtgyatcacttgaggtcaggaatttgagaccagccctaccaacatggtgaaacctggtctttactaaaaatacaaaaattagctggatgtggttgtgcatgcctgraattccagctactcgggagactgaagtgggaggatcacytgaacccaggagagagagattgyagtgagctgaaatcacgccactgccctcaagcctgggtgacagagcaagactgactcaaaaacgaaaaataaataaataaataaataaaaactttaacaactaataagaaaatcagtgaagcgaccagtgtatacaattagatgtacaaaacaaatacttttcctatataccattcagtatctgttagaaaagataatagaaaagttccataaagaaagaaaagggctgggtatggtggctcacacctgtaatcccagctctttgggaggccaaaactggaggagcccttgagcccaggagttcaagactagtctgggaaacattgaaagaccctgtctctataaatatgaaaaaatgggctgggcatggtggtacacatctgtagtcctagctactctgaaggctgaagcagaaggatcgcttgagcccaggagttcagaactgtggtgagctacacttcactccagtctgctgacagagggacacatcccatctcttaaaaaaaaaaaaaaaaaaaaaaaaaaaaactaaaaaggatgttttataataaatctggagtcaaatgaatcaaattcaatcaaaatgttgttgagagatayaaagagaaaatgtatagggtaaagttaaatgggataaaaagcaccttgaaatgatttacaraaagtttatcatgaaaaatgcttatgttataatatcaagttatcttttaaatgcgtagaaaatagcatggaagaaaatactcccaagtacagacctttataactattattggatagtattatttttcatttttattctttttgtgtttttcataagaaacgtaaatgattttgtgtgatatgaaaaaatatacatcttcatttttttaacggtttagataaaagataagtatttgctttgtcttccatgtatagtgtttggcccttttcaggaaaggagttttatwtttttttaatctacgtgcttgtttttgttaattcatatggtggttattttccttagaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacrgtaggaatattttcctttwttcaaattattgtrtggcatttaactaaatttttaaaatatggcataattctgaagaagtgaactatatgtcrgaatttttaaaaatacgratttttaaaaacaaawatagatttattcatttctttaaattgtttatattccctttaggatattgaactgaatattttaaaatatgcatttaatcacaacagtagattctcatataaaatgctgatgttctatttttaatgccttgccagtgaagaaagatatattactagagagaaatcataatgggagaagattgtatttacaagttagttattcagtgtcatcatgtgtcctcagtttatcttcctcttctcattttctcccttgctttcatcctactcacagattcactcatgtcttcataatcaaattttcttgcttagttttacccatttacagacacatgtatttatgttatacaataatttctttttaaaaatttcattatatgcttttcagccacatcccaggatcaattgcatttgagatggatcctacattctaaccagtgaaccgttttctaaattatctcaaaatatttaagtttcactgacagtgtatttattctcaggagtcctgttgttcagacctttagtgtctatcaacacaaagacatagkgtttgtccaaaaacaggatgtgtctgggcatagtaaaaagccttcattaaaatgttcactaatgacacacagaatgtaaaagatgaaagggacatttaaaggtctagttcacatcctgtccagacaaaattgccccatagtcactttaagataattgagcttacaatcaccactagtctagtctagaatacaggatcaaatgaagataactgaagagcagatttttctctacaccctcatatgaaaatatttacggaagtcaggggttgtttttactcttcttttgaacttcagttgtcaacatcaactatttgtaaatgtctttaatagtgaaaatctcaatattgcaagtacacaagccaaaaccttagcaattggtagttatattaatttatattttgattcttagaacaacctgctttaccaatagaaatggcagaaaaaaaatcatatttatttagagagatatttacacctctcccccagctgtaggcacgctatttgacagtactctagtcacttcacacttaatgagcctggctccttctgactttctagatctctctttgttttctgcatctgtctctctctacctgttcccgttaccttcccttttatctctccccatyttttccttttgcccagcttatgccttgggtcttcctaggtcctttgtagtatttattgatcttattaaaaagcttcaagttaattaaattctgaaacccttatttaattttgttcaatatttactctaagtaaaatttctaagtatctccatgtagctaatttcaatgaatataaaatcactgtcccaacatctgtcacaattaagtgccatacttacaygtaakaaatgggatcaaactgcagcaacagaaaattgagaggaacccaatgaaaaacatcttggcagctaataaactcctttaatgcctttcatttaactttttttccaaatcttatttcacttagaaaatttgggctttaaattttacctatttagaacttagctcttttagccctgcaagtaattgtcatttgaaccctactaattctcaaattgaactttttaaaagagataaaataaagagttgtcaatttgatgtatcaattttatttttctcatgcatcacaggtgtcgtcatctttaaaatatatataaatatacttgctgattaaatcaaaataaaaaacgttgtctttttatttccagataaactttgcaaggttttgtgcccatgaaaattgttctgctgatttacaggttwctgcaaagattgggtttttgaagtaagtatatgtggtatatagtctctgttattcatcgagagggkgtaatgagtgtgtgcatttgcattcccaaaagaaaaggaacaagagctaacccttgaaaattaacagcgtttaaagaattagcaacacaatgcttagttttttatcggccagaaaactggttatatcactcagactgatatataatccaagtatgacaaatttaaaaaggaataaactatcttgctcttctaaattcatagaaggggaaacagagtaaaaaggaaatagatatgtgttttagaatagcatctaacacatagcaaagactggataaatgttggttgctgtcgttattttataatggcaaataaaccactgcaattttgtatcatatctggatcccctatattcaaatcattttgcatatcaaaaagatgatgtgaaaacaaggaccagagagagagaatgaacacttcaggttgaggattgatcatagaaggcaagtgaaagaagggaagaagatgcatcagtgacggggcagggaaacrgggaactatttttgggagattgggatataaatggagcagctttaatctggggcatgttgaatttggagggacttttctatgtggcattccacttgaaaatctagttcaggattatgtttggaagttcctccatatattagtgacttgtgagatggcccaagggatagaaatgtgaatttcacagaggaaaaaaattacagatcaaatcttggaggacagttttattcaaggagattaaaaagaatggggagtccctgtaggagactgagaaggcatcttcaaggaattaaagagaaccaagtccctggtgaaatagccaatggagaatataaaaagggagacttaatattgtaaaatttataaaaagatcagatagcgtaatgtctaaaggtcatggaagttggcatttattaataaaatgtgacgggtggtgaaaaaatgggtatcactggcaaatgttaagatagaactctcagtgcagaagtagccaaatgacaggattagtrattaaagaaaggagagtatactgggaacaagtaggttcaagtgaggtatttttatgtatttatcaaatgttgttatttgttcaattattagaagatgtaaatgtgagtgccagaggcagggaaaagaataaattggagggagacatcttcaacttaacttccagcacatgcttwtcagtccatacttgaattccactctgaagcatttcactgttcacttcctcttttgaaygtcttatcctttaattttcatgatactatcctactcccattgtcttagtagttatttagccctttcttttcagctgtttttgatggatctttgggtttggcaccctaaatggtcctccctcagccctttctctcactaccacattcaaccttggtagtcttgctcataactgcaatttcaactggcatgcctacactgctgatgcctaaaccagtgtctcttgagtttcacacccacctacatatcaaattccctattagacatgtccttttggttgccctatagtttcaatctgtccaggcactatccaggaatgacatggacattagaaagttaccaaagccagaaacctagggctcaatctgcattcttttctctttcttatttctgatatccagaattattaagtactacaatactaccacctagatgtctttcttatccatcatgctttgctatctctaccactattactccaaactaggcactcactatcctacctaggtcactaagttctcctgctttctaggatactggcctttgattttgcattattaacatacacatgtgataacagtgcttcagtggctcattttagacttaaaatctaaactcctgggtggtatttttcaccaattccccaggaagtttttcatcaatggctgaatacttatggtggtttggctgtgccatgctctcctgaacctctgtatcttctcacttcttctgcccatctacctgattaacttttatttatcttttaaatctcacctgtttcctaggggaagccccctggtcttcagctacttaaacttaagttctgttgtgcccttggtcctatggccctgtgctcacgattattgaragtctgtctccacactgtcctggaagctgctgcaaagcagggtcctgtcatttttgtgttcccaatgcctaacagtgcctggagtgctgcaggtgactggagaggtttgctgagaatggaacaagatcccaaaagggatcagattcataggtagaggaattagccttagttaagaatctccttatcttgagctaacaagctatgaaaatatgtttgacattaagaaatttcartgtggaaggaagggaaatacagagaactcatggatggctaggataaaaagcaagtttatatgtggtaattgaaggcattgaggatatgtttgggaactgaaaggaatggaaaaaattcaaaatagattaaggacagggagtcaactaggaataagtaaaaaggttgacaaatagrgttgagtaccctactgtggtaggatcacatatggctgagaatcaattattttcacttaggcaatgtcagtttagccttgagagtccatagttcagggccaaaaagccttgacctatttgattgatgattggattttatacttaarttacccagattaactgtaatccagaaacagagactacggactactttgtatcccagcatgtagggcagtgcctttattgatttcttagttgaataacttataatcttcccatttctgtatttattttcttcctaaaccgcttaattatcttggtgtttttaccctcatgggcctttgataagaagacgagctgtgtgggggaaatcttttctaagctgcaagtaaaggagtgttttcattttcttaaatcagacacttgtgctatcacctttcattgcagtctctctggcctatgagaaaatgagacattgacatttataagaaaatattactaactatgcttctttcctgaataatgaaaatgcatcttaatgaattatttttctttgttacatgttttctcacaacaaaatatctgctttgcatttttaatttagagtgataatatttcttgcagcctatcaaacccattatgatttttaaatggcataatgattttaaatgaagtataaggctgtgtttcttaaggtgytgtctctgagccacctttatgagaatcacctggatgcttgaaagaaatgcagattcctaggccccagaccatccacgtcagaactaaaggggaccaggccacagatcttcacaattaatagagctccaagttcttatcacactgaaacctaagaaccaatgttatggtggtgaagagcttccagatttgaagtcaawctgacctggttcaaatcccatatctactgtattactagtgaccttttcagagaagacttttaacttctctagacctctttcctcattgctaagtgggtaaaaatagtaccgactcattaaggttgtcttaaagggtaataatgcaggccaagtgcctagtgcaaagcctgatttccatgaagactcaataaaagtcattactatttctatttttgaaatattatggttggaatttctatagataagcttttttagtttggccataaaatgaaacattgccaattctatatataattctgcatataagctttatatcctgaaaatatagctgctgtgactggctcagtagttgcagtcttacaaggtttgaagtggcatgaatgtccatataaagtagtaggcgccatattttttgtatcaactaagaaagttacaggctatgtatttctattagataaatgattatttgaggaactttcaaatgagagcccttctaattaatttcttagactcacagtgaaaggttctgacaaagtgctttgtgttttggtaaattatactctatcagacagaaatatgtctctcccacagaggtgtcctctctcctttctcagaaacagtaggcgaattgtgaccatatgttccatacattctcccagctataactctgctggcactaatggtatttatgtgccccagagctataaacctgttttaggtaaatgtatttactcagtaaagaacatgagtttctgaagactgcaataataaactgtcaacagtaygctaaacagtgcttatccactctctctcatctcttcattaagttgaggcttcctcctgtatgtctaaatgcttaggacaataaactgcatttataaaggacttgcagtgcaaaataaagatgaaccaacacgacttcaagattacaaatataatagaaggtattagccatcacatagggagtttaaaatcaaatccttgaaactcatgtaaatgataccgcaatacatttctgcacctcagttgtgcttccagaatgagtgatgtaagctttccctgaacaattgcttctgtatctgctaggaatacttttaattgcaagttttagagtaattaactaatagtgacttgaacaataaagatattatttcgcataataagcagtcttgaggaaggatgttcacaggtttggtgaacagctaccaaagactagacattgatggttatctttccagctctctcagcttttcctcatgatcacagtatagccaagcagcatcaagcttccaagcaagagaaaagggaaaagagcaaaagtgcttggtcatctttaagttgcccttccaggaagggcagtgcctcatttgatgtattctgattaaccagaygtgtgttacctgtttatccctgattctgttatggttgaaggagaatggagtcgtcatgatcacagtaaatggatcctgaatcaattattttgttattgtgatacattctctggagttgaacctagaggtctgtcttctgaaatattaagggaatgctgcctgtcacctgaataatctagggctctgttggcagctaagaagggaaatcactgttggctagacaatgagcaaggagcaacatytgccaccatgctgttaattcccgaaagagctagtgtgatgaaattgtccatttttaaaatggaaatagtacgaatatttgsctcactgacagcataaagttttgggagaatgaattatatgctttataaactaagacatgctaattactggttcaatcttccaatttaagtttttctgctgttcttcccttaacctcagtgagtttgcctgtctttaataaaatcttcctaaatgtcaggtaacctgtctattccaacaggcaagaatttttcagtattgtctttttccctgaagtcagtagtaaaggaaaaaaagataaaaattgtacttaggcctgtagactacttgctgcaggttactcttttgtcaaataaatgagtcatgtatcttgacatagtgaagtatggtatcagtttacgttatattttattctagcatcttgattaaaaacaagttagctatcaagccctaattcattttagggagacagggtgaattcattatactaagacttggggagcatttcttgcaaaataaagctatattattcactcagaaaaaaacatagagcctggtgctgtggtacatcatttttctatttttcctctgtcacttattaagttatgattctgtatgtacacagtaccttgatttgtttaagttacatggattctgtgctgctttgtaaatttcaagtctgcattatgcatgttttaatgaagaatgaactatgagtcccagggacagctctggttcagtcttgtcgcacttccagatgtgcacctggttctttattatgtctcacataggaagctggtaggtatctttctgagagcatcttgttaatgaatcaatttacagtaagatgtatatttaggggaaagaaagtagaattgtaattatggtaatggggcaaaacagcttaaaaatggaaaataaaccaggagtctagctgctgaaatgtgaacattgtgtttctctttaatttgctgttgtcttggaacctagctgtttatgcagtgctttcaccttctgttgcttgtctaagtgccaacttctttcccaaaggtgttcagtgactaatgctttggttacaagccagaatattttataaatgtctatttctgggcagctcttctacaagtcttaattaaactttaatgtcaagctgaagtttacttttagaacctcttaggttgctttagtcctaacatgattatagagtttggggtgggggggcaggatgtgggacagccatgttcccacacacttcctctctcccatttaacagtgccaccaagcagattcatactacttaaccccaaggtttacaacacaggcacgagtaaatcacagccattccctaaaatgttgtggtagcacactgtcactcagactcctccaccctgcagtgatacccagggtttggaattactgctttgttagttattacacattcttccagcatatccaactgctcaaatcagggatcccaatgtagagatgatgcatgtggaagtagcattctttcctttcttctccatgtctggaggagttatgaggactgggggatcattttctctaattctcatatggcttattggggtaaagaactgcatcctatgccatctgaaataatgaagcttctattatagtcagaatagtacaaaatagatttcaattaaatatggtaatatgttatatgtttattttgtaattaatttactcatcaattggattgctctgtagcaagagcctgcatttttttctgtgaagggacagatagtacatatttgagtttttgtgggacagagatctctgtcccaactactcaactctgtcactgcagtgcaaaagcatgtctgtgttctcatagagctttatttactaaagtaggcagacatgtgaatttggccttcagggagtagtttacagacctctactctatgatatgcttgctttttatatggaaattctaaagtatatatatttttattaattaaaaatagtgcctgatagtatattttgttttttaaacatagtttgtcaatataacttaggctggttgtgaaagtaagccaagattcaaagatttttaagaaattaatcctcagttaaaaaattataagaatctctcctagatagaaacaaagatagatataaatatgtatctagcctacagaattacgtgtgtatgttgaccaaaaaactataatagttccaaaaatggaaattgtcaaaagtcccatggataattgaaaggataaataagatgtggcatattcataaaatggactatatacaccaatgataagaaacattttacaactacatgtaccaatatgttaatctcacaaacaaaattttgaataaaagccatgcaaaagaacagatactcaaagattacattacatttatataaaatacaaaaccgaacaaaaccaagttatattattaaaaatcaaggagggtgaggacaataactggaagaaaaagccccagagggtttttcagtggtgctgctaatatttatttccttgagctaggtgcttaacgcatgtattcataaaaaatattgagctgtacaatcaggatatgtgcatttttctatgcatgtattatactctgataagtttaaaatagaaaaaaagaggaagaattttctagcattaagtgaagtgtccattttcttagaagttacattasagttataaaagtggggggaaatatccaaaattattttatttgcatattccgaggttcataagaataactctgaaaaaccgtaccacatttccagtttggattttgccatggtcatatgatgccattaattcataggtcatttcagtaggtttatcaccaccaaaacattaggttgtctggatgggggtacagatcgcaatgtggtaatgctagatatttactttcttagtgagacatttggaatttgtatagcatcacagaacagataaacacggtttaaggctataacgtgacagtatttatgctgatactttcatagacttctaacagtcaataacttatccaataatttccccaatttttttctgacatgttgcttggacaccaccgaacccttctttacatttaatacagacatgtacttacctgcttatattttttgaagactgtgttgttaggctctgagaaagcatgtgaatcacgatccagcatcttctccccaaggcaaattagtctagtagtgagaggaaccagagacttgacattgtgaaaatactgcatttttatagaggtgccccgtgtgctttgagagagggagaagctgccaccttacgctgttaggggagagcaatgcagggtgaaggtggttaacagtgagttttggctggaagaacaactgagaattattgacgtccaagataaatcttgaagaataagtacacgtcagatgcatgaagaggagatgttgacatcagagtgctagtttgaaggaagacgcaaaacatcctggtgtattagatgcctgtttatagaaaaatatgactgaaacaatgaattgtgcagtgaaagtgaagcaggggccaactctggagggcctctgtgtcatgctaaggagttggaactcttatcttgaaggcaatgtatggttctcaacagacaccattatctagtttgctttcttgaaaatgaccctctggcagtgtgaagactggattaaaggagaggagaaggacttgagacagataaatcaattagaaactcaatccaagtgaatttaggttcaatcatgacattttcagacttaaaatttcttgaggcagccaatttaaccatagtagtagagaaagaacaagtatcatgtctttactacctcaggcaaaaagtggtttcccagagccctctattcacaacacttgcccgtttgtgtatcttttttacatttatttacacatctgtcctttattatatcagctctaggaaggagtgaagtgtgttggtatttgggaacgatgaacttagtgcctgatttattgtacagaaactttcaattcattcatgaatcttcaagtaataattaaaagcagaaattttgaaacatgttcttaaactctgtccttacatactctgtctttaatcaattcacaaaaacaactaaattcctactgtatctttagtatttccataaatagtttattcaaacactaatcttctctacaaatgttgatttgaatgacacaatttaaacattattgaagaaactttctaaattctgcagtgctaggtggatatttatcttttttatctatcctcacctgatattttgctttgggtaaatgcttctctacttttaactaatttttctgaatgttaaattactagatatctaagaacttctgttcttaggggaaagtttataaaatgacatactgtattggaaagttttccttagcatatagctgttctaaccctctcactgggaaaaagaatgaactgtagaaatttgcaattgtttcaagacttcagaacattctagctgtggcctttgaataagttccttatgtctcaaatacttcatatttaaaatattttaaggactttatacagtatacataacccagatcttcagtgaatggtaggtagtatggaataggatgactgaggcttaaaaatgctaaattacttccccaccagaaagaactgctggcagtgccaggacttgaactcgtgcatatatatggatttacagcaatctatactttgcaatacacaggaggatgaagcatttctccagttctgtttttaaatttggcctagttactggtggaggtgaccagctgcttcacaatttaattctagtccaacagattttagtgccacgcacttgtgggtggacatagtagttcttcctcatgccttgctcacttctaccaagtattccttctagtcttcttttctaccagttccttccattttcctccctcggttcaggcagcagctagttcaatgtctattttaggcttgcaagaaagaaaagaaaaactgctttgcctttagaaaatgttacgaaataatcaggaaaatgttaaaattatagaagcaagaggttatgcagaaaagaaatgagaaaagatacgagtttaattatagctcattaaagtttccttgggtaataggtgactgaatttataaaaaacatgacaaagagttcttctwaatatggttttacatctgcttgcatagggtcaatcccatgattgtttttccaagaaaattagtattttatgttcagcataaattatatacatatatccttgtatgcatataagagagagggatttttatttcctaaacaagaactaaayaatattacttaatttttaggccccatgaaaataaaacatatcttgctgttgggagtatgaagacattgatgttgaatgtgtccttgtttaatgctggagatgatgcatatgaaacractctacatgtcaaactacccgtgggtctttatttcattaagattttagagctggtaagtactgtaaaccacaatagcatgatactacttggtattttacttaattttttaaaagtaartggtagaattcacttcactgatttggggtataagtcttaatatttaggctcctagttattttcagacttactctgtgcccctgctcagaatggcaagttcttgggtcttaagtccaaaggcatcagcctcctgttttccagtactaggagtaggaggaagctgtttgggtgcctttacattctcactgccgtagccagcacacgtctgatgttggaacagtatccccttgattgtggtccttgcacaagtaacattgatcctccatcctggactccagagttatagttctttattttaaggtgacactcagacaattaatagaattttctctattctttatcaaattcgctcatcttttgtccagggaccacaccttcataccaatagtgacctttgacctctcacgaatatctgttaccttctttctctagtgtttgcgctacttgcaaaagtaacagtggaaactcagatattcacggacagtatttttaaagcattttatacttattgcaattataacctcattacacctattgagattatagctattttgattaaataccttaaacacattctcacataccagacagaagaggaccattaaaatatgaaccttatggattccttgcctcatgatttttcaaggaattcagaccctggattaaatagggaatatatcaagataaatgaaagctacaagtccagaattttttttttgtggagaatctgtttgaatactagagtacacacatatatgtatatacacacacacatacacatacacatatatatacacacacatatatacacacatatatacatacatatatatwcacatacatatatacacacatgcacacatatttatatcatatgtctatttatctcaaacatataaatagaaaatagttttcctagaaaagcaaatacttctgggatgatattcttttcaataaccatccttaaacatatgttacaaactttttatttccttcctgtccaaaacagttgtttcatttttcccattaggaagagaagcaaataaactgtgaagtcacagataactctggcgtggtacaacttgactgcagtattggctatatatatgtagatcatctctcaagggtaagtgtttcatatttatggcttttgttcactatcatgaatatttttttctattcttccctatctttaggttgcatagaaaatattataaatattttagcttggggtaggtagctgagtgatgaaataaaactggttcttgaaatctttgagctttgtgtttatattcttggcaatgtttgctgttttaaagggggtggcatgtttacatcgaaatgggcatgtgcatgtgtcaatcagaattctgctccccctacacacccttcccgaaaacccccacccccaccgcaggtggtcctgtctgccaggcatgttacctctgctatacaaaaaggtgtttttggcaagagtctccactcaagttgtgaragcatttctaattttgtctagacttgcctgcgttcacattcagagacgtctttgtctctgaatgttacgtgtggatatgtgtgtactttaaaatagccacaaacccaacaacttccctgaatcttattgccaagggaggagtagctgatgcctttacaatggttcaattctacattccatagaacataaacttttaagaaaaaaattcagattataaaaaatgtacttaagattttttttaatgggctttcctggtctgtgttttacagatagatattagctttctcctggatgtgagctcactcagcagagcggaagaggacctcagtatcacagtgcatgctacctggtataatttattgttaataaaatgaactagaaatatacccccatattctgaggggggggaattaggagaaccgtaaaactgtgttccattaattgtaagagaaaacttctcttacgtggtatgcttttaaaagaaccaaacaacatagttaaatgggagttactggcaatgttttagctcttgagctatgttaagtatttattagattagattagagtagacatgatgtgtcacgaatcaaactgtgtatttgaaatcaaaaacagaataaacagtttacaagtaataactctacaagatttaaaagtgagggtaatgacttccayagatatgtctcctagagtaaataggaaatcgttaatgactatttcatgagtgaagtttcaatatattttttaaaattcagaataaacgtcaagatggacttcattttacctaacacaacaacttggtcaccctctcatcctaaaaatctctataagtaaaactgattataaagatacgttaaggcagtacatgacttgctatacagtttaaaaaattatatgattgatgtgctttctttgatcattaagtcttgcaaaaayacttcttcaacctaaagagagtaatagatttgtttctaaactacctatttattctggtttttgtaccacctagaacataaatgttaaaaaatcttttaatctaataaatgtaactatttgttaaaaaaaaaaaaattcctctatctagcattagaagcaaatgataacagtttaaataatgagagaaattttctgccaaccttgtcctaaaaaatttttactaccatatctacttttatccccactcctcaaaaagcatttaagcaaacctctgagtatattaggtatacagggtatgtaattagttctctctgaagatttttctgcttggtgaattctaacagggtgttttctgtttgtatagtgaaaatgaagaggaaatggacaatctaaagcacagcagagtgactgtagcaatacctttaaaatatgaggttaagctgactgttcatgggtaagtagacataaaggcttcctttcaaatttagagctgatttacagtttccttgcttcttacattaatgaaaaaactgtattctagawtttttttaaaataaaaaggrtactctatcttttaataattacctcattgttatagtcccttacttagctgtccattataataatccactctataatcatcactgatactacatcaaactagtacccagctggaggagatttcttactgtgagagccccaacaagctagcaaggccacactgagcctttcagctgtgcactgtgtaatcctaatctggaattaggcagtatgcagtctgcataatcatacttaatgcccatgtcaagtgtgaagttcagagaagtgtgaacttagtcaaatcactattctgcagacccgtatctacacatgtggcaaatggattgagaygtgagagatctggctgmaaggtgtcccttgtccactttttatacctatgggatcaccagattcctcaaccacagtatcagaattcattgcttcctcatgattttaatgattgagtggatccccctctcattcaagaaggagatgtgtggagaaagaataaaagggggcttacggaaaccttcagtaattccactagaacttattcatggtgttagtccttaaaactacatttttatgcagtagaagatatgagttacagaacaaatagacagatgagcctttcctgttgctctaaatctaaaccatcccgcagtcatcttatccacttagaaaggtgatatacagtcatgtaaatgtaaaatgtcagtgtctgatggaattgagtatcaagtttgagataaagcaaacgggtgaaaaaaggccattcacaggagagtaagacctagagaatcacgagtaagcaaataaaaagttcattgcgtgtttcctggttttcaktgtttatcttgccactcctcctggcttatgatgagtgtcttcctatttttctgttattcacatctcattattttgaacaaggtatgttcacctgttaaactgcctaaatctatgctggttactttcctgtttcatgagtttctaatttggtattacctaatattagctgccaaatgtgagcaccttatggagtagagatctccctagaaacatatttcttagagtttattgcagataaaaatgtcaaatcacaggcctttaaaagagagtgacagccttgtattgtaacaaaaaatttatcatacttaataatgttagacttgttccccagatttggggttcattataagtagccagcagggatcatgagatgggaagaaataattcaaaaatgggtaacataaattgaggtatgagaaccttaggaaaaaactaagaagttatcccacattacatttgccaaatttacatgaatcacttaagggctgaaagagaaggaatggtcagtagaatgaaaaaggtgtagtgtcatggaaagcaagaaaagaatatcggtgagggacagatattgtcacccaggtcagagcacatggcctttttttttttttttttttttttttttttttttttttaagagtctcgctctattgcccatgctggagggcagcggtgtgacctcagctcactgcaacctctgcttctcgggttcaagcgattctcctgcctcagcctcccgagtagctggtactacaggcacacgccaccacgcccagctaatttttttttgtatttttagtagagattgggtttcaccacgttggccaggctgccctcaaactcctgacctcaggtgatgcgccctcctcggcctcccaaattgctgggattacaggcatgagccactgctcccggccctaatttaatttctttttaaataaaatgtatatctgaccacaaaaccaaaagtattccatggtgacttgtaaatatgctataatccagactatagaaaaagactctttataatacgtcatcgaataagacagttaattaaatttgaatttgtttttaccaggtttgtaaacccaacttcatttgtgtatggatcaaatgatgaaaatgagcctgaaacgtgcatggtggagaaaatgaacttaactttccatgtaagaaaagttaattgtgttaatatttstaacaacctaaaaggatgtcactgatgcattgctccaagggacattgtacacctatgacgtccttcagcctctgcagaccacagctggctggaatggggcagyagcagtggtactcctgcctctcagacccctgctgctttccttccacttgtcttgtccctgatattcaagcccatatttccttacaggacaggtgagaaagagcatgcaggaacagagataatgcctgaaacaggcaaagttatgggatgagctgaatttgctagagacacatacagaaaacaggacaggccaagggaaggcatctttgggtgcaaatcagtgaaatttcttcttggttcaagcgtataaaaacctcagcactacaaagtaaaggaggctcttacctcccatctccatttaagatcacgttggttagcctttcaagccataagtttatgacctgtgacaagtgctttatcaattattaaataaccttttaaagtaaagagtactatcgtaattcagaagtattaggagactgatgtaaacctaagtttttaaaaacattttttgctgtcaaactgatatttttattgtatcaaagatgttggtgattagtaaatataatttccaaaaaaaaattctttgaaccaaaagcactgtccaagcattcttatagaataatctatatttgtgagtaaatcttggattaggtataatattttgtaagacaatgcttttcaaaatgtgtattagaatcacttggggtacctatccagaatgcaaattccttggctttgccccaaatctgtggaaaaagaatgaccttgaaatcctgttgattctatgtatactccaatttttgttacactagttgatactaatgttgaaaaattttagttctccactttgaagtcccaagaaatgctctttaaaacccartgggagtttgtgctttgataaactaaaacagaaaccaaacyggactctagaatgtttatttattaatttacaattaatagttaaaaagtattttctactaaatgtataatgtagtgactggcactggagaaacttgcagtatataggatttctgtgtctagtcaactatgtagatattcttagaggtttaattgttgttaggcaaacagatgtttgtgatttagatatttaatggcatccagaagaccttgtctgtagtattgggcactgctaggtatctgttgctgacatttcctgctgcaactgccctgtgcttttatggattagcaattaccacctgttcccaatttggagacactttcttcatctatgtcacatgcattcataaaatgactgcaggtctgcaagtcatcttttttaatcgaggtattgggatgcatctctttctgacttactgtattggttttacagttaagctgccagttcagtaggctatattttggccccatttcccttttcaggaatcttcaatccccaaatttatcatcctcttatgcattttttgacaagtattgttaaaaaccttttgtgctttctcaaaacccaacaacatacttttcttctgaatgcatcagcatatagatcctgaataaaaatacatttttattcactttctcctgctgattatccycttagcacagagtgcttttgcgataacatcataggatttagaattacaatacctgagttttggtcataactcttgtcattttttaacttttatcttgggaacactaagaacacctgttagcatttcccttagctggtgaataccaaaatgttggcctacctcatgagaaccaaatgatatttttaaaatatgtaatgtaacatacaaatatatattgtttgtctcctaagactgtttctccaataaaccatcagcctgtactttttgttttcaacaataccaaaactagaaggttagaaacaatgactcatttgaaattattagcaaactttaaaaattctgactatggatatcctgtctccctttgttatgcagctgccaacyataaacctccaccactataaatgttgcatggaatatacgggatcacctaaaagctcactgatatctgtacttayatttatagaaaacatttaatttgttaaaaartttttccttcttatcaggttatcaacactggcaatagtatggctcccaatgttagtgtggaaataatggtaccaaattcttttagcccccaaactgataagctgttcaacattttggatgtccaggtaaaaatgtatttcttccatctaacctttattgtgtgtcttaaatactaaaataaatgcaaaccaatcctttattcgagtaatgatgtgaaaatggataattgttaacttacttcagtcacactctaagctatgaattcaccatgcatttattgagttatgctttgaatattatacatttctttagaactrtagagttacagtgcaacttttacatttgatttaaataacagaactatattctaccatctccattgaataattattttaagatacattgttgtgtgatatggacctatagaggtaacttctattagtagaattcttcataaaacttgaaactactgtgcaaatatgaggattatagcctttttttaaggaagcactattcaaaccacttcttaagaaccgatattcttgcactgatggttccatcagaattgttttgagcttaacaggttgaagacaaaagtcaacaaatctactaaataggtttgaggtctgatttttaaaaatcctatttaaattccagatttagagagaagaatatggtgttatattgtttcgcctataaaggcgaagaaatatttaatgtcatgctaatgttccaatatcatttttcacatttctgcaaggttaaggccattttatcagcttagaacctatatccaacctgctgtaatttggctgggtttttgtgtttctgccacagacatttaatcactcccaaatctgtcaaaaaaatttctacaatttcagaggtacttgatatattttagcaaagatamgctactggaacttttaaaaccaggttgctttttgctgttttttccagtgttgaaagataagatttctcttgctttctktcttcatagactactactggagaatgccactttgaaaattatcaaagagtgtgtgcattagagcagcaaaagagtgcaatgcagaccttgaaaggcatagtccrgttcttgtccaagactgataagaggctattggtaagtttcagtttttcaggttgtagttcctgctttccaacagagaagtgagacacttaaaatcaagtcaatgggtttgagctgtcacttcaataataagagagaagacaagtttaggtagtattcttgcgtggaaggaacaagcatggttggaaagttgagatagacccagggtctatcccatatataaacatgttggccgggtgtgatggctcacgcctgtaatcccagcactttgggaggccgaggtgggcagatcacaaggtcaggagttcgagaccagcctggccaacagagtgaaaccccgtctctactaaaaatacaaaaattagacaggtgcctgtaatcccagctactcaggaggctgaggcaggagaattgcttgaatccgggaggtggaggttgcagtgagccgagatcacgccactgcactccagcctgggtgacagagcaagactccatctcaaaaagaaaaaaaaaaatgttatacagtttcatttttttatctaacaaatgcccactatttgccaacaagacattgttccagacccttcaggacaccaagaggttgtcttcacctgggcagcctttgtggcatgggttaattttcattcttttcagcttagtgaatgtatgaaaagaaactggagaagcagtcatcaccttgaaatgatccatgttttacaacaaacaaagaatacgtaacttagcaagactctgattaggaacattttttaaaaattctgtcccagaagattatgttaatacaaataataagaacatatgctgcagtttaaatactttattataatttagaaaacaaacattcatgtcttgtttaaaggtaatttaaatgccactaaggaaagcagatgtttaatttcatatttatggaaagatgattttcaaaatgccattagagtatatattaaattctatataaaatattttaaaaatattttccaatgttgaaaattttaatgtagcacttttatattcccttcaagtactgcataaaagctgatccacattgtttaaatttcttgtgtaattttgggaaaatggaaagtggaaaagaagccagtgttcatatccaactggaaggccggccatccattttagaaatggtaagtaagtctaaaacattgacaacttggtggctaagtttacataaaatctataaattcagtcatataggcaggatagtatgaaggcattcaacaaattaaattttaaataaaattttggagtaaaactctaaaactgtatttctatcacttcaactatctacattgactaagtgaaatggctttagaaattaacaggtaataaaggctaaaataggccaggcacagtggctcatgcctgtaatcccagcactttgggaggccaaggcaggaggatcacttgaggccaggagttcgagaccagttgtattcctaggtagatgtctggtgttatttctgaggtctctgttctgttccattggcctctgtatgtgttttggttagccttgtagtacagtttgaagtcgggtagcctgatgcctccagctttctttttgcttaggattgtcttgactatatgggctcttttayggttccataggaaatttaaagtagttttttctaattctgcgaagaaagtcaatggtagcttgatgggagtagccttgaatctgtaaattactttgggcagtatggccattttcacgatattgattcttcctatccatgagcatagaatatttttttccatttgtttgtgtcctcttatttccttgagcagtggtttgtagtgctccttgaagaggtccttcacatcccttgtaagttggattcctaggtattttattctgtttgtagtgaatgggaattcactcatgatttggctctctgcttgtctattattgtatacgaatgcttgtgacttttgcacattgatttttgtatcctgagactttgctgaagttgcttataagcttaaggagttttggggctgagaccatggagttttctaaatatgcaatcatgtcacctgcaaacaatttgacttcctctcttcctatttgaataccctttgttgctttctcttgcctgattgccctggccagaacttccaatactgtgttgaataggagtggtgagagagggcatccttgtcttgtgacggttttcaaagggaatgcttccagtttttgcccattcagtatgatattggctatgggtttgtcataaatagctcttattgagatatgttccatcaacacctagtttattgagagtttttagcatgaagggatgatgaattttattgaagcccttttattttaaaaatatagctaagaagaaaaactaaggctttcataaaatcaaataaaatcaaaattcaacaacaaaaacatatttaaattttaaaaataatgaaatatatcttggactttttcctacaaaggagcatgtatatttatgaggagtagtttgagatgaaactagttttatgtggagttctgtttttcagctttctcatctgttcaatatggataaatgagatgatttttataagmacttagttcatggaacataggaagccaaaggaaatggcagctgttatgttcaagtggaattcttgaaattgccaaacagtgcttaagaggaagatacactagacaggcaaagaagaaatatccattttagtttcaactgtgctaaaagcaaagtcattgaaccatcagcaagtcatttaaccttttgcagtttgccttatctttttctctaggtctaggttttccatcagtggccataattggcattttgaaccagataattttgttttggggggttgtcctgtgcattgtaggatatttagtatcatcctcagcctctatacgctcactgctggtagtaccacctcccacgttctgacacttgacagtttctttagacattcctgrctgtcccttaggtgataaaaccctccctgctgagaaccactgctctagatctataggaagcttgtcatttttggctctaaaatgttaaataacatttacacaatagttttaaaggtcatatccctctttaagaatctgactaaatatattctcatctccctcagcaaatgcacacatgaaaacatctcctaaagattcttagaatttataaagcccttctacagatccccaagcttcatggattctgcgttataaaatccttgctttagatagtaaagttctgagttcatccactgattttatatttgaattctataatgtatttaatttagaaagaaataaaaagcccaaataagatagattcaatatgcggtggtggggtggagaacaatggtaaatggtaacttacctctttctgtagtctaatatttaaatcaagttatttgcaaggtagctgtttaatcaaaggatttcaataaaatgatactatataaattaataccaagaccacactttgggaaccaaaggaggcactgcagttaattttaagtggtgaaataaattggggaaggtaaattgtgaaaacctctagctagaaggtaaagatcctgataaattatgtctttatgaaataaaccaggctatggtgatccttcttttattaaacaggatgagacttcagcactcaagtttgaaataagagcaacaggttttccagagccaaatccaagagtaattgaactaaacaaggatgagaatgttgcgcaygtaagattaccctcttaactgctacattaaaattataggaaaacacatttcaagggtgtctataattacttccttctgagtaactgagttgggaaagtagagtgtgaccagctcatggagggcccccaatacttggttgagagttggcattttccacaactggcaggagggaacaatacagcagttctttcagagaggtgaattgggcagcagtgagaattgaatagattggaggaaaagtcatggatacagcccattacactcactgtttctgctaaacagttaccagtgtttcctgcaattatattagaaccagcaagaaaatgggctgggcagttctaaatactactggggattatggcagggctttaaaggaaatataagcaackttttaaactgatttttttttttttggtttttgagttttatttttcttaactcacgtaggttctactggaaggactacatcatcaaagacccaaacgttatttcaccatagtgattatttcaagtagcttgctacttggacttattgtacttctgttgatctcatatgttatgtggaaggtaagcatttaacaattaccaayattagtctactaaaaatgacattttctcaaagccaatttgacttccaagttattagatttaaatatttcactatttgaatgttaactttttatgttgctcagtactgatctcacatttctcttcaacaccaaagtctttctagaaaaatatgcattcttaatttgttttgaaagacagacgttccttttaaaaaaccatttggaaaagattgcaaattacacggaatgtcaattttggagagaatgtggtgtgtatcactgagaatttctgcattaaaaacaaaaatgtttctttaacccggtatgtccccactaatttttactgattacctctgttaaacctttatgactgatgttacaagggatgcagtttaagaaatattggtgttaactgcttagatattagraatgagtatagtagataagagagtgttcataactatacactagtgatyatgttatgctattttcaggctggcttctttaaaagacartacaaatctatcctacaagaagaaaacagaagagacagttggagttatatcaayagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatkacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgatacacgctgatttagaaaatacagaaaccatacctcactaataactttaaaatcaaagctgtgcaaagactagggggcctatacttcatatgtattatgtactatgtaaaatattgactatcacacaactatttccttggatgtaattctttgttaccctttacaagtataagtttacaagtataagtgttaccttacatggaaacgaagaaacaaaattcataaatttaaattcataaatttagctgaaagatactgattcaatttgtatacagtgaatataaatgagaygacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgtcttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgaratttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatytgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaagaatttgaattgatatytaaaaacagaatttgaattgatatttcatcttgacttttaaagccctagaggctaattgttagtaacatcaatttctattaggatatccgtttggccacacagcaggaggttagagcaatggagcattactgagttcctccccctgtcagatcagcagcagcattagattctcatagaagtgcgaaccatatggtgaactggtatgtgagggatctagagtgccatgttcctcaagagaatctaatgcctgatgatctgaggtggaacagttcatcctgaaaccattcccccatccacagaaaaattgtcttccatgaaactggtcccaaaaagggtggggaccacaggtttaaagcatggccacatttctttatattaaaattctagtttgtacatttcttttagaaacaattacatgttactttggaatcatttcttccatgcttcctccataaagactgataagtcttggatgcaatctgtaaagaaaatacattatttcatcaacttattttgttgtttttcacatacacctaataagtatggtacacaatgccaatgccaaatacaaattgataacaaacacagcattcccaacagagctgtaatctagaaaactgagaaggtctgattgataaatcatcaacaacaataattgctctaaaacctccttaactgacttccttgattgtccaatgctctccattacctctgtaaaacagtcagttatgcccccatgtctagtgggcacccctgcatgcttcttctaaccactgagtgtcacaatgcctaccaagaatgcgtttgcaggttcctaaacctgtttataccagttgctatgtaaaattgttcccaagggaagttgaatgctctgtaaaggcctaataaaagcaaattactgaacaaaacatgttacagtaattatgagtgagaggaaactaagatggaaggataaaaatctaacactttactattcagatggctccactaaaagatttaagatcttgatccatttttaaaaatccaaaatggaagttgtagacattatctgtagtttatgcacaacaataaattagaaagccaatgtagacacgcataaccaaagaaaatgccttgggtctacataacagttgaataaatgtaaagttgctttttatttattgaaatttgtgcatgtctctttatgcttccctgatttactgattttttaaaaactaaccaactgcctgctttgatagttcagagaagagagctttcgttgtaatattagatttatgtttactggttgacaataagcggtgaaataaatagacttacctaatatggacctctgatgcaacttccattaagtcaccatctacattccaagggaaacaattttctgaagcagttycatcctcctcctcctctggattatatccaccagtattattccttggatgaacttttacttcctcaacagtgtaagtctcaacaaatggaaaattgaactaaaaataaatacaaataatcattatacttggtttatctctagctactaacgcgaatcaaagttcactgagccctctctcacaagtaaatatcagcatgtatgctgacattttaatagctttgagactatgaacagggatctccaactttttttggaagaaggaatctcttatccaaagccttttgggttcttttagatctagcacctagaaatcttgttttatgacaaatagtacatatctgtgagaagttacataaaatagtgatactgtagatttttcaattaaagataatctttaatactggcctgtagatacagaagacatataatccattatcaacttgtcaattagtttagctgacataaagcaaactagtacaagtttcacacttggaatttaatttggaagaacgcaagtctaaacttctgaagataaaatgggatgtatgtcttcttttaaaagagaaagccaatcaaatatggattttaaaaggtgtttgcctgccccattcccactttaacaatggacacaagctgcaagatcactgtttacttaccactatagaatggtgcaaggtaaacttcaacttgcgttttttcttgtttgcctaaggaaactatactgaaaaagcactatgtattttctgacataattaagaaaatatagccaaataacttgagcagaaatgtataactactcatttcagttttcagaaaaatgacatgagatacattcctaattaaacatcatctacatagtttttccccttttccacatgtaaacctcaatgaaacatagttttaaaagttgacagaaaactaatattttccccaacacccatattttacatatgtagataccaaggtccagccaactttccagtttatactgtaaacacagttaaacagtagatgatatgatggcatcagctgttgtgactgaggtacagaattagagggccccaagcaaaactgtttgacagtaactgcgttagacctcctacctcgggtataaagccttggctacatgcctcatccttgtagaattatctacataatcattcatgttagttgataattcatttaaaacacacaactgcctgttatgatctaaattatatttccctccaccaccccaactatgttcaagtcctaacccctggtacctgtgaatgtcccctgtttagaaatagggtctttgcaggtagaatcaacttaagatgaagtcattagggcgggccctaatccaatatgactgatgtccttatgagagaagaatgccaaggatggcagagtcagagactggagggatgcagctgtaagccaaggaatgtcaagaattgacagccaccaccagtaagtctattatcttaaatcagcagttgtcatgtgcactcctcacaaaatgaagatctagccatccttcaaatgctttaactgtgaagccacagacgctgttaagtgggactttcgggagccaagagcttagtatcctgtgtgagggtatgtttggggcacggggaggagaagtaaacagttacaattttgatacaggggagtgccatgatggtgcaagtgtggagttcaacggaggaaacaagaggaggcaaacaggctatggatgttgggaaagcttcccatttgaattgagccttaaagaacatataagatttagcctggagaagaaagtctggagagaggaagcatttacaaaactagaggcaaaccatggtcaagcaactacacagaattcagtgtgactcctaggtgctcaacatcatgccccttggccctcaaattcctgtattgaaatcctcgctctgtatacctcagaacataactatatttggagataagatctttaaagagacgattaagctaaaatgatgtctttaggccctcatccaatacgactggtgtccttataagaagaggaaatttggacataggaaaaggcatcggggatgaacagaggaaagaccactcacttgtgggtgctgtgagaaagcagccatgtgccagccagagagagaagactcaggacaaaccaaacctgctgacattgtcttgcagctctagcctccagaaccatgaaagaaatacatttctgtttgtttaagccatcttttctgtggtatttgttatggcaaccttagccaatgaataaaatgccaaaacactgggaatgtggtggagggtggtaataagaggtggggttgcaacacaggcagggacctggatacaaaggccacgtgttccagactgaggatattccatattattctgacaacaagagaaaggcactgaagaattaagcaggagagaaatccaatgtgtgtcttagaaaaaagtttctctaaaaagaggtatggaagacaagaccagagaacctgaaggccaaaaggaggctactgtaagcaagaaaggattaaagtttgaattaaggtgagggagaaattttagaaacatttaagaggagaccaacagaacaagttaggggactggtagtgaggaatgaggaagaaggaacagttcagggtaacctggatgggtagaaagtggtgccattgacccgcacagagcaacgcagaaggaacaactttaggggaaaagataaggtcggctgtagacatgttggcctccagatgccggtgaatttcagaacctcttcagcatacaagaagacagaggtcctgcagataagacgagatgacagaacccttgggagtgcatgatgttcagacagttcaaaagtgaggggcaatgaggccatccaggagacggcatcctgagaagatgagagggctgcaaagaaatcctgggggaagcactcacatttaaggttttaaactccctaccaaaaatggtcacaatgaaagagaaaagtgtggacagtgagaaggggggcaaagcaataggatggagctgcaaggactttgaagggtagtgttcagcctctatctaattttacacagagatggggaaggaacaggagccactccgcacatggtggtttcaatctattttacagtgttatacagtaacattcgcttattcaacctggtaaaaatggttcagagaagcagatgttactctccttaaactgaattgccacattttccttcctgaataccagcactgctatgaattatgcagtagacatgatttttacatagatctgattttcataatcttacaaaatttatataaattcacatttttaatgtcaccatgaaggaaagagcctaaataaacacacctgtgtggataattaacaaatcaaattaacattgcttgaaagcagtcaccctgggaatcaatctttcttactatatacactatgcaaaatattttagaattctttgcaaaaaaaaaaaaatagcatggattttaatttttgaaagttgataaataaatcagagttaaggccagtgaatcacacacaggcaactgtttcttgtgtcaaaagcaagatatgcctcgtagagtacatgagaaaatatgataaatcctgcataatattatctcttagaaaacgtcttcctatcgatacagatttttattattttctgtatgtctgtctttatgtgtaaggtaaccattgcttttaaaatcagaagaaaggtatattgatttaaaaaaatgaagaagaagaatgtttacaaaaattgcctgagagacttgccccataggcaatttcaaaagagaccttccataaacaatttgtgcaacatacacctccccaaaataaatacagaacttctcaggggtacattaataggttaatactatttaagttctcaaatagaggtacatgaatgaggttaatacttactttacttctcatttatttaataaaaaaggattcggaaaaaattctaccaaggtaatgacactaatcttgaggaacatggaattttgagtgctttaaaatcattttcttgtttctattttctgacttaaaaacagcaatgaatatatagtgctttgggttttttaaaaattggttttaatgtttagaaatttattaaaatgtgaaagggcatatattcctttgaaaatcaataaatctccatattccacccaaacacatacataaaactgttatgtaggctcacaacctacattatacctgctgatctactttgacatataaagaaagtgggactgtaattttttatgatttaagtttctaagcagcccagttagttgttcaatacatgaggatcaaataatgttactgacagatcaaacttcatgaagatggcctaagaaagttttaaaatataatgaggcaaaaatggagagacttgctatggctaaggtacataagcaaggttcagctgccagtcattggctgggtttactctcctcctcctcccgtctgttatctcccaactctatccaagcaccattttatacctttaagaatgtgtgggccggacgtggtggctcacgcctgtaatcccagcactttgggaggccgaggtggacacatcacgaggtcaggagtttcgagaccagcctgaccaacatggtgaaaccctgtctctaccaaaaatataaaaattagctgggcatggaggtgtgagcctgtaatcccacctactcgggaggctgaggcaggagaatcgcttgaacgtgggaggtggaggttgcagtgagcagacatcacgccactgcactccagcctgggtgacacagcaaggctctaactcaaaaaaaaaaaaaaaaagaaagaaaaag

SEQ ID NO: 17624 - DNA, 87467 bp, Homo sapiens
gcccttctctccttccattcattcatttgacatttgccaagtacttatccaagggtgcctggtacctagtgctgggcatacagaggaaacaagacagagcctctgcccccagcaaacttccagcccagtggagagtcgatggtaacaatcttccacatttgattcaaaatgctgaaacacagccaggctgtttgaaggaaattggttcccagaagaatggccttggctacaacagatggaaactggtagcgtgtcagttggcagagtcctgtgtgacatcttttgataaattaatctcatgtgaaagaagtcacccacaaaattctttagccagttgtcttgcccatacctttggttctgagggagaccattatgtaatcacttgactaatcacctggtattgacagtgacacaacttgacgccacaatttctacaaggcttgtgattgagaaaacttcattctttgtcaattatcaacaaacttctcagacattatactcatgcgagctgccttcagggcattttctttttccttttcacatctgtgcttaatgagtagcatttttgcacattgtttttctaagctttatatcctcatctgtaagaggagaggatgatagtgcttaccttaaaagtttgttgatggttagatgaaaaaaattcatatgaaacacttagtactggatctggtttagagtgtttaataaaatgtagctatttatttctatctaggtgctgaaatctttgtgacttcgtgactacttaaatgtgcatgcatgtaagcagtgccttagttttcttttttttttttttttttttttttttttaggcagagtctcgctctgtcacccaggctggagtgcagcggggccatctcggatcactgcaagctccgcctcccgggttcacgccattctcctgcctcagcctcctgagtagctgggactacaggcgcctgccaccatgcctggctaatttttttttttttttttttgtatttttttagtagagacggggtttcaccatgttagccaggatggtctcgatctcctgaccttgtgatccgcccgcctcggtctcccaaagtgctgggattacaggcatgaaccaccacgcccggccagcagtgccttagtttttaatgtttaaaatagtaatgattttaaatgtccattttatctcagtaaaatggtcatacttaatgaaagaatatatcaaacttatctagaaaatagttcaatataaatttacaataacatgtatatggcatctttacaattcgattgaatgtattcttaatttattttaactaattaattcactaattagacaggtaggcataaatattgactgctcatatcaaaatagtctattgttggcataaattgttatttactagataatgtttgtggttatttttaagcatttggctcaactaacttttgtgattagctgcatatgagatgtttaaagtatgttaatgcaaaaaggatagaaaataatttaaatatggcaaaacttctatttttttttaaattcagcctttcaacaacaacaaaaaactctttaatgccagcaacatgaaataacatacaaaattaaaatttttacaagaagctgctactttgcttggaaagatgaaatgttctccaagacagttttggttacatgttccagctacacagtagttagttcccattttactggataagttaaacacctttgccatgcctgttgggagttacatcactctaatgagaaaagaatattcctgttaagaagcaaaaagcatagattaaggcttttaaaaagtgctgattaaaaaataaagtcacttaaaatgtaaacaaaatgcctattaagcgmaaactggttagctttcatggcataatttaaagcccttatccagtattttctccctggttgcaggcaccctgtcaattcttgacaaacttttcagacattctacttacgagggctgcccgcagggaagtttatttttaacttctcacacctgtggttaatgagtaacatttttgtaaacgtggccattttcaaggaagaagggaagcattttatgccaaaaaaaaaaaaaaattcaaaataagaaaaaaaaaaaactaccctaatttatctccctctaatctacctatagaagaagatgaaatgaaagttcgagctctccagagtcaatggcctcctctctagcagaactggaagaaattaataacaggataaaagccaaaggtttcaggaaaaacagcccatcaattaaatgttacacctaaatgtaacatttgaaatgtaacatctaaatgtgacatatttaaatgtaacctttaacatttaacatttcaatgttaaatgttaaatttttgagacaggatcttgctctgtcatctaggctgggtctggagtgcagtggtgtgatcacagctccctgcagctttgatctctcgatcttctgggctccagtcatcccccaggactcatgtcagactcctgartagctgggacgagaggtgcctgtcaccatatctggttattattatcattattattaagagtgtctcactatattgcccaggctggacttgaactcctgggcttaagtgacccttccacactggcctcccaaagtgctgggattacaggaatgaatcaccacacctagcctgtttttatttcagtccttctaaatgactggatctgatcaattattttttgtgcttaatcaaatgtctccattgctaatcttcaaaacaaatgaaatcaatttaattcagatttccataattgctcatgctcctccttaaccttctggaataataaaatttcccaataccattgcccccygccacccacacccccctagttcccraaaatatatgtgcttctttttgttacaaaaagtttaaattgcctgaggctctgggaaaattctatcactatggcaattccaagaagaaacaaggcacagtcctaaatgaagatttgttctgtctctaccacatatatgccttcacacaaatagtaggtttcagaaggagttactggtgtagaagaaatccactactatattcaaggcaaacttcctctcagaaaaatgaagaaatgaggacgccttgtgtatgttgctgctacctgagagcaagtctttgaaaccaaaatcaggagatggttaagagtaaaaaagaacaaatactaatttttaaaatcaacttttgaaaaaaacaactttattgaagcataatttacataccgtaaaattcactcattttgtgtataatccccagaattttgaagcttttaccaaattgtacagtcatcactgcaatgtagttttagaacacagatttccatcacctcaataagattccctgtgcccttttacagttaattcctgttcccagcccataaacttgggtacccatgaatctactttctgtctctattgatttccctttttttgtcacatttctctctctgaatacagttttagaaagaaagaaggaaagaaggaaaaagaaagaaagaaagaaagaaagaaagaaagaaagaaagaaagaaagaaagaaagaaaaagaaagaaagaaagaaatccaagagtatttcctaccaataggagaatacaatttactgaggaagaacccacctggataaaatagaattcttaaggaagtccaacgatcctggacaccacacacgttggttgaattagagtcagagtggtctttaagatttaattatctctccaattagagataacagacttagagttacaagggaccttgataattaaagaatactgtagtaagccctgttatcttaactaagaaacgcctctgtttctaaagtttaaaaaaaaaggcaaaaaaaaaaaaacctttcaagtaaaagagtaaactcccaagcattcctataaaaatcagtcagatgttattttttttcttatgagacagagatatcctgtttccttaaataaattagatatctatgggattgaaatataaaagtttcttccaaaatgtaaggtgggctttccacttcaagctccactatgcataygattctagtgtattttcagtgcagtaaatatatcaaactatcatggttttggttgaccaaatacttttctaatcacttatttccttcccccagaatcaatgaattttaagaaagctttagctacaggtttatcttgcttacatccggatttccaggtatccttccctctggaagaaacactcggcttcccagaaatttaccaagcattttacaaggagctcttttatatttgaaaagagaaaactgttttgtcaagtgatgagaaattccaaaaaaatcctctaayccagacaggattctaaatttggggaaatccatggcactctttcaatttrgagtgtgggtcacaaagattcctcaagaggtttttttacactatttgtaggaaactgatatttgctgggtgttttgctttgttttggtttggttttaaatccttgcatgaataaaaacaaatgctaattttgtgtctttaatgtgtcaggcattttatagaacacagagttctaattactcctgtggcaattactgaaggtgaaacttttggagaaaataggtaccttgccgaaataaatatattttattagtagcttcttgtgttttaaagcaaatggaacctctgaactcctaacacaaggagaaggcaaagcattcagttcgggtctctctggatctactgtggaagtggtggactcctccttctgaagatctttaaaagcaattgtgcctgtgtttatctgacaaaaaggactgatgtgatgtgttgctaaatgagagacttttcagattccctttccactctgagtttagagttcaaggcgggggaatcttaaaggagaactttccacactcttggagtaaataacaattgaaatataaaaaatctggcggcgggggatggagggggcattctgtaatggaacttgtcagcaaaaagaaaatggcaaataaatgtgagaaaggggccgaaggagggcaagacagtacatagggtgccccccacccacccggcttttaatgattcaagcaaaaaaatctctgctttgtgtgtaactggcacggtgaacgtgggaaaggacacgaagacctttctctccccacagctggtccaactttccaattttcaggttgttcacagtgatttcactttcagtggaaacgggcgtcccatccccaggaaaggaaggctttcctgcatgtgtaaaaaagtaaactgttactttgtccttgcaaaagaaaacttcattctctgaacttccccgggatctgcaaagcgccccgcggaactcccggtacttagtagaagctcattaaaggtctctgttcccctttgctccccgttcgcccgctggccctttctcagagccagacaggcacagcgctgagaagggaagaagtccgaacagggagctgtgaagacaaaataagggagtcccgagtcagtaccctttagtccaaagaaagggagcgggatggggggaaaggcagccccgccctgggactgaaaagtctggattcttaacagctgcaaggtcgtggatattttatgggttttcttcctcacaaaatacactcctataagcagagattccccccctccaccccgaagagaggtgacgcaatgtcctcaaacactaccaccacccccaataaaaaagaaaagggaagggggagcgtcttgcaaccccttcgcttcacacaagtccagccactccctttcctcccagccgcttcccatcccttcccccatcccctaaaaagtttgatgaccgcaaaggaaaccgaaaaaaagttgtcttgccccagtcctggcgggccatcagcatctcttttgttcgctgcgaacccacagtcccccgtgacgtcacccggagcccgggccaatcggcgcgcggtcggctgcggcggccggcgggcgggcgggtggggtggggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccwgtgcctggggacagcggtgccctccacgggagcctcgaagagcaagaggcaggctcagcaaatggttcagccccagtccccggtggctgtcagtcaaagcaagcgtgagtactgaccgcgggctgaaacaggctgcctcagggatgggaccctaaagccgaccaaagttggggctgaagttttgtgcgcgcgygtgtgtgcgagtgtgtgcgcgctttactgagagaaaccagctgtgcacacaaaaggaccgagttttgagcacgctggttctgagggcctgggatgataagaccrtgcattggaggacgaggactctgcgactttcccgtgttctaataaattctgcacgttcagattgtccttctaggaattaaccaaaacttgcctttaaagagaaaaatgatgcatgtctataaattttccgtctgggattagtgtggtccttactgctacttatttccttctgttaaataattggtcaaatattttcaacatgggggtggaaagggggtattgaaatagctgtcttgtttctaactaacttggaagagatgtaattggttcagacctctttagggccgctcaggatacttcaccaagaacagaggttggaattctttccgtttttcaaagacacaccctccttttgctttgagaaagctgcttaaagttgtcctttttgactattactccaaaagaatatttaagttccttgcatgttttaaaaatgtgacttcaattgtctgccttccaaaatgtttccaacttttttatgtagacccctggccagatggaaatgacatcattgtatataacttttagcaaagttaaaaggaaaaaaatatgtacstcaatattcacatgaagaaaattccataattttgggaaaaggagaaatgcaaatgtaacgttttccttcaattatttkyagccggttgttatgacaatggaaaacactatcagataaatcaacagtgggagcggacctacctaggcaatgcgttggtttgtacttgttatggaggaagccgaggttttaactgcgagagtaaacctgaaggtaagtgacaacaagccccatagttagtatcttttaatacatgaagtggtaattgttaaactttgcattagtaagtaaaaatacatacaccatttttctaatagaattacctgtcatttcctcttaagtttaaaaackgcttatatttgcttttcacatgcttttacctttaaaacaaagaaacgaatctttcccaaattagttcctagagtcttctttttgctttactctcccaaagtttttgatgagaaaaatgaaagattttgtgtgtcctccgacaaaaaaaattgcttataaaattttaatttattagaaagcagtctcaaatcttaaactgttagtttatgagccagaaaacactttggggacttacatcgtaaaatgatttgtcagcggcagttaacacaaaaccattagccacttcaaagttctcattcctttaggaccaatgatatttttctcataaattatagcaactctgtcagagaagcactgatcaggggaaaatggaaatcataggattaacaactgtcaaggccttgtgggaggtggggatcttcgaattgtttgtttgtttttgttttgttttgtttttgagacagagtcttgctctgtcaccaggctggagtgcagtagcrctatctcagctcactgcaacctctgcctccagggttcaagcaattctcctgcctcagcctcctgagtagctgggactacaggcacatgccaccacacccagctaattttcatatttttagtagagacggggtttcaccgtattggtcagggtggtctcgaattcctgacctcaggtgatccacccgcctcagcctcccaaagtgctgggattacaggcgtgagccactgtgcccggccaatcgtttgctttttatgtgaaccttgctttgactttctgagtcagagattggaatgtgaaacccttcacaaatctagctctgtcataagttagtactttatatggccttttcctaagagcctgagatttttctacaatatgaataatttacagaaaatttgacaatatgtcaaggtcaaaaaccatggccttattagagcttaggataaaaatctgtatctctcacttcattttattctttgaggtgtaccatgttacttgtggaatagagaagtgggttttcctttagaggggattagtgaactagaaaarcttgtacctaagtgaggctcacatggactttccttttcccctcagctgaagagacttgctttgacaagtacactgggaacacttaccgagtgggtgacacttatgagcgtcctaaagactccatgatctgggactgtacctgcatyggggctgggcgagggagaataagctgtaccatcgcaagtaaggaagagattgtgtaaaatgatgccaaaatatcaaatatgaatttctctgttaccatcactgtcattttctgttatccatgactggatattccgaactttgaggtttgcccctggtgaccaggtactcttaagtggtcacccaactggttcctgtgtttcttaaagacgggtatgagcacagatggaatcagtgtttgatgtgtgtgcgtttatgagtgtgtgtgcatttatgagtgtgtgtgtttstgtacatagtagaaccaagagacctcttgggttccatttcagtaagacatgcttaggggagttgcccattttaaatcacctggatatcttcaagctagacaaatcatgagacttttctgcagtgactgggaaggtgttcrtgaagagtgaaccagccatgtgttgtctggtcttcatgtttgcaatgcagagacctcttgcacctcacagaaacagtctggtttcttggtgaccagtaggttatacccaggaagcagatgtcactattcctagggataatacaaaattattaacccaatagagtttgctaaggaactttgggaaccgggctgattctcaactctagtttagctaaggcactctttccagtatgattcactgggttaccaatagattctattaagatagtatttaagttttttaatccattctttaaatataagtcgtcttaaagacttctattcaaaagaacaagtcccgtgtgaataggcccaatcaactttccccatatttcatgttagggtttatccaagttcacaggcaaatcgcaagaggcaagggtccrtagtgtttacaatctagttcagcatttgaatgtgccattgggcttaacaacttagaaaactaccaggatttccacactttatatgcatatgtctgtttgctttccaccaaaatgacatttctatcctagggtaaaatacaggctctccatgctcccaaaagctggagtgctgtgcctgatgtggccttttcactgaattagtctcagtcttagcctgctgtgtatgagtgaagaccaagcctcccagcctttcttttctgcttaggacccaatttcctgtgatctctctgggaaagcaggattcatgacctcttccttgccatccagatttctctgtggttttccattgtgttctaagcaagacacttaaytgaattgactccaagtgaccagacctgttaacgtttcccctgtctctgatgggaaagctgttgtctgtgtctctactttagccaacctaagtacctaccatgggtggaatatgagaccaaaaaaaaaaatctgttctgccctctcctaacattttcgttgtatcttcaacagaccgctgccatgaagggggtcagtcctacaagattggtgacacctggaggagaccacatgagactggtggttacatgttagagtgtgtgtgtcttggtaatggaaaaggagaatggacctgcaagcccataggtgtgtgagtcttagggctgagcaagagctgggatgcttagttctaatgtggggttggaccagaatcacatctacataggtcatagacctgaattccagtgaaaaccaataaagaaatgggaattttgtttgaaataatgaattattatataatccatagtcttcttacaggagttagatcaaaaagtactgactacacatagaagtcttaactttgcttcaaaagcataaggtagaattgaaagatttagaatggagtcatttcttttacctaatagctgatctcagattcctccttsgtcaagatataatttatttaaaagaaaaaaaaatgacactttggacacatttctatatggaatgtcctggaccgaaacatgaaatagtgtgtgcttgtcacactctgctcatttcttttcaaattaaaagttgttgagcttctttggatctcaatcctcagttgaattttgtaagtacaagcctgaaagtttctggctataaattttactctgtttacttgtcttctaatttagaggtttttgtcttgttttgtattgttttgctttccaatatttaaaaatagctttctttgtcattgtatttaggccactcaaaattcataattggtcatttataattaagattggaattttgcatatgtagtctcccacagactagatacatacatagatccttgctactggaaatgctgctgggaagtttggggctcgctgaaaatatgtagtccatgtacttattaggagaatggaatttctgcctgccaactcagcttgagctttcttttgccttggctacttactgtgtgcttagatgctgggtgtgtcattctttctgaacagagtgccacttaaaaaaaatgtggctgaatttttgcttacacactacactttaaattacagggagcttgcayaattcaaaataacctttttttcctgtttttcttccaaatttccctacagctgagaagtgttttgatcatgctgctgggacttcctatgtggtcggagaaacgtgggagaagccctaccaaggctggatgatggtagattgtacttgcctgggagaaggcagcggacgcatcacttgcacttctagaagtatgttttacatctttatgttaaagattaagccaggtattgttttctggattcctagagagaagggtaatactatgttactcagaacacatccagtataycagcatgctttggtaacttctggawgtcaagaaaactttcataaccaacttattcygcatcttcagagaagactacataaatagaaaaacatatcactttgataaggttcaatctcagctcactgccactgacatagagttgaacaaaaggtttaggtttccttctatgtttgaaatttaaatagggcacattcacaggctaaattgataaaattaaaaagaatttatcccataaattaaaatgatttatctactctggagttagggatagtgtctctgacctaacgcatttgattagtgctgtaaagaagctggcctctggygtctttactgctccttctaagattgtcttggggtcttaattgttgcctttgggtttsaaggctccttttttgatattgtaaactaataacagctagagagtttgttgaagtaaaacagccattaactactggtgttgtaaataagtttaaaatcaaatccaaataatttgaacctgttttatttatctagctgaacccatttaactacctttaacatagccatcatccaaattcaaattctttgctaacaaaaataggtctctcatgaaaagtggtaaccattttgaccaaagctttcccagaaacttgctggtttattagatattttgcatttaaaatgttactgtgatyatcagacttccaagatctttgtggcaatattttagcttaagacaaattagatgtctgattcaaaccttatctgttatttagaactctttaaatagcaagttgggaaaagtttctcaaagagaagtcatttattccagaaaattttataaggacttactttgttcaaggtattataggggtgcagatatgaaatgaacattagcccagccttcaaagagtacttagggggtcagggagatgagaaagtcttatacatatttatcatctgcaaaacacagtattaaagatttcaacagaaatactgaaagtagtgctatggaggttcaggggatgataatacttttcgctggggatttgggaaaaagctctaatcagtaattataccttcatgcaaacttctattcttgtggtagatggatgtgggtgtgtatttgtttgaacctacatcaactattaattttttttctctaacccaggagttgcaacaatatccaattcacaaagacatcagatcctctatactcacatcgtggcacagagcaaatttggattataatttaaataatctatttaccagataaatgcacgcatagactaatggtcatttagttacaaattatcattttatgttgatcccactcttccagtggagggctaacactgaataatttggggctattttgctagtgatttttaaatactgtagatgtttgggtataggggaagggaaaataatattttagtcaaagaaattgtgcatcctctacattttttacataacaaatgaagaaagagatactaccaccttcttatagcttctttgtagccattggtgaagaccctttgatacctgcttgcctccccattgttataagcttttttttgtttgcttgttttttttgttttgttttgttttgttttgtttttgagacagtctcaccctgtcgcccaggctggagtgcaatggtgtgatctcagctcattgcaacctccacctcccgggttcaagcgattctcttgcctcagcttcccgagtagcttggattacaggcgcccgccaccacagccggctaattttttttggtatttttagtagagacgggggtttcaccatgttgcccaggctggtcttgaactcctgactgcaggtgatccaccctcctaaagtactaggattacaggcgtgagccaccgcgcttagcctgtttttagttttctaaagcaaggtccctattgaaaggcaggccataaacagtgatgactaagaaaaatcctggaagagcctgagaaggaaaaagatgaaatataatgccagagaatgaagttagtcaaaggaacagtgtgaaaacaataaataaatagataaatgaaaatgttatttgacagagagatgaaactagactaaaccattcagctgcctttccactgtaacaaatgtaatttcatctttcagaagtgtaataccttgcagcaccagagctgaatatgaacatattaccaaaaatagattaccaggcatagatagcattccttttttaagtttgaattgaccacttgcgactctcgacctgatgtatgtatgtgcttcctttgtgacacagatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggtgaggcacaggacgagcaggggcgggaaatggggaagcaggtcaagaaatatttccgcaaatccatctttcctttgacatgccatttgaggataatttgcagtgtttcagctaataacctaagataatttacacattattggttgttaaaactttttttaatgtcaagttttaaatttttcagaaaaaaagaaaaatgacatacaaataaaccttagggggaaaaaagccagatttatctccaaaagataaaactgagttttaaagaatgctagcatcataaaacttaccatggatagatcacgcacacacgcacacacacacgtattttgaatatccaaagttcatttgaaaggaaatgagagttataattaattatatgactacctggttcttctgctaggaaaggacaaaaaaagtgcatttggattttttgtttgtttgtttttgaatgaaatatacttccctgtcccgacattgaactctttttgtagtggaaaccatcctttatatgtggtttctatgctctggcaaactttgttacattctataaagtaacacacaattatttycttcatgtattggcattcgaaattttagaaattcagagaggacttagagatggccatgaaagacatgatatctaagcattctttttaaaaaacaagttttaatcatttttggcatgagaaaaagatttttacgtcataaatgtttcataaaaatctgaagagagaaatatggccaacaaggacgtgcactcctctcattatttttaatatgttttgattaactttttactatatgatgtgccaacatcattacgtagtgtctcagccatccttcaattaaaaatattaattgttctaatttttcttcttttgatgagtttttgtcttgctttgagcacttatgaaggtgaacaagattagatttgataatatctttgagttattttattatcattaataaaattgctactggccaaaaaaaattataaacatcggccacgcgcggtggctcacgcctgtaatcccagcactttgggaggccgaggcaggcggatcacgaggtcaggagatcaagaccatcctggctaacacggtgaaaccccatctctactaaaaatacaaaaaattaaccaggcgttgtggcgggcgcctgtagtcccagctactcgggaggctgaggcaggagaatggcatgaacccgggaggtggagtttgcagtgacccgagatcgcaccactgcactccagcctgggtgatacagcgagaccccatctcaaaaaaataaaataaaataaaaaataaaaaaaattataaatgtcagtctaccaaaatagattaaaagtgtaggtgggaattaaatggggataaacactcaataaatgttagctatatatgaatattgccaatactgaaaagattccattgttcaaaaaagtttgagaagcaatgggttaaacaaaatggaacctgctctgcagaatctgtgtgttcctttacatcatactctccatggtagagtgtaggggatgggcgccatgtctccctagtacgtttgaccttgggattctttgtctgtgaacatctttgggttctagtgttcagcagcacttagggaggcactgaattcagtgtacctttggtctagcctcagccctgattctgttctgcggtgggccctggccttcaagagaacagatatctaaaagttgaaagaaaagatcggccgggcgcggtggctcacgcctgtaatcccagcactttgggaggccaaggcgggtggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccgggaggcagagcttgcagtgagccgagattgcgccactgcactccagcctgggtgacagagtgagactccgtctcaaaaaaaaaaaaaaaaaaaaaaagaaaaaagaaaagatcaacacatcctgttgtgttattctgaaaggaaagctgtcttaagaggatcaattggttttagaaaaaacacaatagaatcacaaataatccagaggagaaataaaatgtggaaggtggaggtgacctccagaaaatccaggacagctgctgaaggcaccctctgatgagctcggttactcagaagagtgaggatgtgttgaaggtatctgctgtatggagtggcaggatgatgtctgtgattgagaaatataatcccggccaggcgaggtggctcatgcctgtaatcccagcactttgggaggccgaagcgggtggatcccctgaggtcaggagtttgagacaggagtttgaggtcaggagtttgccaacatggcaaaaccccgtctctactaaaaaatacaaaaaaaatcagctgggcatggtggtgcgtgcctgtaattgcagctacttgggaggttgaggcaggagaatagcttgaacccaggaggcagaggttgcagtgagccragaccgcgccactgcactccagcctgggcaacagagtgagaccccatctcaaaaacaacccaaaaaaccaaaaaacaaacaaacaaaaagaaatataatcccagtagccccagctgagctggaggatggagaccacttggtagacacttgtggattatttcctaggctaaatgcaaaagctactgctgaataagggwcatttttttccagtcccaggccagtagcgacatagatttcagagtgatctctgtgagatcctgaagatcctgactgcagaaagtagtgaattgtcttctctcacccagttttgtgacattcccttttcatgccattaggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacaggtatgcattatctttttgaagaataggactgatgactttattatttagtttttgaaggacaatacattttcaatgtgaaacaataaaacaaacaagaagcctgtaatcttaccaccctgtgataacaattagggttggcatttgaaatagtttcttccaatctttttaatttatgtattttctttctggtcatggatatcatgggtaaaaattttattgtatttatctgtctaaagtgttgttacaagagagctactttctgaataatcatcaatgttttatattctaaatctcaaatttcagcagctttgtgatgtaaacatcttccaataacctaatatatgtattctgcactacaaacatggtagtcactatggcaataacaattgctacacaattctcccccagaatagtctcatatattaattttatggcatagatatagtcataaatattatcccaacatccttaagyagcatccttaattgacctgtataaatatagctttacaaatagagaaactgaggcatggcagcagaagtggtcatgaaggacatcagcagaagaactcaggtgtcgttctatccacagtagacatggattcctgagtaatgcattttgactgaaattaacgagatgatcatctatactcatagcttcttcctttgagggcacaagctcagtatctcattgaagccataaataagcagctgctggtgggagataaagcatctctgtttactgacactcttttgattatgattgtagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactggtgagtgtcccaagggggagccacagaagtgagaaaaactcactttcatgccctagttttatttgccagcattytagccatttattttgaacccgcccaagaagcatcgcttttgttcagtttggactcaagagatcgcagcgctcacgtaacagctgaggattcttccatcttccccagtactgttgggaaatgacaccaagggagtagccttccagttcatttgatttaacacattgggattatgatgtgattaaagatacttgtattttggaatcagtagatgatcccacagggctgaggaatacaaaggatgaatgttttagtgccttagcttattttccagttaaaacaatgttttattcaaagctatcatttaatcttttgtggggggggtgctggggaaatgacagtgaaagtgggatttaaacctgttttgaaggtgtgaaggtaaatatgctaagaagcttagaactatattatcagacattttttattctgagatagactgtctgtgaatgagctgcagaaacctggctctctcagaccagtaattctgtgtacattggaaagctcagcggtaatcttttccttctttgttgtgtattgttcctggcagttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctggtaagatgaagcccttgtgggttgtcttgtttgacaacaatttagggagtagagactaaagactagtgtccagtttactcccatttcattcattaacacaattttgagacaacagaaaacttcatgtgaagtgtgtttgtgtgtgtgtgtgtgtgtgtgtgtgtgtgtgatgttacatcatatacataaggattgggaagaataattagataattatttatataatttttaaacctcattgacatgatttaatgtcaaaaatataattacttatttgtaagtctggaaatatgaatttgcacaggtttgtctttgtaaagagcacacaactgagtagcttacaacatttaatatatgtatgacggctttagtcacagagctacaatattgacacatggttgtggtttgatgggcataagctctatcacttattaataagtgccaaagtgactaaaactcaatgttttctaacaggtagggaatctcactctttttttaaaggtccccagtttgtatagatggcgaacaaatggaaacgaataccttttacttgttttcagatttcaagaaccccatagattccctttaattttccagttgtagaaacaagagcctgggcggtaggcactgtcaagtgtgactatgagacaaagaaattgcttatacttttatttctttcaacaaaagaagatgctgagtttagaagaaaaaacccacttttgcttgtaattctatatccaaacccatagtttttatttgatccagaataaactggaactgggaaaagttatgaagcygtagttaaatccaggcttctagaacagcaagaaccctttgtgtggatgtgtagatattatcttagtttaacatcccctaacccttcctgtaactattttctatgacacgtttggactacgttttctgcctccagggctcaaaaattctaccccttcacctgacagcacttagatgtctytgaygcacacaaagcttcttcccaagtgagaattcttaggatgaccaaactgaactgatccttttgcacacatacatgtttagacctggtgatcatttatcaagtgcatttcttatccatttccaaacagcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgaggtatgctggctgattaacaaaaatatttgagatggcaaaaggtacagaaagggacacttttttttatgaaaacttgcactatgccaaaagcaggggaagaaatatggaatgccacgtcattcattagtctactgtgcatggtaagataagcctgaaaggcttagcaggcagcctgctaagacaagcggcatagcaatgctaatgttctgaaacactcctagcatgtaagtacttaggctgagccaaaaagatggcttcaaaagtaagaatgaaacatttgatccattcagctttaggctatgccactggattcatgtctagaaaagataggataatttctgtaaagaaatgaagaccttgctattctaaaatcagatccttacagatccagatttcaggaaacaaatacataggggactaactttccttgttcagattagtttttctcctttgcacccagctatataatatgaggaagtattgactttttaaaagtgttttagttttccatttctttgatatgaaaagtaatatttcgggagaaccctgagctattaataatctatgtggctagtgcgtagatattggtctgaatttgttctccttttgtggtgtccagtgggtaacaccatccgggagtaataattacatgtggtgttgcagaactgaaagagaccttaataacacatagagacctcactctatatagatcaaggagctgagacccaaaaaggaaaaagtaattttctcaggatctctcaaagagtgagcaacagagttggcctaatttattttagcgttgtgaatactgttgacattttatttcccaaatctaagtatctcctccccttccccctattccagagaccagaccaccacatcatgctgggtgttagataaatatgtttaatcttcttcttatttatcctaacaagcagatatttaaaggaaattatcaactaagcaagaaattttcagaaagtaagacatgtatttgttcaaatactggcttctcacaggaaagtgtattttaccacattctttacttgagcatactgtaacctctgcaaaagttacacattttrggaagaaaaaaatttttttggcaaaaattgtattactgaccaaactttgaaaaaaatgttattctatgcttgtagaaaagttattttagtggaaggtgttgataattaagtggaagtagttgtatgctttgagaagcataccttttttctttcatcaatggaactttaaaaagtttctcactcacccacctgtttcctraacagatcagtgcattgttgatgacatcacttacaatgtgaacgacacattccacaagcgtcatgaagaggggcacatgctgaactgtacatgcttcggtcagggtcggggcaggtggaagtgtgatcccgtcggtgagtagccctatttccctagatgagtttgcacagggggaatggttagcaagtttcagataagaaaagctatgtgaaatcacatgactgaagttggctccagactttgatcagttgcttgcaaagaactttgcaaagtcttctctctaatactggaccaaaatatctcgatattggtagtcgtctggtttttgctgaatttggtgacaaatttaggcttattttaattgaatggaatttattcttgggtttagaatcataaagataatccatgctattaaaagtattctttccttttttttttgtttgtttttgtttttgtttttttgagagagagtttcgctcttgttgyccaggctggagtgtatggcacaatctcggctcactgcaacctctgcttcctgggttcaagcaattctgctgcctcagcctcctgagtagctgggattacaggcatgcgccaccaggcccagctaattttgtatctttagtagagatggggtttctccatgtgggtcaggctggtctcaaactcacttccttaccagctgtgtaacagcatgagcaaagggtgtaaatatcacccaccaaaacactctaggtttttttttggccgcccttcaaaatagaactaagcaaatagtgaaggctgagccttaaaagagctgtgttaccagcactacaaagtttaaggtgatccattactatttctttaccaaaagagacaggttgctcactgagaaaacaaactgataacatccgtttgtttgacgtgagattaccagaactgagagagaagcctgagaggttttcttagaagctgctcagcaggtatactcgtaaagtctagttcattcatttaaatgtcaaacagtttctttaaattttgaagaagtaaggaaaatgaaattattgcagatttttttcttgctatttaaatgttaagccagttatattaatatgggtaaaaataataactaatatttaaaattaatgtgtagattatcaatatacactgaaatctaaatctttacatttttatttagaaatattaccttttagaaaactaaatattcctcctaataggtactttggttttttttttactacaaactgtcctgtaaggtaaagaatgtgaacaaaatatttttttaactgcatatatttgtaagaacaattgcaaatttctatttaagctaaatgtatgctctagcaccctgaaattaaattcgtagttataagtcttcaaggctgtttatcttttccttccatgtattttagaccaatgccaggattcagagactgggacgttttatcaaattggagattcatgggagaagtatgtgcatggtgtcagataccagtgctactgctatggccgtggcattggggagtggcattgccaacctttacagacctatccaagtaagtwgctctattactgcaagttgagaactgccarttgggttataacaacagggcagtgattattaatgctctcatgcctaagttgggggtctcccctctttcccacccttttctcttgttattatctaataatcaattgaatttttgattaaaataatttttctctcttcctctatcaagtaaaaggtagagaaggctatgaaaatgtgcctgtttataattttacttcttaactctgtaaaatattctgttaggttaagacactctggctaatttcatcttatatccatacatggaaataaaaaccaccaagtgagttatgctgggagtaaaggtttggggctttatattatgattcttaacagagaagctgcatagagagatggcatgaaatgcagcataakgtacgtgttcattcaacatgtcatctaagctccctttgcatcaaacttttcatttgtttgatcagttgccaccaggaacacagtatgttgggccaagggttgagtaacttggtcaactctctgcccacacagttcaaacactctcaaatgtttattgctgggtttttccaggtcacaaagacatcatgcctagctgtaggtgtaattagttcatttggggggaaaattgcatttaaatattcactgagtgattataataaaacatgttaataaaacatgaaaggctaattaaaaggcatcagttatttgagcaactgctgaggtgcaaagtctccaaagtcttcactaacgtttgactgaaaatatggcctacattcagaaacaaaagagtttcagggtgtcagaatctgcatgcgacagaaattaagattaactctgtgataaaagattcrctgtgacagagaacaagctatgggaacaacttggccaaaggtagtgttagccaagcctcattcctccatttcctcatctgtaatatgggaagattgtagctgattacctttartgttccatcctaaatactraacacccagatgcaccttttctaggaacttggaagattctgcttttcccaaccctcagacactgtcagtgctggggaaggtgacttcacttttgaaggcttatagcacagattgaccaacctcctaaattgtatttcttggaggatttaggtgtaggaatcacttaattttttgtaacttaatatatatttaaatctgattgtggaagtactataagtatatgaatggtttgtttgtttatatgatgcaaatgatacttaaatggtagaaacttctaaaaaaatgctctgtggtttctatatttatgattgttattggtgttgcaatttgctgaaaatgatttccttctgaatgattgagagagatcttcgtctctctcaacataaggctgtccacatagctgcttgctggaagcatttaggtggacatgttggagataaaatctggaaaggaaggaatccttgagtattggagtattacatgttgaccttaytcctactctttaaaaaggagaacagcaagatcccactgagcatagaggtgatttcggagggaagagattggaatttgacctcagatatgctctttggtgcttatctgtatgtctggtttgctccgtggcctagcacgtagggctttaagagtgtggtgagaataagggaacagcagattaccaacagattgtctctgagtcctgccttgtttgttcctcctacagagaacttggtagagttgttcaaactagcaaaagataagaggcatttggtttgtcaataagcaactagaaaagcacagatctcagcaaaataaatagagaaaaaaaggactgagtcaaaaaatcataaatgtttaacttctccaaggacactactattggaaattattcatttagactttatttgaaactaattttaaaagtgtagacattgtactatctcctttttttggtatcatctcaactattttattgttagtttattcatattgaataagagagggagtaaagatttcacaatggcgatagctagtatatgccaattaagttaatttaaaaagttataccaactaccagtagcgaaaaaggactgtcaaaagtttaaatctaaataatgtaaaagatgtcataatttttaacttttctgtctttaaaggatacatagtataagctagagtaattatacgtagtataagctagaatataggaatttaattgatctaagaaataactgacacaaagtctctttacttcctgaacaaaaacatgctaaattccattgctgttcagtccatttcctttaaaggtgggctatgccacagggctagattttaaaacgtggaatttcasaccagtgctcgaaatcttatgaaagcaaaagggacctctgtagttgtactccactttggcttgagtaaaaaccactgctgtaccctttttctttcctttccctgcccatttttatcctcctccttgtgtccttgtggacatagaaatatgattaggcttagaggtgaacagtaaaggtcatttatgttatcttttcaaaacttaatagacatttawccatcataagcttgtcccccctcaaaatcatgattgacaagactaaataaaatgtatatcaggtgtctctttatggaggaaattgtagtaggatttatttaaaggatcaatatttaaatagccctatgccaattatcataaataattaaggacatgatattcctagctttcctgatttacatggaagtacgttaaatagtcacatctccaaaatttttcttgaatagttgtctttaaaaatgtgtttacatttgtaaggatcttcataaacagaaggggtaattcaaagatrggcatggaattgacttatgccaattgattaaaacaaacatcctgtgtgttctgtgaaatacatacaactttaaaatgaaaaactcataattttatgcatgaattttggtgttcatgtggcttggaaatatgtgcattaaatggaattaagattcaaagtatttgctaatcttcaaccaactttgaattgttactggtgtggaagtgagcatattgttttagaatttctgaatctacatggatatccaagttatatattttttctgctacagaaagctttgttttccaagagaatttaatggcttagataataaagtttgaaaatcaatgtattttttttcctagaagctttcagaaaacttaaatctgttaataatctggtgaagtgctttattacacatrcaaaattttgctctgtttgacagagtgtcagttagaaattcttgaaaaggttactataagacacaatttttatttctagtaatttaaacattgactgacatcataaagatagtgttttaagaaaagatagttttctgttctgcaagcrtaaattttctagctatttcattattatcttaaatggagttaacactacttwgaaatkgatgctacttcccttattttccttttattttaaacaaaagaaccaaaaccatactttaaattttgttgataacagtgatatacatcaaggtgtagaaatactgaatttagtatacacttcataaagtcatttctgttgacaactgattttggaaaaaaaataaatttaatcacttaataatttgatggatcaatggtgtgatttgggagtaaacttcttgaataaaaataaaacttgatgttttttccaaactgatagactgcttagactgatgagaaataaaactaggtctttaattattacctttgctatttgtctaagattctacccccatttagaaatgtgtttgttttacatcatctcatatggcctttggaatgttgtttccttcttaggtagtagattcattcttgatgaaaaccttccaaaattagaatttgctttaaaagaggctcaatacaataagtaaatgaagtctgtgttctgtattacattatttttgtaggatcgtttcacaattttctcacaattcttactttgatagtagagaaaataaaagcaagccaagagacttttttttaaaaatatattttatttgctataaacaactatgatttgcatttctcatgtgaagaataataattatcggctaaaaatggatttgctgcattgattttcaacgtaaatatttaaaagattaatgccagataattttattatactcacatttaacgacaagcaaagctgtttataatgatgactgtccatgtacacagttttaagttgaagtgagtgaatattcaagataattaaatgctacattttcattttcaggctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactgaggggattttggttttggttttgggttttgtttttttgcggtgggggggctggtatttggaagaatttagctctttatgttacagaaatcttttttgcaaggacttagaaatgataatgcttaagattgttcttgcccaatgtgggaagagaatctaaggtttttatatgtcttgcaacctcatcaaaggaaaattactggcatcattttcataatttgaaaaaaaaagccaaattaatatatttcttttttgattcactttttaagtgatcatttttaaaactttacttttgacccactgwatttatttagatagaaggaaaagagatgatgggagggaagtttagataaaggatggaagttggttttatttaaacaatagccctgtgatttcctaatgagaagtgactagaaattgaagaaaccaaataaggaggatattggtcaatttagctttagtttctcttactctctcaagcctgccctgtttaactccaaagttcatggctcataatttgagaaacactgttttaaacacaggagaaaaaaatgtccattttaaatcatagctattgaattctacaattacaaagaaacaaacaaacaaaatttgaccaacccaggcggttaaatttaaactcttcaggaaaaatttaagctgttaaaattattctttttctaaatttctaaagtggagggacagaatttttcagatttaaaagggcctcctaggtgcccagaaaattagtggaaagaaccacgtctagacgcatctttgatgtgtcagagttccaaggataaaaagaaacttttaaagtcttctatactcagccaggttatcaatcaaatatgagggcaaaataatattttcagacagattttaggcagtktatcttccatatatccttttctttaagggtatttgtagatacactccagaaaaacaagagtgaaatatgaaggaagttgtggggtccagcaaacagtgcttccaaatcagacccctgatagaggtggaaaactttgcaatgcaacaactgcgtagctggcttagaggacagccaatacagatggaacagaaagatgaggatgggattgagggatcagggattgaggtctccaagaataaaaagggacttcatggaaaaagtaggcttgtggataattaatcacaggggcaaataatgcagttaaaataacaacatgacaatcaggtggaggaatgtataataaacccaaatgtggctgggtagagtggctcacacctgtaatcccagcactttgggaggccaagccgggcagattacctgaggtcaggagttcgagaccagcttggccaacatggcgaaaccccgtctctactaaaaatacaaaaattagccaggcttgggggcgcacgcctgtagtcccagctcctcaggagctgaggtaggagaatcacttgaacccaggaggcaaaggktgcagggagttgagccaagatcgcgccattgcaccctagcctgggcaacagagcgagattctgtttcaaaaaacccccaagtgtattataaggcaataattcctatacgaagcaaactaaaatgcagcaatattaaggtataaaaacaaagaggaataattccattgaaccttgattctggaaactttgatccacccagcagtcatgatgttagactcattgaaaagaatgtatttctaatgcatgatgcgatcggtctatagatgtgtcatggaaacttggttgcaacttcaagacaaaataaaaagtaaacatttacatgaaaaatggtggatatggaaggtggagaagagaggagataacagctttatctttcaaaatagagaattgagagatggtaccaaaagctgatgaagtaaaaaaaaaaaaaaaaaaaaaaagatacttaatataatactttaaattacaaatataaacacaagaagaacaaatataatgatacaaatgtcagacactgggaatgtccaagattctggaaggaaagggtggtattattgagctaaatcctcaactttgtctgggcacagtggctaaaaattagccgggcatggtagcatgcacctgtagtcccagctacttgggaggctgaggcggaaggatcgcttgagcttgagaggcggaagttgcagtgagccaagatggcactactgcactccagcctgggagacagagaaagaccctgtgtcaacataaataaatatataaataaatcatcaagtctcatattaaagasyctgtaaatatgacttattgttgacaaatgaaacaaatagaggtgtaagcatgttgtctacatggaggcaagaccagaataatagaaaatggaaacagattcccttaaagaggggaatcgtgtctttctcattggctcartgtagtctccgtagagtctagaatgcttcagcacctggcacactgcttaacaaatggtgaatgaaaaaaaaaaaagaaaagtcattctttttcttctttcaccctatgtycataatctggccatttgcagaacwtgatgtccagtgatcgaaatcaacagcatcagtgcatccaatatcttctagtctctcatcttcttattacatcattaattttatttactttaaaattaaggatatccaaagtattatgtgagaccattgcaatgggagacttaaaagtggtataaaatgtactttgggccaggcgcagtggctcacgcctgtaatcccagcactttgggaggccaaggtgggcggatcacgaggtcaagagatcgagagcatcctggccaacatggtgaaaccccgtctctattaaaaatacaaaaaaattagctgggcatggtggcgcatacctgtaatcccagctactcgggaagctgaggcaggagaatcgcttgaaaccagaaggcggaggttgcagtgagccaggatcacgccactgcactccagcctgggcaacaagagcgaaactccatctcaaaaaaaaaaaaaaaaagtacattgaattgraaagtcttcaaaaagcagcagtgatgaattttttgagatttttaacaattacaaaaattcagggttttttctaatggatgccacctgagactttattttctgttattttcttgtaataactaaccaaacaagctcatgttgaaaaatgattactaaatttgagctaattgcaatgactggtttcaaaattttccacagtgtatttgagttaaaatttcactgtgaagagtactacgatcactctcgcttattccaaaaatataaatggacacttgagtatttgaattattgaggaaatggttgactgggtaatttttaaaaatcactgggcataaaaaatatattttgacttatattagtttagagtatttacacttgaaagagtctcatcttttctgaagggtgtttctttcatacacattttattgcactgagttttgtgacccatggcatattaatgaagctgaacaggatgtgaaatataaactggaagcaaaagattaaataaaccaaaattgcattttttctgtagtcttgtccaaaattgggtaaccacttctgatggggtagctcatatccaagaatgagtcacaaaaccagacttgttgaacctggtatatgatgagtcacaaagcaacattctgcctttgttttttcaggacaagaaacttgaattgtatcccactgagttaaaagataaaatatatggcattggcatttctgtacttcagagaggaatatatctgtttgtggtaggaataaaaaataagtgagagaggcaaagcttaggttcatcatattatgttactgatataacacaattaacttggtaaaagtgaaggtgtgggtgggcgtggtggctcacgcttgtaatcccagcactttgggagtccgaggcgggtggatcacctgaggtcgggagttcgagaccagcctgaccaacatggagaaaccccatctctactaaaaatataaaattagccaggcatggtggcacacgcctctaatcccagctactcgggaggctgaggcaggagaagcgcttaaacctgggaggtggagtttgcagtgagctgagattgagccactgcactctagcctgrgcaacaagagcraaactctgtctcaaaaaaaaaaaaaaaaagtgaaggtgccyagtgtctgcaactatgtcaccccgggcatatcacatatcactctgtttttccgtctgtaaaacgggagcaacaatgccattgccttatcatcagaaggatatggagactaaatgggagaatgtaggtaaacagcacagagtatgggtatcagtaagtaaactgcagcagtttgttgatgttaacaatagttagcattatatctaactatatctaacgatataaccattgggaatccagttttccatgattttcctctagaatggagctgcctaagtcctgcttaagtcatttttctttgaagattactgaacatcatcttcaaatgttcatccttgtaaacacgtgtgtgtgtgtgtgtgtgttaatttaaattttcagaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagtatgtacacaaccaccctcatgcctcctacccccgaggttcctagagctaggctctcctgaggcaatgctttccttctcaattcatattcttccaggaggggcaccaacgttttttaaaatgatgttggcgacgaggacggtaaattttctagatgactgaaggctgactttcccctttctgtgactctctaggcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctgggtaagctcaatatgtcgctcaagacaggttcagggcagctgctggaaaactctccttgtgggggtgggtggcctctaggcaggtggtatctgtggtttggaactggttgacagctcagactgaacaaaccaccctctggcatgaggaagggaaggactgactctttctaagaagtggccgggtttttcccaagccactgtcacatgttcctggtccctgatgccagctgcatcatgcgcctacctgtgcacaagttcctacagcaaaagctgtgttcttggtggaagtaattaccaggactgcagctgacaatgtgagcacagtacggtcactcatacttttcaaattgttatggtgaggggcctttaaaaaacttcattggcgcactgaagtgtgtgccatcgtaagcactgagttcagtgaatttgaattcttataaagtgaacacaccacaagaccagcacccagatcaagraaaagaatatctctctaccctcaccccatcatcttccgccaataatcactaccctgactcttactgcagagagctatttttaaaaatttggcattcgattacaaaaattatacgtctttagaaaaaaagttggaaaaatgaaaggaagaaggaggaggaggagaaaggagaaagacaagaagtggkgttttcccatagtacattaataatcacagattaggtgggtgcggtggctaactcctataatctcagcacttcgggaagctgaggctggtggatcacttgaggccaggagttcgagatcagcctggccaacatggtgaacctccatctctaataaaaatgcaaaaaaaatagcygggtgtggtggtgtgcacctgtaatcccagctactcgggaggccgaggcagaagaattgcttgaaccggaaaggtagaggatgcagtgagctgaaattgtgccactgcactccagcctgggcaacacagcaagactctgtgtaaaaataataataataatcactgattagctattagcacattaccttctagtcgcttttccctatgaatrtataattcttaaaatatccttcttataagctgtagagtcatttgagggactagtttgctctgattagttaccttttcttttcatttcaaagatcttccaagcacagccacttctgtgaacatccctgacctgcttcctggccgaaaatacattgtaaatgtctatcagatatctgaggatggggagcagagtttgatcctgtctacttcacaaacaacaggtacatgtgtgctacatagtgttaaaagaatctttttctgtaaaacacaggcctgtagtagcacttcctgactgttygccccactttctttctttcttagcgcctgatgccccwcctgacmcgactgtggaccaagttgatgacacctcaattgttgttcgctggagcagaccccaggctcccatcacaggtcagctaagcstccccctctttggctgctatgttaatsttaatgacatcagcagggagggcgcagattctgactgcggacctgcatatcactttaaatctccaatataatttatgggagaggggtttgtgtgtgtgtgtgtgtgtgtggtggcgggggtgggggagttattttctatggcacatttccccttgaaaccatttcaccaactcccttatacacacacaccacaacatacacacaacctgtaaagccagctcattggcttattaaagcaagtgttcccagggttgaagaggtgtaatttcctgaaaacgttgctctaagatttatccttaaggagaaagctgagctgtcgtcttagctcattaggtgattcaactgcctcatcactgaagttccaaaaagacacacacagtgctagacaactctgcttaggctggttcattaattgcttccctcgtctggagctcaaagaggaaaaatcagcttaacatgaatattttcacctaatggcatctctaattgacatttattaaggatgtcaggtcttcaaggatgacatttattattaaaaaggttcgcatgactgttcttattttatcttcgtgctgaatagtcattattagaagaagtggcaatattcaaagagtcaaaaagtatcactggctcttcactaatcaagcaagatgctaagggatattagaaaagggaggatttatggtgtttctaagcctctgtctcaaagaaaacagtgcatcttacttttgctcatgaatctgcagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcaggtaacttttttaagaagacacttcctatgttatcttawcaggattgttcctgaaggagggttgttttgtctctgtcaacagtcctcwcattcaagaaatcttatatattagtttttccctaaacttctgatatttagctgaaatgtcataagtaacttatcaaagctggctactggcctttctgattaaaaactgacaccataacrtccatctacaaattttcccctagaagcttaagggtcatttcatttttgattcttaagtattataaaatgattcagtaaaacaaaaactgttacattattttctgcagttatttcaaaggctttttctaaaaaawtttttagtatcttttcttataaccctctccccccaccaccatatgacacttcatatgctggtaactcacttattacctattttagataaaaggttcaaatgtcataatttaagcactatgactggaccatgaaaatgtgatctgattaagagacaaaacttagcaaaactctcgaatgagaggctcaatgaactgcctaacatatccaagaaactggcttcttaaaagtaatcttcagcagagaatgtgaatgaccagttgactcttgtctgtcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccagtatgtcttctcctatctctatctcccctccaaattctccaccctcacttgcagcctgtgagaaagtgcagtaaaccattcactcagaggtgtatggcttasagagagggaaatacccagccggcaagggaatgcatagtgaacacaaagcacattaaacttgaaaacaaaactcagacaagctccatggatgctaagtggtaacccatttctaaaatacatgtaccagctgaagggtactaagaggggagaactgaagagaatctaatttgagtgcatttttcgtgtaactaaatatatctagatcaaagttaaaatgcaggatcataacacttagagtagaattcatttaacaatagcaattgtcaagtgtctagtattactagccaccagcttatctgctcagtttttacaagcattattctcatatttactctttgttttgaccttaggaaggaaggtcttattattattattttatttatttatttttttgagatggagtctcgctctgtcgccagggctggagtacagtggcaccatctcagctcactggaacctctaccacctgggttcaagcaattctcctgcctcagcctcccgagtagctgggactacaggcgtgtgccaccatgccctgctaatttttgtgtttttagtagaaatgggtttcgctgtgttggccaagctggtctgaaactcctgacctcaagtgatccacccactttggcctcccaaagtgctgggattacaggcgtgagccatcgtgcccagccggaaggtcttactagtatccktattgaatacttaaagaaactgaggctttaaaaaagttctgcaacttgtagggtcacagagataggaagggatagagctggctctataacctatgtccgaagcccatgctctcaattattatactcgactgcctcttaaagatttcctctatttgaaaggtaatttaaatttcggtgggaaaactgctggttattattctcaagaataaactccacaacttatgtgattctgatagtgcaaactcaccagtatcctaccatgaatctgaggatacgttatcattactgtaattactgtctaatctgaaccatgtgaaaataacttttatttctctagcaaagggctattcacagaatattgcttttgacccatagagagcttcttcttgctgtcattttaggaggcatatccctttttccttaatctgtttggctcagagctaactgtgaacttcagaagtgtttgttttgcctttttaaaaataccattgctttaatgtaactataatttctgagactgatgygaaagtcttgctggaaaattagacttcccaaaggatcacagtcaagcaaaatggttccacaatttctcatgactggcagagttttggcaaagttttgtgtagcactcaatctcttactggctcagtttttccagggttttgactttcacatagttacaaccttgaggagagaaaacttagacattcaatcaagtttcaggacttgagttatgatcattactgatctaaatatttcttggcatgtttcatcttttttcctagaactggatgctcccactaacctccagtttgtcaatgaaactgattctactgtcctggtgagatggactccacctcgggcccagataacaggataccgactgaccgtgggccttacccgaagaggmcagcccaggcagtacaatrtgggtccctctgtctccaagtacccmctgaggaatctgcagcctgcatctgagtacaccgtatccctcgtggccataaagggcaaccaagagagccccaaagccactggagtctttaccacacgtaagctgaaaattaartgccttttcttaactatatttacattctctattcttcatgctttaaaamaaaacaaaacammamaaaaaaaacattaaaaaattagtacataatttaaatcagtgatactaaaaatgtgctccatagactggctgctggcccgttaattgtttgctgctagtctgcaacaagaaaaacggttgtgccagaacrtaaatcacaaagcacactgcttagtacagctgagaatttttctgaagccagattttcttgatgaaggaagcagtgtgttaatttgcacacattgccaagctcgctctttcctctagggccagcactttgagtaacatgggtttaaagcagtctgttattagaaaaattaaattcgattacattaaatgaatttaccaaacactagttaacgcaagaaaaaattagcacctatgtctacattctattactttgggcattgaatagtaactataaatgcagaataaaaatatctatggattgaatgggaaccaactaattgaacatgaagccaaggaaatgatttctttatgagtgttggctgcagaagattaaagtacttttgcagacggaatcgctcttttcttaaattactcttgaaattcctcagaggagaaaaatactaacaataatttttggtyatgtctatccttttgctcaacattttaaaggaagtggtcttaaatctccyacatatctacatcacaataacaacctctattcacaaacygattcctattaaatacatttccatttacattacagagaattatgagactccttatttctagctgaacatcatttgttattttcaactcgacattttgaattatagaagcacctaacataagtactttttcagcatatattctaaccatggactagtttgcaattttctaagagctttcaacaaatgttactcttcgactaatttaaaagtatggatgttaaaaagcattcaaaaagtccatacaagcctagtttgtaaataactatggaattgatttcccaaagaaaatacaaacttttccccataagaattcatactttaagaaaaacttacttccatttaaatttactgtatgaagtttggctcatgaaggctttttcctaaataatagttaatcgtaagcaagtaaaattcacttttaatttgcaaataagcttacttgaaaatttggctaaaattttacacggttctaagatagtctaagatctactctcatgaaattaatgtctttatatttcttgtaaatattcatttcttataaatgtccttcagtgaattagaatggagatttcagtgaatgcgccctttcagtagatgtcgtcttttactaaaatgtagaattctatagttgtcttgttcattccttaacatgagacatattttatgtagtttcttttgttgaacacagtgcttataaaagaaaaagcatttttaatgatgctaacaataattaagggaaggtggtgggccaagatatttcaagtacttctgaagactgatatattggatatattattttatgctttgcataatacattcatataaaatataatgattttaactgaagtactgatagccaaaactaattttattagataaaggttaacatagtgtctggaacattgtatgctttcaaaaactatttggtgaatagataattgagaaaggaataataataaaaacagctaaatgaagcttatatttaaataaactaatgtaagcagggtattctacaactccatttgaactttaagcactccctaaggctgtaaacatccacaaggcttgcatgtttttgaaattactaaatttctgtagttttttactatcttactaagctgaattctgggagtaacttttctgagttttataacttgtgctaaattcttaagagcaaatgtgagaaaagttaggggaaaaagctgtttctggggaaaattcagcttagtcttatattgatagggcaaattttatttctttaacagctgggctgttcttccctaacaagacctgccagaacccatagctcacacttagaatcacatcctttgtttgacatcgtttgkgggtttgtggtttggtgattttcccataatggccttcccaggcagagagcatcatcttaaacttgggaagactctaggtggctggctcaagcaatagaaaatacctagtcttaaagcccaggacagttgaggcgaatataatttgtaaaaaaagttgtggttttcacagatgttcagtgaaagaaactgactgttctctgaattgttttttgtgggccattaaaaatggtcacacagggctggccatggcattttggcacagtcaccagcagycaagtggtgtataatttcagaggtactaaaaggcatcgggtcacccatcccagtcatgtccccccaccccccaccaaacaccatcaaaataataacatacatagatgaaacagcccactaaaccagtagtacctcaattcagccattagagctatcattatgaagtggcccacacatatatttggctttttctcacacartatttttaaaataaaaataaaaaatggctccttagaatccagactgaaaaaaaaatgcgagaattgcgatgttgattctaaattcccacatggcaaagaaaaaaaaattgactggagttgagttgagactggagtctgaacactttttaatccctgtttgtataactctggagactaattctttgtcttgccagccattcataatttagtataaatgcattcagaggttttttcccaatgggaacaaaatttgattgagatgtaaagagaggaagaattgtggagatgtcaaacatgtgaccagagctatkaacacacttgatacccttgaacttaaacttacccaactcaaaatatctggccttctgcgatcttacctttctacatttataataagatttgcaaggttgttggaaatctctatcttaactttatatatacatgcctctttctttctttttctttcctttcctttccctttctttctttctctttccttccttccttcctttctctctctcttttcttcctttcctttcctttccttccttccttcctttctttctttctttctttctttctttctttctttctttctttctttyctttctttctctctcactctctctctctttctttcttatttttggtgctaaaacccaaaacaaatcttttatttaaaaataagattttttttttttttggccaggtgtgatggctcatgcctgtaattccagyactttgggaggccgaggtgggtagatcacctaaggtcaggagttcgagactggcctggccaacatagtgaaaccccatctttactaaaaatacaaaaattagctggatgtggtggtgggcaactgtagtcccagctacttgggagtctgaggcaggagaatcacttgaacccaggaggctgaggttacagtgagatgagattgcgccactgcactccagcctgggtgacagagcaagagtccatctcaaaaaaaaaattgtttaagtaaaattttattttctttcttttttttttttttttttttttttgagatggagccttgctctctcaccctggctggagtgcagtggtgtgatcttggctcactgaaacctccatctcccaggttcaggtgattctcctgcctcagcttcccaagcagctaggattacaggcatccaccatcacacctggctaatttttatatttttagcagagacaaggtttcaccatgttggccaggttggtcttgaactcctggcctcaagtgattcacctacatcagcctcccaaagtgctgggattacaggcatgagccactgcgcctggccaaagtaatattttcaataagaaaaataacagtgatgtcaggatgctagaaaatgcaaaataaatttgttataattcctgattctggtgatraaatactaaatttttgcagtattattctgaaagaataatcacgtatttaaagtacaaatctttagacttcaaagtgcatccatggtggcagattttgtttaacttttatatagcatcttttattgcaaccaaaaatagctgaccattattgtggaataattcagcgtaaagctttttttttttctttttttgagacrgagtctcattctgtcacccaggctggagtgcaatggcatgatctcrgctcactgcaacttctatctccagggttcaagcgattcttgtgtctcagcctcccaagaagctgggactacaggcatgagccaccatgacagttaatttttcatatttttaatagagacagggtttcaccatgtttgccagcctggtctcgaactcctgacctcaagtgatccacccacctcggcttcccaaagtgctgggattacagtcatgagccaccgatccccgcccagcataaagctgtttttagatcaccttctataatttaccattgttcttaaattaatggttaagaaacaatatgataatcagtttgtggtggccagttttacattttataagggattttacactgacgatatagggaaatttattgtcatcaaagtcaaatcccaacaatcataaaaagacatgaattagattatataatttcaatgaaaggaccaccttagcaaacatctaaccccttgttactcaggtatcattcacgggccagcagaattggtattatctgtgtttgtcagaaatgcaaactccctagttttttgttggacctccagaaacagaatctgcattttagccagacccmagatgatgtgtgtggcacattaaagattgagaagcctgatcctctcccaattctcacccaatgaaaaaatatgttacatcctctatccactgcttggttaaactgaggttctccataaaaatacttgttatctatatgctatgcaatcatctgtgagtttgagttttgaatatgtgcattgattctctctcacagtgcagcctgggagctctattccaccttacaacaccgaggtgactgagaccaccattgtgatcacatggacgcctgctccaagaattggttttaaggtaaactgcagatgttcctaatctctgtgatacagccctgaagctgtccttgtgkttcccatgtagtggaaacagggtgctcaggagtcaggagacctgggttttgtcacctgcttctgtccatacatctttgactacattgtcagggcctaacagtccttccctgcctacctcactgaattgttggaagggtagatggaggctgcgaaagtgttttgcaaaggataaaacattagcacgaagctgctgcttattgttatcttattttctctatyctttcctgcagggaattacatttcaaaaaaacatgggaaaactttatttgatgtgttgttctaaatgagtgtgaacaagttcacaaaagccagtttagggagaccagttaaactcagagtcacttaaaaatcgcattttcatccaatcagtttcatctccaactgttcaaagcactgagggtgaatctcttaatagaagttaagattaaggtttccctgtggatatctggattcatcttctttaaagtaatgatattagggaagcggtgaatacaaatgaatatgtttaaaagaattccattctttggcatttagtgtgaagagagaaatatttgttatygctggaaatcatgactcaatccccttgatygtttaaaaaaatacaccaaagataaagtttgtaaatggccatatttatgattatgctactcaaatatagaagaactttctgaagagtgccagtataccttttaattcccttaataatgtcatgctgactttcagaagccttatgatgtgtgaaggatctctctagagttgaacactattggataacagtgttacctaagtttttgaaatagaatcttaaaaggattttaaattatgggcatagttattctaattcttctcttgtaatgtatcatcctgcagttgaagctatgtacatatctcttcaaaaggtgtgtttttgcaatacagttgctacaggggctggtgcctttaaatggcaactaaaaggttaattgaatgtgaataactcgttaaagggagagctcagacattccttctagcacacacacagaaaaatagaaatgaactaccatgtgacccacagtccctgtatacgtctggtttgtaacaagagattctttatcaagcaaaacagtatgtaatgacatttctctggaaccttccatyacaagccaccttaaygcagtttggaagatacctcccccacctgggggaatttccagctaaagtatataaaagagtccccaaatcatttcccaataaaagtacactgtgcagtttctgaagagtttacactatttaaagcataatcatagcctcacagcagtaacagkcctctggaaatatttgtccttggtgtttactttgcattccttcctctagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacacgtaagaagaattttttcccttttctattagtttttaaaactgttctacttttcgaaaaaagctagtgtcaatatcactttttacttatgagaatggcacaggggagatatcttatccttacttatattattaatgctattcctgaatttggagtagcaggttcaattcatgctttatattttatggcatcagaaatgttctttccatgtcaagaatatttatgaactggcaagatgaaaataatttcaatagtattgcaaaatcattaatcataaaraagtctttgtcagagaattactgctgtccatcatattttcataatgtaacctatatttttatgggagggagggagggagggaagaagcatggaagagagggaggtagggaaggaggaaagattacacaggtcaagagctttgtgtcagctttgacttttaaaatgttctttctgcatagcattgtctccaccaacaaacttgcatctggaggcaaaccctgacactggagtgctcacagtctcctgggagaggagcaccaccccaggtaagtttgggatggatcagagggcaagtatacaccataccttcccaagacaaagattttagaaactgtgtttctttcagagaaagaagggattcaaattacaaatgcttagctctccataaaaactatagcagtacatgatgtacatcatggagcagcctgcaggatgctttaatgcacgttgacttcaatcacaggaagcagaacaaccttacactagtctagggggacaagacagatcctcacacagctgtagggctgaagaaaagcactgtggaaggtggcttttgctgagtgcattaaaaattgccaaacaaatggttgaagtcatattacgtaatttcccttttgtgagttgttacagagcctaagtttattattccctgaagttttatgaatgttttgtcatgggttgcaccacaaatatttaagggtgatgaaaggcagaaataccttcattttacagaataagaaaactgagacttagaaaaaattggcctactcatagtcacacattttaaatgttacaaaactgggattgtaacttaagtttgtagactccttctcacacccaatgtcacatatttggaatgtaatttttttttaattatattctatgcaaactgaaaattctgattaaggggtttcctgaccatttttagagctttaaatgaagcatttgtctaaattccttgttcacatatatttgaaaattatttataaaatgctaaaatgtataaagatagttgttaacaatattcaaacagcatgaygtactatagcaataacaggaaattttagatacccattacttttgccaaaaccacatggaagtctcaacaaacctatggagaaaaatcttaaacaaaaataaaagttccaattaatgttgattgcattcttacctcatatacttgttaatttaagggatatgtttaggttattatttagctatttctaattttactgtaaaattcttgtgaaatttttgtttaaaaaaaagtattatatagttcttatctttgccggggcacagagctaaggctatcatctctaaatctgattaatgtatgcaaacacacagaatgaaactagctcagaatatctcttttaatctccctctgaagtagagtgattttggtaaagttttcattatctgcggaaacattgtttaagccaaagctatacaatttccagctgagttgctctgaatttgaaactttaagttgacaatcttcgtgcttgttagcagcaggatcattaatatctcgtctcaatggcccagcccacayatatggatgaycactagcaagtgtaatgatctcaatatttatttctcattcagttgggtttccttgtatttgccacattagtgtttaccctgttcctaatggcaaaatattctgtcatctccttgccttttataaagtttaatatactttctcattttaatctgtccccacagatctctagtcatcactgtttttatttgaatgtctctcatccctctcaactcttttactgcccaatttctgtgattcctgaagacttcaacaatcaayactctctttttttgtttgttttgtttttttttttgagacagagtctcactctgtcacccaggcttggagtgcagtggcgccatctcaactcactgcaacctccgtctcctgggctcragcgattctcgtgcctcagcctccccaagtagctgggactacagacatgcgccaccaagcccagctattttttagatttttagtagagacagggttttaccgtgttggccaggctggtctcgaactcccaacctcaggtgatctgcctgcctcaacctcccaatcaatactctttctagaataagtatcascacttttgttyctcaccttttctcctttcttggttctcttcctataaatcccatagtttcagaccttttaaattaggagagctctctggggaatgtgcttaaggtggagarcgattctatactaggcaggtagaaaggaatattcctcagctgtcttcaaatgattcattaaggaaaagcagggtacagtgataggaccatgagatttggaaacaaagaaagctttggggaatcactcccctggttcaagatttcctttaaagtgaggatcttggcggaggttgaagtgagccaagatcacaccgctgcactccagcctgggtgatagagggagactgtctcaaaaaataaaaataaaaaaataaagtgaggatcttagtactgcctgaaaggattgttgcaagcattgaataacagtgacagtggagtcctcagtaaatgccaagtcctgcattccgccctgtgaatccatcattggagtctagttaaatatgctctggctcacagatyctctgtgcaataacttcccttttcttttttctccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccaggtaatagaaaaataagctgctatcctgagagtgacacttccaataagagtggggattagcatcttaatccccagatgcttaagggtgtcaactatatttgggatttaattccgatctcccagctgcactttcyaaaaccaagaagtcaaagcagcgatttggacaaatgcttgctgttaacactgctttactgtctgtgcttcactgggatgctgtgtgttgcagcgagtatgtaatggagtggcagccatggctttaactctgtattgtctgctcacatggaagtatgactaaaacactgtcacgtgtctgtactcagtactgataggctcaaagtaatatggtaaatgcatcccatcagtacatttctgcccgattttacaatccatatcaatttccaacagctgcctataaaatagttttgtccctgtatgtgagcactgaaacagcatttggttgacacatctagtttttcatcttgcagtttcaaatccttctttttgaaaattggattttaaaaaaaagaagtaaaagtcacaccttcagggtgttctttcttgtggcttgaaagacaacattgcaaaggcctgtctaaggataggcttgtttgtccattgggttataacataatgaaagcattggacagatcgtgtccccctttggactcttcagtagaatgcttttactaacgctaattacatgttttgattatgaatgaactaaaatagtggcaatggccttaaccttaggcctgtctttcctcagcctgaatgtgcttttgaatggcacatttcacaccatacattcataatgcattagcgttatggccatgatgttgtcatgagttttgtatgggagaaaaaaaatcaatttatcacccatttattattttttaaccttcttcatgcaagcttattttctactaaaacagttttggaattattaaaagcattgctgatacttacttcagatattatgtctaggctctaagaatggtttygacatcctaaacagccatatgatttttaggaatctgaacagttcaaattgtaccctttaaggatgttttcaaaatgtaaaawatatatatatatatatatattccctaaaagaatattcctgtttattcttctagggaagcaaactgttcatgatgcttaggaagtcttttcagagaatttaaaacagattgcatattaccatcattgctttaacattccaccaattttactactagtaacctgatatacactgctttattttttcctctttttttccctctrttttccttttgcctycccctccctttgctttgtaactcaatagaggtgccccaactcactgacctaagctttgttgatataacygattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacgggtgaattttgaaaacttctgcgtttgagacatagatggtgttgcatgctgccaccagttactccggttaaatatggatgtttcatgggggaagtcagcaattggccaaagattcagatagggtggattggggggataaggaatcaaatgcatctgctaaactgattggagaaaaacacatgcaagtattcttcagtacactctcatttaaaccacaagtagatataaagctagagaaatacagatgtctgctctgttaaatataaaatagcaaatgttcattcaatttgaagacctagaatttttcktcttaaataccaaacacgaataccaaattgcgtaagtaccaattaattataagaaatatatcaccaaaatgtaccatcatgmtcttccttctaccctttgataaactctaccatgctccttctttgtagctaaaaacccatcaaaatttagggtagagtggatgggcattgttttgaggtaggagaaaagtaaacttgggagcattctaggttttgttgctgtcactaggtaaagaaacacctctttaaccacagtctggggacaagcatgcaacattttaaaggttctctgctgtgcatgggaaaagaaacatgctgagaaccaatttgcatgaacatgttcacttgtaagtagaattcactgaatggaactgtagctctagatatctcacatggggggaagtttaggaccctcttgtctttttgtctgtgtgcatgtatttctttgtaaagtactgctatgtttctctttgctgtgtggcaacttaagcctcttcggcctgggataaaataatctgcagtggtattaataatgtacataaagtcaacatatttgaaagtagattaaaattttttttaaatatatcaatgatggcaaaaaggttaaagggggcctaacagtactgtgtgtagtgttttgtttttaacagtagtacactataacttaaaatagacttagattagactgtttgcatgattatgattctgtttcctttatgcatgaaatattgrttttacctttccagctacttcgttagctttaattttaaaattacattaactgagtcttccttcttgttcgaaaccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaagtaagcagttgaatgtatctgttccataaatattaacctagagcatagcaaatgaattctaaattctcaagtaggaggagctaagagcaagagagctgcaaccaagctacaaactaaactctgaattsaatgcmcagctccattaattttgaaagatgtaatgtttgttgctatcttaatatacttttgatatctacagctttwaaaaaatcatagtggaaaaacacctgcaggaaagttccatgacttcaaacaaattctgcttctaaataagcacgtaaaaataagtgaatatcaagagaaattatatgactaaatctaaatctttagagaaaaaaatgagaactgaaaatagtgtcaccatatgtgctttattctcatttttataaaaaaagtgtcagcagttgattgatttaggatttgaatacttagaaaagtgactgattgtttggtctagattagaatgttgttgtgaagagagtcagaagtttaatttgtacttcaaaaagaatctgttagaaggatttctcagaagactgagagcttagaaaaaaaactgacattaaataaataacaacaatttatggaaattgtctctttctagtcccaaccattatagaatagacatcttttgttaaagaataaaacagtaggctgcaagatggtgctgtgtttcacataaacagtgctttttattattttcactgtaatagtcaaatatataacaacagcaaaagattctacataagggaaaaatagcttacatttaggtacattaccaagtattagtctgaaaacatctacctttcaaacataatttagataatgaaacacaaagaagagcagctcagcgtgaccataatcttggtttcttactttgtggctgagggcaagaatatctttatattggcatatccaccaccccagggctgttgcttctgtmcaccctggaatcactaattacagcatcacccagtatacaagcccctgcatcacaatgtctgtcccttagccgtagacctgtcacatgytaatcatgtgttctaagaccttattataatcctaatgctacagatgacctcarggtagcccctctccctcctagcaaagtcattattatcctcttttaaagatgaagcaaaccagtgcagtggctctcgcctgtataatcccagcactttgggaggctgaggtgggccaattgcttgagcccaggagttcgagaccagcctgggcaacacagtgagaccaagtctctacaaaaaatacaaaaattagccgggcatggtggtgcacacctgtggtctcagctatgtaggaagttgaggtaggaggatcacctgagcctggggaggttgaggctgcagcaagccatgatcgtgccactgcactccagcctgggtgacagagtgagaccctgtctcaaaaaaataaacaaacaaataaacatgaagccgtcgaggtccccagcagttaagtaaattgccactggccagctagtatggtggaaatggaatccaggcatctggtcctccattctggcacttttccaaacttttgtagggggctttatagaaacgctgaagggcaaatggtgtgcaggggaatgagggtttagtgagtaggagttccaaatttagaaacctcactctctgtatcttttagatatacaaatatttaccatatattacagttgcctctagtgttcagtacagtaacatgctgcacaggctcatagcctaggagcaataggctagaccacatagcttatagcttaggtgtgtcaaaggctctaccatctaggttttttgttttgttttgttttgttttgtttttgagacggagtctccctctgttgcccaggatggagtgcagtggcacgatctgggctcactgcaacctccaccaccaaggctcaagtgattctcctgcctcagcctcccgagtagctgggattacaggcgtgagccaccacgcccagctaatttttttgtatttttagtagacgaggggtttcaccatgttggccaggctggtttcaaactcctgacctcaagtgatccaccctcctcggcctcccaaagtgctgggattacaagcccatctaggtttgtgtaggtacactctatgatgcttacacaataaaatcaccaaatcacacacttatcaaaatgtatctccaccattaagctatgcctgactgtgtatcaaaatggaagaagaagctgggcacagtggctcacgcctgtaatcccagcactttgagaggccaaggcgggtggatcacaaggtcaggatttccagtccaagcctggtyaacacggtgaagccccgtctctattaaaaatacaaaaattagccaggcatggtggcaggcacctgtaatcccagctactcaggagtctgaggcaggagaatcacttgaacccaggaggcagaggtttcagtgagccaagatcacaccactgcactccggcctgggcaacagagtaaaacctcgtcaaaaagaaaaaataataaaaataaaaaaaaatggaacaagatactcagggatgtatatttaattttttaaaaaatattctgctctcattttaatatggcagaaccgattgctttctaagtgtggcttttttccagtaaaggttaattattaagaccactagtcctgscctgggtcaatcccagtatgatcctgggcaagtaaattaaagaagataacttctctgtgcctcagtttttttttgttttgttttttgttttttcatttacaaaatggagataattgtagtaaatcaaatttttagaggtgataggtttgttcatttcttgaatgcggtgatggtctcccaagtcacacatatgtaaaaacccatcactttaaagatatgcagtacgttgtatgacaagaaattgcttttaaaaggagcaaactaccttccagggttgttgtgaggcataaatggcaatccacagcaccacagcaaggattatcatgtgccctccagagacatactctcaggtggatgcgagaaatatccagctgttgcagcaacttcatcccactcgaaatccagctgagtcacactcacaggtggaatggagggcttcgagaggccatggggcaaggtgacccttccttatcatctaattacagaccttctcaaggtctgttcactgaacacttcgctgtagtgttcacttaggtgtaagtaggctataggactggacatttggatatttcatcagttcaaatagtcctgggcgtgctttagtttctcatgcttttgagcagagttttaaaataagcccsatttgcccctacagatctcctgcctggtacagaatatgtagtgagtgtctccagtgtctacgaacaacatgagagcacacctcttagaggaagacagaaaacaggtgagtggtgttggcagtatgactatccagtagcttttgcctatcaattctgtataacaaatgaaatgctacttctaaaaatacatctccattttttgttgtcatggtgtgtgtacctttgtcatcacagtatgattttatcgctggtctcaaaaactaaaagataccttactcaacartcacctagactttcagtcactaacaaattaagaaatttgttgtctgtccttttaaaaaacattttctaagaagatctttgttatttagatttagcagacattccttttcattaggcagctctgtctaatggctgacccaacactcattgtcatctatttgtcttcctttactaagccagcaagtttacattttctttttacttaataaaatatgcatttactagaaggaagttgaattgaatctcataaatattacatacttaaatatgaatgcttttaattttttctttcaaaaggtacactttagtgtattcattaatttatttatagtccacttgcttccaaaaaggacttatgatatcttagtttggtttcttattgaaaagaactagtaaatgctgtaactgaaacagaaatttgctggaagtcccagagactaagtgatttgaatttgcaacaaactctgaatttttgtgcatttttgaaaaatgcatttttcaaaactgtcaattcacgaggaattatcagcattgtaatttgtctgggataatgtctttagtttcagaaagttttgtgtttggcatcattaccactctgttgacatataaatttcctcttgagcttaggaggcttctctgagagtcaaacatttactttgagagtgggcagatcttgctttacttggaaggatacacttacaggatagaaacacagaatacttgaacactgaagaatttgaaaatgtcaattctcagaagatcttgaacacttatctccaaatgtgacacagaaacttactgtaataacccctaaaatctgcttgaattacttagcacaagaaaaaaatgaatgcttgagctggctattttgaattgagtcaatttaagattttaaaattcatatgtagcttagaatcagtacatcttactctttggtttatggcaaatcatggtattgatgagacaggaacgaaatgttggatgtacgttaatttcccctacaccttcctcacttcctaaactggtggtgtcttttcttttttttttctcttcctccccygggtgggaaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacaggtaacttttcttgtctgcaaagaaactcagaagactttcctacccagttggtagattctgtaaagtagcttgctgttgtctgtcatcagctctcaaaaaaaaaaaaaaaaaaaaaaaaatagatcattgtcatggtacatggagagggaagtgagaaaatgtggagaaacatcttccttagaatatggtaaagaagcccgggcgtggtggcagtaaagaagataatttttttcctctcaagaaatttctcacctgatttgggtatttatgcatttctaataacacaagttttgttgaaaatgtaraaaattggccggacggggtggctcacgtcagtaatctcagcactttgggaggccgaaatgggcagatcacttgaggtcagaagttcaagaccagcctggccaacatrgtgaaaccccatctctactaaatatacaaaaattagcaaggtgtggtggcatgcacctgtaatcccagctactggggaggctgaggcaggagaatctttgaacctgggaggcgaaggttgcagtgagctgagatcaggccattgcactccaacctgggtgacagagcaagaccctgtctcaaaaaaaaaaaaaaaaaaagggccaggcgcaatggctcacgcttgtaatcccagcactttgggaggccaaggcgggtggatcacgaggtcaagagatcgagaccatcctggccaacatgatgaaacctcgtctctactaaaaatacaaaaattagctgggcgtggtggcatgcacctgtagtcccagctactcaggaggctgaggcaggagaattgcttgaacccaggaggcggaggttgcagtaagccaagattgtgtcactgcactccagcctggtgacagagggagactctgtctcaaaaaaaaaaaaaaaaaaggtggaaaactgaacactgtttcaaagtacctttaaaaatataattttagggtaatagtgtcattgttcttagcagatagaggctgaagtacttacgggaacagtagcatcatgttatctgtattttagtctcaagtcgtcaagccagagacaaatacctaagggaagggtatataggtgttcattgtattacttttttttttttttttcttcctgaaatggagtcttgctctgtcacccaggctggagtgcaatggtgggatcttggctcactgcaacctctgcctcccaggctcgagcaattctcttgcctcagcctcccaagtagctgggactacaggtgcccgccaccacgcccggctaatttttgtatttttagtagagatgggattttaccatgttggccaggctggttttgaactcctgacctcaaatgatccacccgccttggcctcccaaagtgctgggattacaggcgtgagccaccacgcccggccttgtatcacttttttttttttttttttttttaacttttctgtagttttgaaatttttccaaataaaatgttgagggaaaaaaactcttccccaaatttgaaataatcattttatcacaatttgaatgggctctgtaaccccttatcttgaattcgtcataatataaaattctgctaattacacrtagtatttacatgattgtatggaagaatcattaagacaattatctggaaaatgaacaaacagtaaatctgaatattgtttgaaaattacggatgtgaaaagtttcccttttttttctagtttctgatgttccgagggacctggaagttgttgctgcgacccccaccagcctactgatcagctgggatgctcctgctgtcacagtgagatattacaggatcacttacggagaracaggtacagcagtaaaatgctattttacactctgattaaatcagattctgttgtggataacctgaaagcccaacagtgaacaaagaattaaagaaactttggcaagtccattcaacggagcccttgttttttccaagaaaatacgtaagatatagatgatataatttgttctaaaacccaaataaaaagttgtttatatactacaactagagggggaacggcagagctgaggaaataaaaggattgtaaattcacaaacatattatcagtggtggaaataagtgatttttattttttcttctctttacttttctgtattttccaaattttatttaaaaggaatgtattctgttaaaagttttaaaaaggacacaatgcatgcaatcctgggttgagggcttaccttctcccacttctaatgctactctactactcagtgacattttaaagctgaaatgttaaaacagcgctaactgtaattttctctcaatgtttatacacttaccaaggtttgctacatgcataaatacccctttctgttcaagatagcgctctttaaaagggaataagcaagaagatgtgatttacatgctgctataaatgtggtaattcaattaatcagtaatacccaagtagctctaaacccctcacactctgaactaaccctttttcatacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacaggtacaaacttctactctggggtgacaccagcttttacttattcagatactgttttgcaatgttctcccaaggtatttttctaattgtagaatagattttcctttttaatgagcaacaacctgcagctagcacctgcrgcgaacagagttttgagccagataaagaaggaagcaccccaagggcaggaagttcagtcagttttgtcgatatattccgcatgtctgcaatacgacaggcatagagagtgttcagtaagtatttgtgggaaaagaatggatgagttgataaagtaggaagagacacctgcttgtggaatgtagcttctttgtgaatgaagcaaccatctcaaaaataggaaatggtattgagatgcctgccccatccctctaaaagctctctctgtattctttcgagaagaaatacctttctcatgtaagmgatcattcgaatatgtaccagacctagagaggaggacttgtccaatcttgtctccaaggactggggcttcactggtttctccctgcttttatttgtagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccaggtaagaatcatctgcatctcggccaggtgcggtggctcactcctataatcccagaactttgggaggctgatgcgggcagatcacttgaggttaggagttcgagaccagcctggccaatatggcgaaaccccgtctgtactaaaaaatacaaaaaaattagctgggcatggtggcttgtgcctgtaatcccagctactcaggaggctgaggcaggagaatggcttgaagtctggaggcagaggttgcagtgagccaagatagccccactgcactccagcctgggtgacagagtgagagactccatctcagggaaaaaaaaaaaaaaagagtaatctgcatctcatatacaacaggatagatggggtaggaccacctaatattcttttttatataaatggctaccttgttgtgagtactatgtatttttttgtcctatgtcatcattgtccccattcatgagttcagggctcaagatcattatcaacccttttcacagtagaagtcttaagtgcatttctgtttttacatggatagttctatttagtgatatggacatcttaaattactagattcacccttctggttttgtttatcattcacactaagaagagataaatggcctaactgactttttcagctctttttagctatgttgtctttgtttttaaatagaatacttgtgaaattaggatcttaaggcaatttattagagtcaagttaattttcattttttctgagagcagtatcactaattgttgggggcatcatattaagttttagatcttatccttgagtgtgacttcactcccatatggtaatttgtattagcaatgaacaggtttgtccaagaggaaatcaaagtctgactctccatatttttgttacaattctgcaaataaaaattctaggccaccatatgtttactaccaaactctagacgccacttgaggactttatagtggatgacgtggatgttgcatttgcttttcactccctttgcagatcaaacagaaatgactattgaaggcttgcagcccacagtggagtatgtggttagtgtctatgctcagaatccaagcggagagagtcagcctctggttcagactgcagtaaccagtacgtaaccactkcttggtttccattttcaaagtcaaattttgttcttgggtgtctgaatgcccacgacatgtcttttgcaattacacatagggaaagtgaacttgttggttagtttatgtcttgagctgagccctttacgaacatcttttttccttctcagtgccaagcgaggaatttacagagaaagaagttgtgaaaccaccatagttagttgctgtgctttgaatttcttttgctcaaatggcctcagcgaaatcttatttgcctatagcawatctacaaaaaattttcctagaccgtcttttctacaactggatggtaaagttgattgaagtgtgcctcatgtagctttatgtttggggcatttgaagggctatggctggaccagagtgtaatataaatgcttaatagagaggggaaaagaagagtgtaagaaccattatagggctgggctcacgcctgtaatcccagcattttgggaggctgaggcaggcggatcacgaggtcaggagttcgagaccagcctgaccaacatggtgaaaccccatctctactaaaaatacaaaaattagccagtcgcggtggcacgtgcctgtaatcccagctactcaggaggctgaggcagaagaatcacttggacccaggaggcagaagttgcagtgagccaagatcatgcctctgcaccccagcctaggtgatagagtgagactccatctcaaaamaaaacaaaacaaaacaattataacaatttgaatctgacattgcaaatcagctttaccacttccaaggtatagaaaatccaggtctatgagactaacatcacattgtaaaaatcaaatcgtggtagaatayctttaaattaatataaatacatccccattgtggggacattttgcagggtatctgcttatctcacatacacctatgttttaataagtgatgcaacattgcatattttctaaaccaagaaaaattaagcaagtgtttaagtgatttttccttttgatagtgggttaattggacttcatcaaagaaaatggtatctgcaaaactgctttgcatgttataaaaatgcttatttcacaacttgcttttcacataacctcttaccattaatttgcctaacagacattgatcgccctaaaggactggcattcactgatgtggatgtcgattccatcaaaattgcttgggaaagcccacaggggcaagtttccaggtacagggtgacctactckagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacaggtatatggttaattgcaccaccaggtgcccatgggagcagcggctttatgccctactgaatgaattatgcttcactgggctattgattcccgtgtaagggtgaaaaagaattattaggaaagatcctctttaaagaggaatrgtaagaaacaataaaacttaggtgatatttaaggaaacaagtcwgattaaaagaaattttggagtatcctggcttatacacaagaccataaagcaagacatttgaagaggatactaaagttgtggattatttcctaagctctgactccctgtgattaccctcactatgtataaagaaaagaagtttggcattacagagcttacttataaaaaggaacccaaactcgggcatttcatagcagcatgattctgagcacacgtgggtaagacctttcttctctggttagatatcatatgctggtgtataattagcttaaatgattgtgatttagacacctaggaaataatcaatagggcaattgctttccataatactttatcttcttgtgctttatttctgaagcagagtagaatgctaaagatgtatcctagtgacagcataaaccctagaggtgacagtctgtattattgcttttcgcttctcttttctgcttctgttgggagccagttttcttcttacgccgcattacagagagaacgtcaaatttagcagccatatctgccatagggtccaaataaagagacaataaaaacattattctctcttttttggatggaatactgcgtgaaatggttatccatacaaagatactttatgtagaatagaaaaaggaggccgggtgcagtggctcacacatgtaatcctagtgctttgggaggctaagccgggagcactgattgaggccaggagttcatgatcagcctgggcaatgaagtgagaccccgtctctacaaaaaaatatgaaaaaattagcgaggtgtggtgacacatgcctgtagtcccagctactcaagaggctgaggtagaggatcacttgagcctacgagttcaaggctgcagtgagctatgataactccactgcactgcygcctggatgacacagagagaccgtttctaaattaattaattaacaattttaagaaagaaaaagggccattgcttatttttccatacaaaagtaaaataaatcataatggccaataagccaatgtaacttttttttttaagggaaagcaaaacttgtaaaacctaaaatctcttagagttttggcatttacccaaatgttttcagtgattctgagaattggtggatataaaacacatttctcagcaaacactttcttcattttgcatcccttactgtactttcttgtactgaatctttgcttgaccagggaacccacctagcccaacaagaacaatccattctacttcttggaactcactttattttccttttcccccatttcctataagataacctctaaccaatgacaatctcgacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtaagacatgaccgttgttcrttggaataaagatggagatcatctctaacacagtttctaaggtggtgaaaatataatatcataataaatctaactgttcttttcctctgcatcaaataatcttattgtaattttatatcaacggaattcctttatgttgacctaagttttccagatgactattgggacagaattttataaayagctttggattttgtgcagctcttttagatgtattgtgcttattttaaaaggttgtggggggcaatttacatatccattggttgaatgcataaatcgacttagttatgcattttctgagctctgttaccttggtaaagaatattttacagtttgtaccagtctaccttgagcctaccctcattaaaacattttaaaatccttccagacatacatgcagaaaactgctaggaacctaggggactgatgtacctcttaacataaggccaatttcaggggaaactacagaaagagggttcagagacaaaatggaacattctctttgcctctctatgataaggaaaaaattatgatttacacctgtcagatcataaaaaagaaaaatacgctaatacccacttttctcattttttttaccagcttagtttaagtatataatctatggcttacttaagcttaaccgctaagagcattttaaaattgataaatacatttatcacctgcactgtaggaatgaaattaatctaggaattttcaaggttgtgggttttgctggtttgtttattttttattttctaaccattgcatttacctaatgctgtagtgaaactccttgggtttcagttgaggacgttgctaaagctcaccatgcccttatttctctaggtggccaccaaatatgaagtgagtgtctatgctcttaaggacactttgacaagcagaccagctcagggwgttgtcaccactctggagagtaagtaacaaaatgtcttcatatggacaaaccttctgtatagacaaaaattaaagaatggtaaatcagtggggttcagtggctcatgtctaaaatccaagcactttgggaagctgaggcgggagcgtcacttgaggccaggagtttgagacctacccgggcaaatagcaaggccctgtctcttaaaaaaaataaaataaataaaataaataattttttagatttatatgttaacagtggaatgagtcctaatttgaaaatcaatttgattgcctttttgacgcatgactgtcatcttttatactccttcagaaaggggtctactgacccataaaatggaatcacttcataagcttataatgttgatattatggactatgactgacatctagtttatgctctacttgttagaatttgttttcatagagctaagcttggggagaccactggcttctgctatatcttaacaatgcatattaggccattcttgcattactataaagaaataccggagactgggtaatttctaaagaaaagaggcttaattggcccacaggccagcaggctttacaggaagcatggtgctggtatcttcttggcttctagggaggccttgggaagcttactcatggtggaaggccaagggggagcaggcacatcacatggctgtggcaaaagcaagaccgagagagagagagagttggggggggaggaccttatacatttaaatgacccagtctcttgagaactcactgtcataaagagggcaccaagccacaagggatctgcccccatgatccaaacacctctcaccaggccccacctccagcattggagattacaactcaacagagatttggacagggacaaatatccaaattatatcacagcacagtaaccattggaccaaatcaggcttagattctagtcttctgttatatcaataccttgatgtatgccttttcaaaagtcaggtaaagtgtcaaagttttatcatttataaaagagggatggcattgtacctgttgagagaaaatacaaaatacttgccgtaatattagacacacacacacacacacacacacactctcwctctctctyacacwcacatacacacacacacacaaaattgttagctggccatgttattgtaactcctaccacacatatttttacattataatacattaataattttaatatttattgaagtatttgtagatactataaagccagccctgggaaccactggtagtatctataaagcttttcagctcttcaaaataaaatgtctgagaggtagawattttcctattttctaattacagttgacctttctctctgaatrccaaaggagrtaatctacacattactagttatatatttcttgaaatggatgaatttgatatataccaaggaaacgttttaaaataccaaaactttacatrgatgagccaagcaggcactaatctctagctatgctcctgtgcagatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtcagggaactcattgcactaaccacatttgttaacaaatacccacaatgtaaacgggcttattaactgttctacgactgacactgataaaatttattttcagtgttatcatcataacccagttttagaacgttattttcatgctatgatcagaaatagttttgtcctttgaatgcctgattttgtgtaatatttgtcatggaaattgcgtaagtgtcaatcaacaagtttgatcttccatcattgtgccctttcttatttaaaaaattgtaacataaggtttaaaactaaaagaaataaaaaacagtgatgtatagatcttagcattaaaaagcatagttaatataaaagtaaacaataccacttaataaaggccaaaattgtaaccgaagaatattcaatatctgaggtcttttttagctttttaaaattgtgattccaaggctcaactattgaccatctgattacggtaaagagaaaacctcaataagtggctgacccccattctgcaagagggcctcttccaacatagcatttttgcattccagaatttactttaccagtgtccttgtctgtatcagtgattcactttcgagatatgtttcttgttaacagttaacatccatagcatgctctmctttactgttcaaatgtggaccactttggtagtctatataaatatgggatgatagaagaacccagaaaaattgcaggctagcttgagaattctcctagtaaaaagcaagaactgttaaaaatcatctcttctcaaatcccaggtttacaaccaggcactgactacaagatctacctgtacaccttgaatgacaatgctcggagctcccctgtggtcatcgacgcctccactggtaactataccttctactgaggaaatgccattgacttgtatgcaatcagtttcatgaactcaaaaaacaaatgtgaggcgtatatttttgtattatagattccagagaatcttgtttccggtttacagtattctcagattcttttaagtgtgtttagaacggctcgggagaaaagtgtgggagtaattttcttggttatttgccttcttagagacttaattttgttttctttcagccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggtattgctgcttccatgctgtcattttccttcttactacctaggacacatgaagtccttagcaaactcccacagcgtctttgatactgtgtcatgagaatgcgaaactctgttcctgataacctcaaaaagcattctctgtgtaggagtggtagagcctaatacatcccaaaaggcatgagtgaaggaaaatgcaatttcaagactgtactaatggcatgactagactcatgttttcctttcgctgcaagtttgccagatacctgtcaattcagtcctggagaaagatatttttcaaagcatactagctgattgtgattctgtcattacactcagctctctatagatatggcaatcttgcaggacttgccagtgcaccacctgccattgaccttgttgaccactatcacaggataggtcttgaggcagagcagtcccaaccacccacattggaagaatgcctggaatggggaataagagttgtctaccttggtgggaaagactataagcctctagtattatttttgcccaagagatgaaatatttaaactatctgtattagtctgttttcatactgctataaagaggtttaattgactcacagttccgcatggctggggaggcctcagaaaatgtacaatcatggtggaaggaaaagcaggcatgtcttacatggcagcaggagagagaagcacacaggaggaacttccagatacttacaaaactatcagatcttgtgagaactcactatcatgagaacagcctgggggaaccaccccatgatccaatcacctcctctcctcaatacatggggattacaattccagatgagatttggatgcagacacagagccaaaccatatcagtctgtatagagtatcacctggactttaaaattcccacagaacatacagacattagaaggagacactggctttttagaattggggggaacaggaaaatagaagcagacatgagaggaattgaactagacacttcccacagaggctgcacaaacactggccaatctctcctacccttcacttgcctttagtttcacttttcattgatctgccactgaggactgcttggttattaggcctaagtagattcatgtatataatctgcaggactctctttcaaatttatattccagtggtggtatatgatgctgatagattttcttaaattcaaaaaggcaaataagaccacgttaaaagaataccctggaaaggccaggcgcggtggctcacgcctgtaatcccagcactttgggaggccgaggcaggcagatcacaaggtcaggagatcgagaccatcctggctaacayggtgaaaccccatctctactaaaaatacaaaaacaaaattagccaggcgtggtgatgggtgcctgtagtcccagctactcgggtggctgaggcaggagaatggctgaacctgggaagcggagcttgcagtgagccgagatagcaccactgcactccagcctgggtgacagagccagactccatctcaaaaaaaaaaaaaaaaaaaaagaataccctggaaaagttagccaaaaaatgtctattcaggcgtcagatatgatagtaagataattagtttgcgaygcggactttatatgcaggatatttgggtgtttatggaggaaaagtgaagtcgattttaccttcaagaggccaacagccagctggagaggaagtgcctgctcccagtagcgtctgctggtgagaccgacttccacttgactagctgagcccattgacataatgtgatggttctattctcccttcaggcctggaaccgggaaccgaatatacaatttatgtcattgccctgaagaataatcagaagagcgagcccctgattggaaggaaaaagacaggtaagagtatcttgcaggtaacaaggagaaagataggacaaaactaataacaaatgagcaatcttgcaatatgaaaaggttctccatgttttgatgcatttcttgtgatttttttwatctaacagcatagtgtatatattgtattctttaataggagaaataatttaacatgcactgcagagtttggttttattttttttctttactacagccactcaatataaagccttgttattcaccttttaaaaattcaaacaagatgttaaaatgtaaaagaagagctatcattgctcttcttttataccttctgttgaattttaaaatgtttccttttttaaaggagggagagaaacctctcacatttatctttatttggtttctacaacttagagctaaataatgtcttacttttgcatccagtttcagttaatttcaagaaaatgtgtattcctgatataggaaaatttcaaaaatgaacatgtgtgttttatctatttttaccatttcaaaccatgaaaaactgttgagccaaacctctgtaattctcatacttatgacactgatatgattagtctggattctacttcctacaacttgcttctcaaatttaaaaaagaaagagagaaagagaaagactgcacatttcagttccattaggtctaatttgagcagaggcagcttctacggggctcagcggtttaaagctgtgtgtatgataaattcatactaacacttttttctttctaaactataaagaaacctttgagaaaaatcctaaagatttctttctggaaaaagtgttttgtgatctcagaactgctcattttctggtggcttttatcaaattgatgaacagtcattgttgcctgaatcgattattatcattgctgctacttcctggagcttaatgcgctttgcttttttggctctaacctctctcggctagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccggkactcaatccaaatgcctctacaggacaagaagctctctctcagacaaccrtctcatgggccccattccaggacacttctgagtacatcatttcatgtcatcctgttggcactgatgaagaacccttacaggtaattaattgttctcttcacttctcatggggcagcacagaaaggaataagttaggtaactgaagtgaccagccctcgaataaaaagtggcttcatggctgggtgtgatggctcacgcctgtaatcccagcactttgggaggccgaggcaggtggatcatttgaggttaggagttcaagaccagcctggccaacatggtgaaacctcgtctcttgaaaaaaaaaaaaaaaaaaagtggctccacttttagaacctcttagaagatggcacatttaagccctgcttttttttttttttaaatcccaatatggctctactttggaggacataccagagagtcactagcttttatttcatagagaaaatgaaactatttctcttattctcacacatttgaggttcctttttgagtaagatagatgattctagaaaagaaagatattctacctgaatttccatttgtgtgcagaagtctaaaacactacctttacgatttgtccttgaagaaccccactatctacaacatatctaaagaaaaaaaaaaacaggcgaagctgtgcatagcagctgataagtgattgattctctaaaacgtatattatttaatttgtgttgacagtatccatttttttttttccccgagatggagtcttgctctatcgccctggctggagtgcagtggcgtgatctcggctcactgcaacctctgcctcccaggttcaagcaattctcctgcctcagcctcccaaatagctgggattacaggcatgtgccaccgcacccagctaatttttgtatttttagtagagacggggtttcacgatgttggccaggatggtctcgatctcctgacctcgtgatccgcccgccttggcctcccaaagtgctgggactacaagcatgagccacccactacacccggcccactgacagtatcaatttttattgtgttgttacttttagaaagtggcagaatttaaaaactgacaacactgtaggaaatttatgagcttagaaacatgagtttgaggatttgcccaactgttttaaggactccacactggggtcagatgtcacctggaggagcatgaccgtgtctcccatatagcgcagtgtccaggttttatgtgaagcaaacatggccagggcttccagagggcttatgcagacctgcgactgaagcaagatcaatggcaggccgtctctagtattgtcgagggctcctgttaactacggagcacgyaggtagattgttggcaggaaaatctggcaggaacgatggcccctatccttgttccatttctctcctcagctggttaggaccactataccctccctcttttttttttttttkttttttkttttttgtcttcctttgctttgtttaaacagtgagggttattggtaagaggagagcccgtgtcattcctcactataatgctttctctctgctttggatgtaccgataattgcagttcagggttcctggaacttctaccagtgccactctgacaggcctcaccagaggtgccacctacaacrtcatagtggaggcactgaaagaccagcagaggcataaggttcrggaagaggttgttaccgtgggcaactctggtatgtaaacacgtactatttagacacargctcccctctgctgtacaccagagatgggcttttctgttgactgtacctttgttgccattgtctttttatctttgggatttaatgcaacacatcaayatgaaataaatgagcaactttatattaaattaatctctcccccacctcctgccatatcctgttgtcttcacaaaatgcatacgtaattgacagactctcaaatggtgatatgattatagatctggaagggatttcaaatattatttagtacaacactctgagtccttacttstgagtatctgagttgatatagggcacaggtttcctgatgtcttttcccagaccctctccatytcaccatgctgctgtcctcttgagtgattaaatactgaaacgattacctataaagaaaataccccttctgcagacatggggacagttggcttttgctcctgatataaaatgctaccaacattgtgcatttctgtctgcagagaatgttattccaatgttatttccatttttttccaatgttatttccatttttttttctgactatacaggttaaaagcttctatagaggttaaaagatcattaactcttctttgtagcacctgggaaatccttttaaatcaatagcgtgccacctggctgctcaatttgcagcagctgaaaattcaccaaggcacatgagataggggataatcaaaaccgtgaatccccaatcttccaacaggagagttctctactccacaccaacagagagtgctaagtcctgtctatgccaagtgacagattttattcctaaggccagttgtttaattttagccccttccctcatctgatagaagactgtgctactttacatgtataaattcctgtgaattaagcagttgagcatttggctggagagaggttgggaggagattattttgtgtttgttgtattacatatccacagtaatgcttatctttgccttttgtggttttactagtagaatgccacgtgaacagaattttcaagagcaaaaaggtctttgtgcttttctaagtcattttttttttttttttttaaagattccatctctttaactttagttaggatggaatttgaactcctggctcttttgagtatagaaacccctagtaacaatttaagttccttccatttttcttttaaactccttattcccagcagcagtattctacattctaaccaggttctcccagctttgagacgtctcagacttaccagttctccaaaacgctattttctttaagggtgacaccttttaaaaattaggcacctcaaayatctactgcttttgagcttttgagttttgcactgtaaaaagaaaaatacacagtgggattttaagtcaaattagtttatctaatttttagggaataatttgaagcatgctttgtttgcatagatttttttaaaataagcttttccaaatcataaagagataagatcttaggtaacatgaagagactcccttacttattcctaaatmatctatattccaagggcattttcttatttggaacagttgacctcactgataaagctgtctcaccactataataacaatgtccaaaatctaggctttctgcactattatgcaaaaattacaataataaaagtgaaaattacattataatggtatattaaaatgctaagacttttgcattataagcaaaagacagcctttaataattattctttatttagtgaacattttctaagtcttggaaaagggtcaatgttttgaattcatggccttatataatcttcacaagattccccaggaggtatagatatttttattattacgctagtattgcagatgagggaagcaaggcagagtggtattaaatagctggcccaaggtcactcaggtaccaatggagaggcatcattagtctttgcatcccactaaagttctccactagcttcaattgcctcaagatctgttccatgttctatgaagtagtttcaacagaaatggcaattatcttagaagcaakggaaaaataaaagatgggcttcctgtcgggtgcctgtgacaggtgtcacatctaaccatggttttttagagcagttaatgccttgatagaacagatgaatgcctcttaatcctcctggaattcttgttttagattaagtcattgtatacagtcattcgattttcttcttatggtccaaatcgattaataagatgtctctttttgctttttcttccttttcttcatagtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagtgagtagttgctttgtccatccacttccrtgtttgtctcctcaagttccatgcatgcactcatgtgccaaggaagcatgtttggaagacacaggttcttccaaacatgaagcaaacaagagaatactgtttgactcgaagtaatattttgcatcatagaaaaatgatgggaaattttacttgttggacattgcttcatttcaagggttgtatgccaatacaactattaattacacataagattatggtgctaatttgatttttgaaattttctgtgaaaacaaatkgataaagacttttggaaccaggtctatttaagagtattagagacacagaaaaacctcaaatctcttttaatcttcagtgttgaatgagatcagaggtgaacatttagactcaaaaacagcctccttcaacataaaccaaacatgcacatatcatagtacccatgcacacacttttgcrtcacacacatagyccaggtagcttgaacgttgctagaaatatgaaagaaaaaacagataatctgcttttagatcattaaaaatcaacttgaattgataaatgtttgattttcaaattctaatacgttttaattttcaaattttttaagttaaaatgtgcctaggaaatatctattatgctttgagattaggattagaatttataaacctttcatttattctttgtgtttaggagatgtgatgattattgacaattggttcatttttataggtgttgaccgttatgcctataaataagcctcctatagacatacagaaatcatatcctgtggaattagaatataagacttggtaaaagagattttcaaagtattttacttaacttgtatacttgaaatcatttaatccagactgaagttgtaaaagccagccagtgttttcaatatagacttccatgtttgaccatctgaaaatgaaaaacactaaaaacatcacatgctgtttaggagctggaaattttaatatttgacttcaagtagatggtttttaactcctgaaatcgaactacgtttaagtttgtatgtttattacctgtttgagcacttaggtgcaattgtgggagcggggatgtcaagttcatttatgtgactctttggctcaacttacataatctttgttttgatatcacagttgtctaattattttactttgtagcttaaggcaggctgaattgttgataaaatggaaaaagtagtatattgttatataagcttctgaggtgtgttttgttgtataagccctggaggttaaaaagtcatcccttatgtatagtagttaaaggcataaaactgtgacttttagatattccacagaaccagacttatttgatgtggataataaccaatgatttagcattttgtttgcttttgttttattttatccgggttcattttttactcttcccatgtacatgaaacaggtggtggcgtgtagagatcagctgatccttgttttatggttaattgaactactttgtatccagggtttctgcaaatccaaaagtgatttttcatctaggatctattcctaacagtctactccaatcccactttagttttccacaattttaaatcttaatagtgagaattcaaatgaaagtcatttcatttgactattctgatgacatgattgtggcagaataaattgggtcttaaaatgccctagaaaatggtaaatgataaaaaataatattttaaaattcaaccaaagaaatggcccattggccaggtgtggtggctcacacctgtaatcccagcacttttggaggctgaggcgggtggatcacctgagctcacgagtttgagaccagcctacccaacatggtaaaaccccatctctacaaaaaatacaaaaaaaaaaaaaaaaaaaaaaatagcactgtggggagtgcctgtaatcccagctactcaggaggctgaggcaggataactgcatraacccaggagatggaggttacagtgagccgagattgcaccacttcactccagtctgggcgacagagaaagactttgtctcaaaaaaaaaaawaaataaaaagtaaataaataaataaaataaatggcccattataggggtttttatctttaacttgctatttttccagatcatggttctgaagaccctgtgacacgtcccagttcacctactgtcttgtgagtcagaatatacaaataactttttggtcctgactttccccacccctacaggatggtgccatgacaatggtgtgaactacaagattggagagaagtgggaccgtcagggagaaaatggccagatgatgagctgcacatgtcttgggaacggaaaaggagaattcaagtgtgaccctcgtatgtcatcasagatcatttttagtgccttattaagcattctcactttcattatcaggctgtaactctcattcacagaaatgattggagactttaggtctccttgaggagtgaacagtgggtttcttaatcttttgatttgggaargtggagacaagcttcaaaaatgagtcatgatttaatgttattacaggrcactttagcacttgtccaacctgagtattttgaccattatctgcagtaaaatgctacaaagaagctttattggtctgtagattcaacttttaaaatatgatttccatcttcccgttggaccctttccagtgtattaggtctaatttttggaagtgccaccctaagatctgtatagcagtactrctcttagggatgattcacataaatatgtggtgtttgcgctgtgatgatacaaatttaggacagaaatagaacccacccctagatcaagtctgcagtattgttctcagcttatgcgtgcatctgtcttgtgtctatatgcagatgaggcaacgtgttaygatgatgggaagacataccacgtaggagaacagtggcagaaggaatatctcggtgccatttgctcctgcacatgctttggaggccagcgggtaagactggatgtgccaggctccctacaagttagataagataaagggtgggctcctgcaaggatgtgtcgtacacacaggaggggcagagacccttcggaagtattaaaataccacatttcctgttggcatacaactgctgacatagagctctagagcagctctatgtctaccttacatgccattcattctttctattactcttagtagaaagaatgaatgaatggcatgtagagtaccaaaaacacaagtcttgagtcattcttaatagcaacacctgtcatttatatgatgttagaatcattttcctaagctccctagcatgtcagagatactatttacactgaaaaatagtgaagcagagatactattcaaattaattagtggtaaatagaatgtgtttcatttcagccggttctccccatcctgggcagcctgagaccctcccctcccctactattctcaggctgcttctatttttcagcaaagtgttaagtgcagtgtagctctaggcctccaactccattctgatggacaggtgtccccatggcaacgttgttaaatattttgaataatatctcagatgtaagaaaatgccacttcttttaacctctctcttgattcagaacagatgcttgttataggtctagcactgtgctaagtagtataggaaaaacagaggaaatgagaaatggcttggctcttaatgatatagttgaagatgttaaattagcatacatttcaaagtcaagctaattaagttctaagtgggtctgacaaatacagttctgggtaggctggaattagcaagaaagagaagcatgaactggctgaggtttacgatgactaaggtttagttgggaggggagaaagcagagagacacaccccctgggatagaaaggagctggcccaggtgggctttggtgagccaaccctctgcctgctgtcttctggtaagaaaatagatgggaagaagtggcttatggagggccttggcaacccattatttaagccagtacttctcaaccatttctaaaatatgcccagtataacaaaaaataataagcctttctctaatatgatttcaaatttcaaaatgaaattatgtgtaactcaaataaaagcaatggaatgtgacagccctttgttttcaacgaagacatgccctcccagcaactccccaaatcctggtgggtgaggggcatgcttcacactcaagggtgagactcattggttaatgccaaatgcattaaccaattacaggtatccaagatgcaaagaaacatgatggaaaatagtctttgggaaaattaatctggcagcaggggtgttcaggggcctgtcttggctccaccaggggcagcccatggaaactactatgatcttgtttcacccccagtgattacatggggagggaggtgctcccaattctgatggaggagaattggagattggaatttagattgaattcagtatctctctctgtctctctctctctctctctcccattaacacttacaacgactgtgattgtatgaccttagaactcagtcattctggtatgaaattgtgtgatggagaatgaatttgctgggaagttgattttggtctcacttcagcatcttctcattatttatgcacatgaaacctttcatgtgcgacacttattctattctcaagtgctaaatgaaacatttaagacaggagtggaaactgttcactttctcatatgaaagcaagattcagtgattctgtaaggaggtagtcactggtattgtgttaggtattaaggggcatatgtgcttaaacagagaaatatgtctaaaatatttaaattctaatataaaaaagaaagtgactgtattatttagggctgcattttagttgtaagaaaaaagtccaactcaagcaaaaatggcccacacaatggaacagtcccaggacccaccggcttcaggggctgctccagcaatggcgcccggactccctcttgctccgcgtgccttcccatgcactggcttcgtgcttcagcggggtctctgctgatggtgccattgatgactgacctccatgagcttgctttaccccctgccagcttaagaacagtagtgaaagagaacatgtgtgtcctcccatttccagtaaaaacttcaggcaggagcctcactggctcagcttggtcccgtttccatctcccatgccatctccggccaggtgacaggctaccatgtcactgcctagggaagtttaggaagagagtggcaaagtggtgcattagaaagaacatggccaggtcaccccacctcctgggcggcaggcccaactccaccagtggtccactgtgtgacttccctgctccctctaagcaagtcactcctctcctctgggtctctgtttccttacctataaaatgagaacrtttcttcatgtgatctcaagtcccttttaaaatcgctaggattctttgaaaaccttttctatcatctagtgcagagaacttgttgaggaagttgggattggaatgagcctcagcagatgggcaaggtttgaataggaagagaagagacatttcaggagaaagaaacaacatagagagmcagatgtaggtataagatatggtaataagccaaaatgtattaagagttataaatgcatgaaatcatcatcaaagcttgcttagtgattaactgcttatattttgccagtgcatatgatgtgacatttttctttaactcaaacactaaattacgatgtcctcaggttatcataaaccccatttgacttcatgcctctactctctcagggctggcgctgtgacaactgccgcagacctgggggtgaacccagtcccgaaggcactactggccagtcctacaaccagtattctcagagataccatcagagaacaaacactgtaagtgcattagcagcacaagtgtgttccctcatactagacagtctctktctacaggtatstttcttcagaatgaaccaagtgttttaattaattaaaaaaaaaaacaactcataaatgacttaagtgaaacactgtattccataatatagtttaagttataatttatgtaactcttgaacatctcctattgcccagtatgctgctaggttcttgaaactaggaagaaatattatcctatctataagcagctgtcatgagtccccacctccccgcatttttttttctgtacactttacagtatttgccactaatttttttttccttcttcctttttaacagaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctcyagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaarttgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaagtatttgaatagtataatatggaggagttttatcttagggaaaccccatggtatgataacccccatctaacatgtcttactttgggtcagctgacacttttggcatggcttgataaactcccagctaaacagtttgtttactcctgatctgtaaaggtcatttctttttcaatttaacattgaggaaacaaactttgggattaaatttgacattcaggccaggcgcagtggctcacacctctaatcccagcactttgggaggctgaggcaggtggatcacctgaggtcaggagtttgagaccagcctggccaacatggcgaaaccttgtctctattaaaaatacaaatgttaccaggcatggcagtgggcgcctttggtcccggcttctcagaaggctgaggtaggagaatggcttgaacccagaaggcggaggttgcagtgagctgagattgtgccattgaactccagcatgggggacagagcaagactccatcccaaaaaacataaataaataaatgtgacattcagaatagtaaatagtggaaatggaaataattattagtaaaaaattagtagttcataataaacaagacatgcaaagcactttttaaatatactaatgtacaatgaaagaaggtatttcaataaacacctggcaaagaatattaaaactaaatacagaaagatacttcctcatgttcatttgaaaaaaaaaaatactaactcccatttgaattgatttacagtttataaaatgctttgacatttagctatctcatttaggggaggttttagagcttaattttacagggcatgaagctcagatgaggtttccttagcgaaatacagacccagcccctggacttctatttattactgatctttaagctttatcagcccaatagtcaccaagagagctgctctgtatgttttttaaaaatcacagaaagtacaaaataaaggtgatattaaacgactgtctcacatatgtcggtcatcactgcaccctggagagagaacgtcatctcgatgccaatctacacactgtgggaagggacaaccccctgagacacatgtgctgcaaaaagtaagctgatgcttccatattcataggtgagctggtaaagcaggcccttcatctgaatcttgcttaaagccttgatatctaaaaacataaggaaagagcagctttaggttgagactgatgatgcttcaaaccacttgcctaactacaaacctaaaaatatttaccctaaaatgcagtgtaagggccgggaagggtggttcacacctgtaatcccagtactttgaggcgccgaggtgggagggttgcttgagctcgggagttcaaggccagtctgggtaacatagcgagacccctgtctctacaaaaaataaaacaattagccaggcatggtggcacatgcctgtggtccccataactcgggagactgagacaggagaatcgtttgaacccaggaggcggaggttgcagcgagtcaagattgtgctattgcactccagcatgggcgacagagtgagacttcgtctcaaaaataaaaaatttaaaaaatgcagtttaggcaaatacagttggactgtattaactaaatggatagcaagcccctttacttttatgttgaaatgtaaaaaacctcaagttccccacttaaggtcaggaaaaatgccaccttttccaaaatgtctgttggattctccaaagtgatacattaaatttatgaagtaaacgaatagcaaattaaacacatttacaaggccttttcttttagcatcacaatgcaagaatgatgaaactttcttttgtactgatcatttctcagcaaatagcatagtatagagttttgtcttggggaaaccccattgtatgataaccccaatctaatgtgtcttactttgtgtcagctgacacttttagcatggcttgataagctcccagctaaacagtttgtttactcctgatctcaaacaggagaaccaactatttccaaagatcttttgccgtttttattgattcaggttattgcttcccccgagaattgttttaagcgggcaagattgaaaaggcattactaaaagaaaaatctatatttaggcaagaaatcaacaatgcaagaaaaattaggtaaaactagtaaatgttaatcagactttaaaaagaaatatcatcgttttaaagttttacattgccttgctacacttgatttgtaataaaatgttacattttatattgttttcagctctaataatctaagtgaattatgcaaataagtctgtataataacatcactatacacctgtagggcaccctttctatggaggtgaataaagaaatgatcagggggaaattacaagtacaggaaatgacttttctatttaattatatttccattgaaacttctattccatttctagtggtatgaaactcattaaagtgattaagaaacatcacatcagcacatttaagtgctcaaattgcttcctatttagtaagttcccattactgtgatagggaatgtggcaggttacaattaaaaaatcccattttcaagggagacaattcaactcttaagaaaaaaaaaaaaagaccgctgttgggacttcccatgtttggaaacatttaaagattaccattaaggctgataaagcagaagaaacacaaagatgaccttgcagaaactaaggaagttttttcaaaatacttgaaatgcacgttgttttcattatcacatcgtctcactccatatcctcattaaaataaaagattcaacttgaattgcaaacagaaacctatataaattacaaatgaagaaaagatgtaataaaagagcaagagaaacagggcttcagccgaaagtcccaaatgggaaattccttttttaacattcctcagtagagtcaggtatgagatattaaagcatgttttacatttccttgaattcctttttacttactctttagagacatacaggttttaacaatctcaggagccaaatttatctctaaaacagctcatgtggagcccccaaaggattgaaactagcattggttgaagctgtacgaggcagccagcccagaatgatggactggggctggcgtcaagtgccctgaagctacccagcagagcaggctcccttaggcaagatacatcaaaggccaaggagtctcccattgggccctttgcaacttggtactttgtaaatggccatttcattctagaatgaagcactgcctttgccaggagactgctggacaagactttacaatgaaacatgcccatctctgtaattcagcttcagatgtaagatgctgagccaagtgctggaaagctatttttgactcaaaaatgtacggcgatggtggagcaactggaaccctcattcatcgctggtggaaatgtaaaacggtgcggctgctgtgggaaacagcctggcagctcttcaaaacgttaaacagttaccatacgacttcacagttccattcctagatatatactcgagagaacagaaaacatatgttcacacaaaaacttgcacacagatgttcatagcagcatcattcatagtagccaaacacggaaacaacccaatgtccatcgactaatgaatggatcaacagaatgtggtatatccatataatgaaatatctgaccataaaaggaatgtacatgctgcaatataaacctttaaaatattatgctaagttgaagccagacacgaaagagcacatattatgtgatccaatttaggcaaaatgtccagaatgggcaaatccatagaaacaaaaggtagatttatggttgccaggggctggggcgaaggggaaatggacagtgatggctaagagttaacttttggggtgatgaaaattttatggaactagataatggtgattgttgcacaattgtgtgaatatactgaaaactgctgaacaatacgctttaaaatggttaagatggtgaattttacgttacataaattttatcttaaaaaatgccacttcagttatagaaaatctaatttttgctccttcatgaggaagagatgtggggtaagagtagatgaaggctgaaggaactcagaaactttgtggctaccaatttggaacctgaaacaaaattatccataaatagacatcatttttcatagtaatttccataggttatcttccactagttcctatgcttccatatacacaaaagcattatgaaaagaataatcagcatctttttgaaacagtatttatcgtgactcaggtggtattttaagtgcccgcaatattttgtctcatttgctcttcagagcaactctaagacgtcagtattgttctcatctcattctacaaattgaaagtgcgggaaaggcaatgtgaatcactaaacatcacatagcttgtaagtaggagaactgggactcgaacctgatagactagcaccagaatatgtgctttcagccagaagctattcagccttttggaggagtgaatccatccccattttacagaagaatcaaactccaagagggttaagctatgtgcccaagattgcccacctactgactggcaaaacaaggtactgattatcctaagaggcacaaagacaatttcctcgagggaaagatggagccgtaatcaagcacaggaatgtgggggccttctagcaaaatctccttcttgacctggttggtggtgacacaggtgtttgcataaaaattatactttaaatggtaaaagtttcatgcacttttctatatgcctacttcattacaatttcttttaaagataaatttgtgcctggcacagtgtttggcaaaaataaggtataaaaatgtccatgaatggaaagcactgcgagcttaaagacctgcagggttctgtgctctgaggaagggacataggctgggctttagaaaggtggcctggagagaagcaggtgtcaaagggcaaggcaacgggaggaagaatggaggatccctttcatggactgttttctccctgtgcccaggggatcccccaatagaaatacactcagtattggtcaggacgttgttacattatggatcttctgtccttctgctggaaacaacagacataagatcattatgcatttcacttaaacaccagtgaaactccactcttgacgtttcgaatgattgaattatactagacatatatatgttaatggggttccagtgccagaccctcccaaagtgctcaacttccttggttactggctacctccaccaagattaacttgagtacatataaaggaaaacaccacctcacagagcaaaatatgaggaacccaggagtaagcttgcatgtgaggggtggcactttggcttaaggcaggacaccgctttttttggcataacacagggaagtgagacagtaaaatgagaaaggagctgttgacagccctaaactgagtcgttttccagagtgaagaatggttgctcttattgcttgggtgctcctccccggggttcattcaatcctgtccttcatgaaccccttggggctggcgaggagtgcatcagctgggctgtctcaagcacacgctgctgggtagccaatgttagtcagggaaaatgagctcacaggccaacataccacaacacttgagtaaagagactttaaaagaatagtaacatactagattacagatcctaacagaagtagaaatagtaaaacaaagctagaaagatgataccaacaattggaaaagaaaaccagaaatatttgaagggaaaaataaaactcctgaaataaag

SEQ ID NO: 17625 - DNA, 26433 bp, Homo sapiens
gctgtgttcctcccgaaccatccctcagcctctgtggtgctggtctctgtccggggcctttgcttatggcccttgcatgctcttttcctcagcacttgagctatttgattccgttaaggacctgcaggcactagtcacaagcagctgccgactggcgatggtgcagaacctgcgtgtctagtggcagaagcaggggtctgagaatgaggctctccaggcagtgccatggggagggtccggaggagggcgagtggggaggtggaggagggcatggccacttcagggtcccaaatagggaaacaccaaaataactgttctcaggaaaatcagctggtcaccgtggaaggtagacctgggaattctgtcggcacagataagtcatttcccctgcagcctcagagatgcttgtgtacccccagccgcaggctacaacagaggtgcggagggtgacgtgcctgcaggacttgttttttctgcaaagcattgtggttgtaactaacagaagcatttccttgcgactctccccccctagaaatttacacagagcatgaaattagatggcgagctgggcgggcagacgctggagcacagcaccgtcctggggctgcccgcaggggccgaggagcgggcccggaaggagctcgccaggaaggtgcgtggcctccaggtttggccagagagagacgcttcctcccggctgggcggcagcctgggcatcctgacgcagggagaacaaacctccccccttttacttccatctcccctcagattgaagaaaagacttaaaattagcttccaagcacaagcacaagagcctctcacaatcttctcagctctctggtccccacttcagccagtcgggctcgagggaacccccacagatcttcagagcgagcgctgtgcagggcgcctgggcgagggcaggggccacacccgctgtccctgctgagctcggtcctgagttagaaccatcaggctctcagcaggcacggacaggctgcatgtcctcggaggcatggccctgcggcgccggctccggggtggcatggtggggtgggcagtcccgtgttcacacgctggagctggagctggcagagaggagttgggtttggaagcgtgggggccggaggtgagggacactgagaggcgccccgacctccttgctgagaaagctgctgggaaagctcgttcatctcaccccaaaggagagtgaccacctcatcccacgaggcctggagtgtttctctgagtgctgggttctcaggaatgttttttgatgtcttttttaccttgaatctcctgaaaacatcatggaacccatgttttctatttaagaaaaggggaagggaaaggacaccggcctgctgggaacagtgtggagccaagaaggcccacggtgggggtgggcatggctcacgcaccccggctttctttccagcacctggctgagcacrcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggtgggtgggcgccaccccggctcagcccttcctcagctcagtccagcgcctgcccctgcccagcaccgccctggctcagcccttcctcagctcagtccagcacctgcccctgcccaacaccgccctggcccagtgctgtcccggctcagccttcccccagctcagcccagcgcctgcccctgcccagcactgccctggcccagtgctgccccggctcagccttcccccagctcagcccagcacctgcccctgcccagcaccgccctggctcagcccttcctcagctcagtccagcacctgcccctgcccagcaccgccctggcccagtgctgtcccggctcagccttcccccagctcagcccagcgcctgcccctgcccagcaccgccctggcccagtgctgccccggctcagccttcccccagctcagcccagcgcctgccccggctcagcccttcctcagctcagcccagcatctgccccagcccagcgccaccccagctcagcacctgtccctgcatccaggccccatctcccctgcaccctcccctggtccacctggtgtagcctccttcagaaggtggggcaggtctgtgtcctggtgctagtgctggtcatatgccactccctgaagtcaggctagcccagctctccctggggtgtgacattctgtgcaactgggctgccccattggcaccctgcggctgtgtgtgtcctgtggggctgatcaggcctgggtcagcttccctcatgctgcactaacacctagcctgggggaaagggccaggtggccaagctgccagcctggaaggggtggtgcccttgggggtgctgtccttgggaaggtgcctatttgtgcttttggaccaccctgtgccctgtgccccccacaaatgttctgattttctgagcagggatttctgaggccaccctgcattgagaaccactgcttggttctccaagcccctgacacctcaggccccattgctaggccctgttggggtgatgggagccccaactttctggggccaggagagaagaaacctgtgtttgtgcctttgagcaggactgaacaggactgaaaaccttcctgtggaaacattaattaggagcgtgcctcaccctcacccctgcagggcctcttatggtctctgtagctgaacacttccccatggtaggagcagggctgctcaggacggacccgcagaaggagtgtgtgccccagctccactgtccttcctcacccctgctgcccagcacgcacccgcagaaggggtgtgcaccctagctgcaccgtccttccacacccctgctgcccagcatgcacccgcagaaggggtgtgcaccccagctccactgtccttcctcacaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctcactttgtttctcaaggcgctgggtttcgttttatagaagctgcccaggcagggtggatgtctccctggatttgctaatctgtttgctttttgaaattacactatcacctttttgggtgtttttggcctcaaagtggaaatacatggtgtttaagccaggagcaagcaaagatgcatgtggggtaagatccaggcctggtgtccacatctttccgggtgagctggggccgggcttcctgaggtctgtcggaaccgggacaagcctctggaaacggtcagggagttgtggaaacccaccgggcatcgggtgtcgggtttgctttggccccagaggcagccccgttccttctcctgaggactcacccgcctccacgaccctcctcctgctgctgctccaactggtccagggcaggaggccacagacagggccctcaggcaccctgggagcccacacctccccctccgtgggagtgggtcgaggggcaggctctgctgctggctggaaaccccaccccgccctatccggtaccgccttgttacgtagaagttactcagcagactgacacccaatccccctcgggcgatcatctgccctgtcttcccacctccagggctacagtgggcagcaccgccatccccagtgtgacagggccctgggagcctcagggctgcccggccaggttggtctgctctggttacattctggccaagctgccccttcctgctgacctgcatgtgtattgttgtcaccttcagctctcagcacctcggcccccttgggcagtgaggaagggccctggaggcgaggttgggagaaaggatagctagaacaggatcctgcggggaacaagggtgtgggcagctctcacccggggctgcctcactgagagcaccrccgagtgggggtgggggtgtccaactctccagccacaaaccgcttcctccttgtctgcaggctgtgcaggtctggcctgtgagtaaacacatttatcagcaacccaagctgtcagtctcagtgttgtgcaaatgccggaccggtgagcagaggagcctgctagctttcctgcctggccccgaggcccagaaacccctgatcttgtgtcctggggtctgggaagccctgggccttgagaagtggggtttgcaggtggtgacaggaggaggggagggaagcctccagggctgtggggttcaggctcccagaccccccggcacctgctgaagaggagagctgtgttctgtgggattgggtggaacttcctcagcgcgggaggagcctgttctggcccaagctggtcctgtctttttaggaataaatccctggtagctcagcgtcggcaggggccttgctgtgcctctgatgtggccagcgtgccgcctttgcactttgctgttgagtaacttgcaccatgaggtcaaggaagggaagtgtgattgccagctggccattgttctataataacagggtcacctgcatgagctcaggcacaggccagtatccccagccctacctgggagcctctcggcagcctgggggacctcgtcctgtgccacacaggcaagcggacacacccccaggcagcagaagtcacctgcggcccagtgccagcccttgctttcttgcttttcatgccattcacattagggtaagaatggctttgagacaaaatgtgacagcatcactcacgccagcttagatcctccgggttccctgtcctcccaggataacgtccgaggccgcggcctcttcttgccactgccccttgacctctgtcctctgcccctaggcccgtgcagttccctgactcgccctgccctggtgccctctctccaggcaggactccctccagccccttgctggccctgccctgcctctccccagggaggccctgaggscccccccccccatgtgatctgtcagcagcgccctgtgtggtcatctgagctgcctttcctgccaccaccactgttcccaccccaggagggcggcctggctgtgaaagccccagggaggggtcctgggtggaccgtctggggagctgtggtgtcagcccaaacctgcaccctcgaggctgagcccaccacggggaatgtggtcaccaagggcaagcacgcttggccgcaggcctggagacgccggagccaggccacggtgggctgctgcaggctttggtccacgtcggccagcgtcagctgctgtctggggatcttaggctagggacggcccctgcacctgccatcacctgggctgggacccccacctagggctccccctccccacttggacgcctgcgggcccatgcctatcccactccggtgaggcctcagcctggtggagggggcgcaggcttgggggggagggtggcagagcttcccacagggctgaacctatgcccacaaagccatgacttgcccctgcctgaggctttctgttccccaggaaatcagagaccccctctcctgaaaccgccaggcggccctcacaagtcccttcccctccaggacctgcctggcgccacctccttccagccgccgggtccttcgagaggccccctctcggggctctggccggacttgggacaggctgtgcctgagtttcctcacctgtgcaagggaggatgctggattgtggggagaggggaaacggaccccgcccccaggtgccgcgcgccccgcccctcccaccggccgaggggcccattggctgcggggcgccggggcggggcgcgcggaaaagagcctcgggccaggagcgcaggaaccagaccgtgtcccgcggggctgtcacctccgcctctgctccccgacccggccatgcgcggcctcgggctctggctgctgggcgcgatgatgctgcctggtgagtggttccagggaaccgtcccgggcgcagcgcggggcagggtggctctccccgcaggacgcgacgcggaccccgagcccctggcctgcycgcaccccgcaccctggcccggcttcgggctggtccctgggagcgggccatcaggtgcacagtggtctctgggtggagagccccgggccggggaggccggggaggtcggagggaaccttcaaaggtgaactgtgagagggaagtcccgcctctgagcttgttagtggggtcggggccgggccaagcaggacgcttcacctgctgcgcgaggcgccctgggttcctgggattcacctgtggggctacccacccccactatttagccgaggagggaagggagggcagacaagctgaggcctggagtgcaggggtgtgggctgaggggacccgtctcctgcctgggggaggacatggggctgctgaccctggatcccacccctgctcctggagtgacttgggctggggtgtgctgaggagcttcaggctggaggccgggttgcttcccgccagtttcctgggcagataggggctggctgctcccctgctgcctctccaggttggagatgtggtcatggagacacgtccactattgtgttttaatgggagcaaagggtcctggggttggtggtctccgaaaccctgcccattgcatgctgggaccctgccctctgctctcggataccagggagtttccagttcttgggaggtgaacagcctccgggaggcacttcctgctccccagttagatgcgatcagatgatcagaagaatggaggaggagaatggaaacgggcaggtcggcggcccgagtcctcctccctggggggaaggttcatccttgccctcrggcccctccagagatctgagacagcctggagacctgtggagtcactggcacccgctggcacccacagcgtctctgagcactgtgtgtgggtgctgcaggacacaggcccaccggccatgcctgggggcgctcctggggtcttttaggcacagaaccctcacttgagtctttgtcccagagctatctggtgagttccccaggggagggtcaagcccagcaagagacagaatctgagggcccaggaggcctctgggaaggaaacctgccccccggcccctcatgcctgctgaccctccctcctgcagcgattgcccccagccggccctgggccctcatggagcagtatgaggtcgtgttgccgyggcgtctgccaggcccccgagtccgccgagctctgccctcccacttggtgagtctaagctggcctggggagggtccctggctggcccctgagcctatttttgtgaaaggagctttagcttacagaaagtggtgagaggccagtgggtgtctggggctgccctgtacagctctagccccctggggcccatctccgttcctccctccagcactgcctgagggctcccagcctcctcgttccttcaggagctctatggacccctggaagggagcaggggcaggttgtgctggccccrggcccctccccagtttcacttggcgaggctgataagccaaattcctctttgagaagtgacgctggctcaccgcagagttgacacaccttcctgtgttggggggggggcctggcgggggtttcccagggctagaaactgagaatgcccccctccccgactggggctgcccgagggtgattcctgaagcctgagtgggtgggtgtgcacacatgtgcacggcatatgcatgtgtgcacctgtttccagggagggcagttccggccccagccctgtccttacctcagcatccggggaacctactaccgacctgcccgctgccctgggctcatccagccggtggcacagctaaggctgtcccagagctctgcaggccgagccccagcctgcacatgggggctggagatgcagtggtccagcaggaggctctgcaggcaccaccaggtccggcagctgctggaagggatgggtcctggaggcaggcagctgtcgctggaggggcctgtgcgtgctatccccgccacccacctcctttgctgcctggctgaggctatgcctcccccaccctatgctttctcggggaaggggcattgtcgttacccatgcgtggtcagatggggaaactgaggcctgggaggaccgaggagcaccgtgtccttcctgtctacccaagtgctgggctccgccggtcgccttcagcacagccccgttccctaccctccaccctccaccccccgccccccaccctctgccctccgccccccgcctccaccctccaccctccactctccaccctccaccttccaccccccaccccctgccccctaccctccaccctccaccctctaccctgcctgaggctgtggaccctccaggatggagccttgacctggggctggaggccggcaccccttcccccccagctgagcttctctggcccccaggattgaggtgggcacagcccgggcaggctgctcacctgggacccttccctcctcgctcagggcctgcacccagagagggtgagctacgtccttggggccacagggcacaacttcaccctccacctgcggaagaacaggtgagtgggtctcgggtcggcccccctgcccgggcctggctccagcacactggtgtccccggcgtccagcctctgggccagcctctctgcaccgagggggccgaggcagtcacagcacttcttttccagggacctgctgggytccggctacacagagacctatacggctgccaatggctccgaggtgacggagcagcctcgcaggcaggtatgggtcgggcggagcagctgggcgggcaggtaggggctgggcggccctccccgagcctgtggggccatgggggcacagcctgtggacccctctcctgcttcccccgcaggaccactgcttctaccagggccacgtagaggggtaccyggactcagccgccagcctcagcacctgtgccggcctcaggtgggtgtggcggacgaacgccagggctcccgcaggtggagaggaaggcctaagcctgtggtgggggtggggaagggaggcagggagggtgcctcctcctcccactcaggcctttgctgtcttgcatgggggtctgctcaggggacgccaagcccaagaggctcaccctcctgtaccctggggcctgaagtcacctgcggggggctgctggtggcagggtagggggagctgtaggcaacaaactggagcctctggtccttcggggcaggaccaggccactctgaagcccacagcacacccggctcccactcccctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggtgagcacccttgtctcctgtgtttggctggccctgccggtgtccacttgcctggcctgtgagtcctcctggctccccatgygctgggtgctgcccattgtctgcagcctggagcaggcctggccacgctcccccagcactggacaggggctggacagtggcccygggtccctgagggagggtccaggccccggcgctgggaaggctgactggcttcttgtggctgttccccaggactctctgccatcccgagagacccgctacgtggagctgtatgtggtcgtggacaatgcagaggtgtgttgggggcagggaaggtgggagagcagccggcggcgggggcatggggggtgtgtgggctccagcctgagggtctcrtgtccccagttccagatgctggggagcgaagcagccgtgcgtcatcgggtgctggaggtggtgaatcacgtggacaaggtgggcagcggtcctggctgcagaggtgccagagcccctggcgggaggtgggggggggtgttgccacagggttcattccacctgctccagctctgccccrcacctgtgcctggccccacctcgccgtgggacaggtgcatcctccgccacccaccctccctgctgtaccttccgccaccctgcctgacccccaggactccaccacctctccagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgtgagctggcggagcgggcagggtggggagggctggggagggagggcgggcagggtggggtggaagggagagcagggctggggtgggagggaagtggggagggagccgtgtccagggcatctgtgtcactcccacttccaggggtgtcgacttcaccgggactacygtggggtttgccagggtgtccgccatgtgctcccacagctcaggggctgtgaaccaggtgagggggctcctgcccgggtttgccaggccgaggccagagctggataggggaggggacgcctcggtccaggtctctggagcaggccacctcccctcaggccaggtttaatgcctgattttatgttttaaggtggtgttggcgggaagctgtgccaagtcctgggccctggtggggtgagggtggcaggcgtggggagttggccacatggttcctgagagcacagaccctcctgcaggaccacagcaagaaccccgtgggcgtggcctgyaccatggcccatgagatgggccacaacctgggcatggaccatgatgagaacgtccagggctgccgctgccaggaacgcttcgaggccggccgctgcatcatggcrggcagcattgggtgaggcggccaggccctgcagagccagggtatgctggaggtacgaggtgggtggggaaggggccaggccgcctcccccaatgctgccccgcctccccagctccagtttccccaggatgttcagtgactgcagccaggcctacctggagagctttttggagcggccgcagtcggtgtgcctcgccaacgcccctgacctcagccacctggtgggcggccccrtgtgtgggaacctgtttgtggagcgtggggagcagtgcgactgcggcccccccgaggtgcgtccatgccccatacctgctcccgtcagcactgggtgccacaacctctgtcccttcaggccagggtgaccactgcacatccacacgtggaacttggggctctgtgggtgtccagagcggtcacagggagggagtggctgcagggcaccccagtggtcaggggaggcggccaggtccgccctggagcccagcccggccccagtgcagcctgccaaggcctttgccgtcgccccaggactgccggaacygctgctgcaactctaccacctgccagctggctgagggggcccagtgtgcgcacggtacctgctgccaggagtgcaaggtgagtgcagcctcccaccagtgacccccagagcccatggctggcaggtgggaagggaccctggggcaccagggaccaggcagcttgcgtggacctgtccccrtggtgagctgttctctgctgggccaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgaagtgggcacagagctggcctggcagggtggctgcaggccttgccagggctaacccgctyctggtcccacaggtgggcaggctgccgaggagtcctgcttctcctatgacatcctaccaggctgcaaggccagccggtacaggtgagcttctgagaccgccctgggcccaggacatgtgctgttcccacagcggggtcagccccagaagggcctctgcaaagggtcctgctcccatgagggtctgctctggacccatggaccccaggctcaagcgcaccgtgttgtgggagggaggtgggtcactgtggctcctgggctccccagcatgctcccaggcaagmtggcccacgacctgcygtccatccacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtgagcccctggctcagaggccgcgccaccccccaggcatcccgggcatgtkccccacgtgggtgcagatgcgtttctgagcttggcagctgytcgaggccatgggaacagagttctctccscgcttctagtagagactgaaaggtttccrggggyggggagagacatggttctcagttcatctgatggccgtcrccggcggccacgtgccccaggagggccacttcccaggggctttgggggtaggcagccggcagatgggctgaagcacagccaccttggacgtggtgaccacagcccacccccagcttaccatgcagtttcaagggacgctggcggggcagaggtccagagcggctgcctgagagacgcctcctacccccaggtttgctggaaaggacgttgccaggacttacacgtttacagatccagcaactgctctgcccagtgccacaaccatggggtatgtgtggcctctcgggacagggcccctgcacagaggctgccgctctgagggagccggtgctggggacagctctggacacgggagcctgaggctgggggagcctggcgtgtcctgtccatgggggtctctgtggagcccctgtcggctgaggcccggcctgggtggcctccgtggatggaacctgcatggtcaccgggcagcgggcaggggctacatggagaggcctcgccgtcvgcgcatgtgggcagggaccgaggggccctcgggggtggggctggcccggggccctcatgctggaggcacggcccccacggccccttggggtccacaacagggttggccctgagcccagccgtccccgcaggtgtgcaaccacaagcaggagtgccactgccacgcgggctgggccccgccccactgcgcgaagctgctgactgaggtgcacgcaggtaggcctccctggccagcgcaggtggggctggggtccaagctcagagggcccgaacagagcccaggcagaagcygcgggcccgggaagctggtggtgttcacggtgccagtttgctgccacaggcatcgacacacagrtataggcagagcctgtctgtccccaggctgatgtgaggaggggagagccctgtcccagagggaggcagtggccgagggcagggcacggccgtgagctgagactccagtgtcctcagcctgtgtcttccagcccctcctcggcccggggccctgaggccacccagcatttcctccccggcggccactgagcatgtggtcgtccagagcatcaggcctcaaaggcacagccgtgcccacagcactgtggcccagggccaccctgccaagctctccaacctgtcactggcaagctgggagtgccagtgtaaggtaccaggtcctccctgaggggtccacagggcacagcctgggggtgctgagaaagaccgtgtctctgggaacctccctggctcctgcctgaggtcgcggcctgcctgcctgatgtggggccgtgtgtcccacagcgtccgggagcctccccgtcytcgtggtggtggttctggtgctcctggcagttgtgctggtcaccctggcaggcatcatcgtctaccgcaaagcccggagccgcatcctgagcaggtgagggtggtgggggctgtgacggagggtggcgagtgcttcccgtgctcagctgccagaggaaggagtgcccagcacgggcccatggtggacggcacggacacccaggctcctctgtgccccgacgtcatgacgccccccggcttgggctgagtttgaagggccttcctggctccactcggccagtgccactctggactccaccttcccctgaggctggggcggggcatggttttggtggccggttgggcttggggcaaatccagagaggcccggtggggtcccccataccctgacccagccccgtgagcaccctgccagtttcctgctgagccctgctctagggacctggacccccacacagcaggagacccccacgcagcaggacacactggccccacagcctccaagcatctcccgcccacctgactggggcccccaggacatggagggggtgtccctgcctcttcagggtccgccccacctcctgggcctgtstgtctctcatggccacaacctctcgccctgaagcctctcgggtcggctggagctgggagggagagactcrgggtgtggtgctggggccccatggccggacactgaccatgcgccctgtgcttyctccccaggaacgtggctcccaagaccacaatggggcgctccaaccccctgttccaccaggctgccagccgcrtgccggccaagggcggggctccagccccatccaggggcccccaagagctggtccccaccacccacccgggccagcccgcccgacacccggcctcctcggtggctctgaagaggccgccccctgctgtaagcaccacccctggcgggttcatgaggccgaaagcagtgcccaggccccatcctgcgaccccaagtgcagcccgaggccagcagagccctttcattaaattcacgcacaggccagcggtggccccgaggcccagagcagctgctgtggtcgccctgctgggaacactgaggctttgggagtgggcacttcccagacccctttgagccatgatagaatctgagcttgaacttaaacttgggggctcccagcccagggaagcttcctggcctccacagagcccatctgaggacagtgtcgagacacaaatgctctccggcccccagctcgggatcacacggctgaggggaggaatggggcggggcctctcatctggggtggggccctgtgggccgcgcagacgcctccagcacacacaagaggcaggaacctcggatcctggagctgggggtgctggaggggcacgggggtcccagctctgacccaggctctcggccctgtctcctccagcctccggtcactgtgtccagcccacccttcccagttcctgtctacacccggcaggcaccaaagcaggtgagcagtggtgattgggcggccaagccktctgagggtgtccaggccttcctgatgggattggggtctgtgcactgcaccgggggccagggatccccaggtggcccctgytgtacacagaaggctggttagcccgacctcgtgaggacatcagacagaaaggcaggtcagcgaggccacaggaaggcaggagctcagtcctgccctgcgttggagctggtttgggggtcctggctccttctccttccactcagacctgctccgcccaccaagcccctcccagagctgaagctctggcagagaagaggactccctggggccctgcaggacagatgggtgggtgggctcagggcagggacacgtccgcgcttcccttgggtttgggggctttgggggttttggaaagatctctcaaaacccgaatcactggagccctggcatgctgagggttaactcccaggcctccgtgtccccccagggttggggtcctgtccctgcgccctggctcccacctctgggctaaccttggagccctttttggaccccgtgggggcagctcattggcctcagccctgggaaaccgctctggcagtgggtggagaaggacccttgagctcccttcctggggccactgactcagctagggcagcagaaagggccaggctttctctctggggcctggcacggggccccagtggtaccatcgaggtccacttggcattgcgggacattgtgagcagcctctgtcctcagagagggcaggacggtggcgggcaggctggggctggggaggtgcctgtgtgaagaggtcccacggtgcatctccggggaccccctccacagaggttcgtggtcagccctaggactgggctgtgcatggaagacctggggcaggagagcccctgccctctgggttgaggctttttttttgttaacatttaattttgaacaaattttagacttacagaaaagttgcaaaaatagcctagagartcctgcatgcccttcgcctggcctgctcccgaatggccacagtgtgggcgcgcagccgaggctccacgtcaccratgcgacccagtcagtaccgcctgctccctctggacgcccttctccagccatggtccccccaggcactcagcccccggcccctctgcctttcctcagcttgccctttggaagtgtggccagcagtgttttcagagtccctcagcctgggtttgtcccgtctttccttgtgtggatgagggccstgcactgttggcgggggcagcactggacacacccttccccaggcacagcccaggcctggcccacatgcagcttcggtcacgggggatgttgacacagcgcctagttggagcagcgtccacagatttttccttagaaagctcctgtcttctttttatagtgagcagatgcctcagggagataccttgagactctttgaaccttaagcttggacccactagttttggcatccattggtgaatattggctgcaatagttgttctgtgctgtttgcctaatagtgattttctctcttttttttttttgagatggagtctcgttctgtcgcccaggctggagtgcagtggcgcgatctcagctcactgcaatctccgcctctcaggttcatgccattctcctgcctcagcctcccaatgtatctgagactacaggtgcccgcgaccatgcctggctaaatttttgtattttttttttcagtagagacggggtttcactgtgttagccaagatggtcttgatctcttgacctcgtaatctgcctgccttggcctcccaaagtgctgggattacagacgtgagccaccatgcccggccctaatagtgattttctatttctctctttcctttttaactttttatttgaactaacttcagacttgtacgtgagttgcagaaatagtcctagaaggggtctggacaggcaaaatgggggcctgaagggggcagagagatttctggccaaggaagttatggttaccaggcatagcagtatatggggcagaggctgcagcaggagccgggcgtggyrgtagatggggcagaggctgcagcaggagcygggcgtggmggtagatggggcagaggctgcagcaggagctgggcgtggaggtagatggggcagaggctgcagcaggagctgggcatggaggtagatggggcagaggctgcagcaggaacaggcgtggaggtagatggggcagaggctgcagcaggagctgggcgtggaggtagatggggcagaggctgcagcaggagccgggcgtggaggtagatggggcagaggctgcagcaggaacaggcgtggaggtagatggggcagaggctgcagcaggagctgcgcgtggaggtagatggggcagaggctgcagcaggagctgggcatggaggtagatggggcagaggctgcagcaggaacaggcgtggaggtagatggggcagaggctgcagcaggagcygggcgtggaggtaggtggggcagaggctgcagcaggaaccaggcatggaggtagatgcggcagaggctgcagcaagagccgggcgtggaggtagatggggcagaggctgcagcaggaacaggcgtggcagtagatggggctgaggctgcagcaggaacaggcgtggcagtagatggggcagaggctgcagcagaactgtgcaggagggaagtcactcactcttcactctcacgggcttcccctggctgctcagtagggtcctttggaagctgctgaaaactgcaaatgcttagcccacccaggctccgtgtgacacagccaggagtgagctccacagctctgtgtggtggacatccagcctccctaccctgggaaagctgaaatgcaaagaaacacgtgttttagtagctaattattggcctttgagcttccaaaaccccacattccggcaatctgtagagctcttcaggccaggcgcattggctcatgcctgtaatcccagcactttgggaggctggggcgggaggatcacttgagcccaggagttcaagaccagcctgggcaacatagggagaccccgtctctacaaaaaataaaaaattagctgggtatggtggcttgtgcctgtcgtcccagctactcaggaggctgaggcgggaggatcgcttgaacccaggaagaggaagctgcagtgagccaacatcacrccactgcactccagtctgggtgacagagggagaccctgactcaaaaaaaaaaaaaaaaaaaaggaaaggaaaaaagctcttggagggtaatatgggggttggttaggggatgtggatggtgtactgggcaggtgggcccaggatggcgttctgccactgatgggctttattcctgggcagtggcagccaggagggcttttctgtagcgagctcagtgggggcggagcctgcaggctccctggggggcagagcgaggtctgtggggagcttcgttccaggtccagagaaggtgatgtccaggctagagccgggastgcctgggggacccatgtcagctgtgtctgtttcctcccaggtcaycaagccaacgttcrcacccccagtgcccccagtcaaacccggggctggtgcggccaaccctggtccagctgaggtgaggccccagcacacaccaggcagagtccactgtgcaatggayggcacggcctccccacggggctgacrgtggcactgccgctggagggtggggtttttttctgattatctgtggataaacttgggtgactgaaagaaaagggaaaggcattggcagtggctgtactgtgrtatctgtgctgtgatcaggggacttctcagcagatgccgaccccggctgtcagtggtgcctgaccttcccccagcaactgcagggaagaaagtctgtcctctgtgagctgtatataytgtgactgccacacctgccattgtgtgcatgggccatgttgttggtggatgaaccaagaatccacattttaagagatgttaaaggacgtaaaatttcgttgtaccctttatataccttttatagcaggtagtttttcaacatcarttatcttttcctcctcccagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagcrttccacggtccrgctagtgccgctcagccctagaccctgactttgcaggctcagctgctgttctaacctcagkaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctgcgtgctcttcgagagggtgtcagtgagcagactgcaccccaagctcccgactccaggtcccctgatcttggggcctgtttcccatgggattcaagagggacagccccagctttgtgtgtgtttaagcttaggaatcgcctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttagatcagcggggaaggatggagggcttcagttcacgagatacaagggtcggcgcttggtaaaatgcagactgcgaatagatgaggtcaagccaccttcttttctccctggatttctcaggccctccccagcgtaactaagcagtcccgcccctcccgcgggcagacgatccgatccaggaacccacgcccaagaagacttcgccgcgatgcacggaggagcccgcgctacccccgccccgccccgtctccgggcaatggcccggccccgcccccgccccgtctcccggcaacggccccgcccgcgccccgcccattccgtctcgtctcccggcaacggccccgcccgcgccccgcccattccgtctcgtctcccggcaacggccccgcccgcgccccgcccattccgtctcgtctcccggcaacggccccgcctcttccggccccatgcccttgtccgggccactgccccgcacccccctcgccatgctgggctcgaccccggccccgcgcggcctccacgcctggctggacgcgctcccgctcagccacccacgcgccgcctggcccgggacctcagctatggcggtgggcgcgcgtccgcgaagtcgtggagtccgaggggcccccgcggcaggggcctgcgccctcggcccaggagaagcggcgaatggcccgcggcgcccctcccggttgctcgctgacccccccccccaagagtctggggctgcgaaccccgcttcgcctttgctgcatccgactcagcctttcagatctgtaggatccgggactccagtgtccgactacagggcggggctcacggcccacacgcgccgcagtaccccgcccgatgcgcacgttccctctgggcaccccctgggagcgtccccgtggtgccaggctggcgcgctggcctctgaggaggtggcttctgctctaggcacctgagcagcaagtctgagtgggcgcccacggggcggaggctgttagacgcatctggtgctgcaccgaggaggcctgacgtcccctgtggccaagcccccacacccatgggtgctgcctccgggtggctcctccgaggcagagccctgagctgatagcgcccattcgtctcgcaggcctgccacgcccccagctcccttcagcacgaagaatgagagcgttctggaggggacaggccactgcacttgcagagggtgggttcctgtctctcaagccctccaaccgcccatacctcccttcctcccgatctccccagcctccgccgcccaccccatttcctcgacagttggattcaaggctggtgtctaccttgtagtggggacccagccgccgggcgccagagcacccagaccccggagtccagcagctactggaggacaaggagcaggcgctgtcctttccgcaggagacagtcagggtgcaggcgacctggcacccttgttgccgggacaccctgtggctgaaggactgggaaacagggcctgtgcggagccttgcagagagggcatggccttcattttctccagccctccccaaaatgcagacatttgctgagtacctgtgggcaccagctcttatcacctggcggtgctggctggcaagtctgcctggctgccctccagccagagccgagccccttctcccatccccaaatgcacagaagacagccagagagccagggtcctgggcagcacctgcccagcccaagactccacatgagcacttagatatgcagtgcacacctggctctctgcacacacctggttctcaacagacacctggctctccatgcacacctgctctcagtgcacacgcggctctgcagtgtacacctgactctctgcacacctgactcagtgcacacccggctctgcagcgcacacctgactctctctgcacacctggttctcagtgcacacccggctctgcagcgcacacctgactctctctgcacacctggttctcagtgcacacccggctctgcagcgcacacctgactctctctgcacasctggttctcagtgcacacccggctctgcagcgcacacctgactctgcacacttggttctcagtgcacacctggctctctctgcagacctgrttctccgtgcacacctggttctcagtgcacacctggctctctctgcagacctgattctccgtgcacacctggctctctctgcacacctggttctcagcgcacacctgctctcagtgcacacgcggctctgcagtgtacacctggctctccgtgcacacctggttctcagcgcatacccagctctgtggtgtaaaccaggcttgacaggctctgtggacccatgcctggctctgcaggtgcacacctggctctttcaccaggggtctccagttttcctgcgtgcaggaagccccttgccatacctgcctcccccagctccagccatcaggacccttaagggatgctggatgggagcccggactccacacagacgttcactccaggcctgctgggcagtgcacggccacatccggaagaatccctctcaccccaggcacctgcctcgggcacagtggccacaggagaggcctgctgactgcctcctaaaccttcctatactggaagcacagactcagccagtctccagcagcaaacaacgtgacccactgtggaaaagctgagctgcctcaaaggacgtttcccaggtgaagcccaggaatgacggccacatatgggcagagctgggtggcaaggggcaggcctgtgctcagtagactcagccggaccagggcccccatgtggacccaacgccactcgccggtcatcccaacagtgtctctcgctcagagacaaactccaaaggccagggggtctctgctgactcttccagggcatccatctgaccccatgctgtgcaacaactaagccagggccctccgtggagtcgccttaaactgcagcttgagctgctttccctctgggtgtcatgatgcagctgtgattcatgctgccacacgtggatcatggaggccgtgactgggaagccagcagcytcacttcctgccaccactccctctctgccaggctgcggtcaatctgaagccacaaaatgacgtcactttcctgctttctccagaaaacagctcatccagatctgggcacccgctcaggaaccgcgatgtcgacatcatctccaagagccccttcaaccccgaggccccttgggcacagcctgcacacctgccccacacactctgtcctgtgtcccgggcccctgtcttgaggttctgccctccccggtgcccctgggccgagggcttagtcccctgcggggtctcaggaaggaacttcagggccacaaacctcaggagggttccaaagccgcctcaggaggcgaggcgaaggcagctgagagcagccgcttcctccctgagccagaaggcaaggccccctccccctgcacggccagctgctgcaccgccctgcaggggcactgaggcacagccctctccacccagtgtccctgcagtgcataggctgagagggcggcttcccaaagactggcctggtcaggtgtggtcagctacccggggccgcctgttcccagagcccctctcgaagccaggccagggctgcctctaggaaggggccattcccaggggagcagcccctcagtgccacagtgggctggggagggccacggcgggtgccagcccccagggtccgccgcttccccgctgtcagggggactcggtcctggctcaggagtccgggtcatgctgggtcatgcacgtggcaggctgcaagcggtgctcctggaatcaggagactcaggttttctggagtcactgcagtgacccctcagagacagggctcccacagcacagatttcagcaggtcctgcagctggggctgggcaggaagtgctggggaagggcctggccgagaagcccgagccaacccaggcctaggcagcttctgtcaggagctgtggcagtgccagaccctgccctgccaccccgggtggtgacagcacaggccaccgctcagctccaggtgcccccacaggctcatgcacacacaaacagggctgcctgccacctgcgaggaacctgctctctccagggactcagaaacaggcgccaggccagagacacaccacagccagaaaggcaggtatcaggagccagcgggtgcttggtgcctggaggccacaccccagacacccacaggcagggccggctcacccgccggaagacaggcccaggaggccctctgcagggtccccaggatgaccagggccctggtggcatgaggctggtggagggtgttgaagccaggaaccctctcgatggagtatggaccccatcctggctggaggagaggttgtcagggcggggctggcccttgggaggcaccacaacccctgtgcagggtaccccaaccggggagaagccaccaggccacgctggagtgggagccaggacctcagcgccaggtccccaccgcgtctgccgtgcccacccctagagggtgctgaatcctggcccctcccagctctgggtgtgtggtggggaggagctgcttctctccgtcctcacccggccttgccctcggccagcaaagaccgcagaggagagtgagacccttgggagctccctgggctcaggggttctgagtgcctgtgctgggaccttggacggccaagacaccgcttgacttccaccttctgtcctctggcgcccgcctgcacctggtcctctgcctgcccacgcggccagctagaaagcgcgcgccctccagtgggaaggagagcaaggagtaaaacgtcccgccagggagtggggagtgtcaggaaattaggaggaagtgtcggggctgcggcttgccgggatgtaggagcacaggccctggggcagaggaggggcggggggagccgtgagaggcccggagggagcaggggaggtggagaggagctttccccagtgaagctggcaggaagagtcccaggtgcaaggagcgcattttagaattccaggactcgggaggaaacctgcaggatgagggctccccttgggggcggcctgcatttctcagcgggaaggtgggtgtgggtgcccctcacatcacctggcgtttatttttgcatgtgtgaaatataacaacaatttcctaggggaaaacaccctagggtgcacaaaagttgtaaaaatgggaacatatggtccgaaactcactgctgaataatgtgctgtcatgaaatttacttcaaaaaccccctcacggagtacaatcttgggtagatgaaggagaaaaaaagtaaaaatgaatttaaaaatctcttaaagcttctgttttttgttttttatttttgagacagatctggctctgctgcccaggccggagaacagctcactgcagctggagccgttctcccacctcagcctccggcacgtgccaccacgcccagctaattcttttcttttccttttttttttttttttttttttgagacaggggtctcactctgttgcccagactagagtgtagtggcacaatctcagctcactgcaacctccacctcctgggttgaaacgattctcctgcctcagcctcccaagtagctgagattacaggcgcccgccaccacgcccggctaatttttgtattttagtagagacggggtttcaccatattggccaggctgctctcaaactcctgacctcaggtgatccgcccgcctctacctcccaaactgttgggattacaggcgtcagccactgcgccttgcgtaattcttttcattttttgtagcaatgggggtctcactgtgttgcccaggctggtcttgaactcctgggctcaagtgatcctcctgcctctgcttcccacagtgctgggattacaggtgtgagccactgcgcctggccagcttctttagatcaagctgtaaataacttcaaatagtaaattagtagagcagacacgactgactaaaattattagcaatgaaagcacaa

SEQ ID NO: 17626 - DNA, 15531 bp, Homo sapiens
cgcccaggctggagtacagtggtgccatcttggcccactgcaacctctgcctcccaggttccagtgattcccctgcctcagcctcctaagtagctgggcctacaggtgcatgccaccatgcctggctaatttttctatttttagtagacacgaggtttcaccatgttggccaggctggtttgaactcctgacctcaagggatctgcctgccttagcctcccaaagtgttgggatacaggcatgagccaccatgcctggcctaaagtcctttcaattctaagattttttttttgcccaaggagcttatctgccactattgtttccaacatgtccttggcccacagcttagagagtctggtcttcttaattatcttttcaagtgtttatgacttagttcctcagctagactgtgaaactacttaacaacaaggactgtgtattgaatgtctgtgtcacacagcagtgtaaatgctgggtaaacactcattggttgcctgacatagtaactcatgctttaagccttcccatagaagggtgagagattgggagagtggaagaagaatgatcactggccttagaaagcagaaatctggtcccatttctgcccatcttttctcatttctcatcctgcaggcatctgagtcttagacccacctatcccacttcctcaagaagcccttggtggaactttgcaaatgaccaaagagggagaattataataaggttgttagtttccagagaacattacacctaagcttctccacgcttgtaatggagggatggatggatggatggatggatggatggatgaatggatggatgaaagggtggacagaagggtggatggatgggcacatgggtggatggatggttggatggatgatggatggatggaagaatggacagatgggtagatagatggacagatgggtggccgggtggatggatggatggatggactgagtcaagtaatgtcaattagagacctgagtgttctttcctctgtgctctactcacactatcatatttcctagcagtccatggcacatgatgtctgctcagtctcagggtgaatctgaggtcaatatctttgcagttgggtttccctagatgttctgtcccatcaagctggtaccaactaattaaacccactgaaaagcagagactcccttctcgtctttccaaacagagtcacactcacagtgctatcagccccttctcttattctggctgtctggccacagcctggattccggcatcagaatttgttctgtccttgggcttgccagacatactttctcttgtattcaccacctcttcaagcctaggatggagccccacggggcaccaaagatgtctgaccccagcactgtttatctggctgcaaacccactaataacatagtcaacgacagtcagtacagagcaggggccccataccttatttctgccaaggctttatggatgactctctcccccttcaacaaatgctcmttaatgttcccaccatcttattattcatgctgtaccaaagacattgtgaaatgcccaggctcttcttccttcatgtcctgcagccaattatagagattggtgcaggcctgacccacctgtaccagacggtataaacacagcgcaatgccctggagaaatcagttggagtctccagggatcagggttccaggaactcaggatctgcaggtcagtgatggacaggcaatattctctctctcttttctttcttttctactctctcctgtcaatatctctggtatgccctctatcccttcactcctcctggcaagctgtctaggtaacaaggtagtcccctcatatgacatgatgggacatcaaaaacatttaggagcacataaagagatttgaggagaaggaataggttaagccaaatcaagatttctgaactacttagaacaactgactttagaaagtaatctcaaaagaaaccatctgggccaatggtattcaaaccgtgtttggtggaagcttaagagattttttgttttcgtttttttttttttgtgctccttggtagctcctcagtgtcttctttgcaggcaagagaaatactagcagggttccaaagtctccattgcttcctgtgtcagcaaagcagctgccctttatcctttttacaatcattagaattctgcataaaattttattgtgaaacttaaaacagttttgaaagataccttactcaatctttccatccaatgttgataagttgaaggcccagggataaaaggtggcaaaataaattggtagcagagctaggtctaggactcagcctttctattcaaagtctgctctgtgtgtttctatgtcctggccacaaggaccagggtagttcaattagggtggttggagagagcttcaagtgagctgtaagccatgcttcatgacttcaagatcttataaacttttataagggaaacaaatatctttatgtacaacaataaataatacagtaaaatttaataggagttcagagtagagttacaatagtaagggaaagattcattaaactctgagtcatggaattataaatagtttggcctagaaagaaccttcataaccacataatctaatcccatgaatgtatagtgctgaaactgagggttggaggttaaaagacataaccctgtatgtctaagctgtaactctacactggtaattaatttgatagaactagatactgaacccatctatactgatactatctccagtgatcttaatatcaaaagatctgaatggatgacaatgagaagggatgacttttgaggcagggagaacaatgggacacctgtgagtacgtccactgagaagataagaaaggaattatgtcgccaggaggtgtggtttagtgtccatggagaagtgagatgctatcacacaagaaaatcagtgccagacggtgacaaaacagtcagtcactgtagattctagagctgggcagggatgtggtgaaaaaatctttagaacgtgggtccacattcctcacataggttggaatgaatgaaaggcagaaaaaccgggaatacaagtacagtagtaatggcaattaaaaacacaaagttatattttaaagaaataacctgtagggacttgataagttagacactgagtcaggagaagtaggagatattgtcaatgagtctcaggttttgaatatcactggtgagaggaatattatgacagtgagagaaatgaaattgggaggaatgtgtgggctgggaggagaagataattaacttaaccttaaatatatttggttggatatcagcaggatgtccaaagtgggctgtcctgtaggctgcaggaggtaaagtgggatgtgcagtctacatttgggagccattagcccaagataatcattgcagctgtagaagtcaatgaattgcagcttaatatgatgtgaaatagaagtgcttaggaccttgttagccttaggggtggccccagaaggaggtgaaatctacaatgggagaaagaggtgtgaagggagtcattcaatgtcaagggttccaaggaggcaatgactaaatatcaaaggaatcaaaagaatctctggatcttgctccacagaagttaatattggtcttggacagaacatcccacatagatactgtgcaggagaatgatgaaggataggacagggtgctgtgcaaaagaacatggggaaagcccaagtttagctgatggcagtgtttgagccaggacaggtgaattgcggaggtctgagagccagatgccatgtccagggagaaatgagaggaagaaaagagggatatagactgaagttcagtgaaaagtcatttgaggaaaatagggaggggaagctttgggggtgaggcatgtggcacactgggaggggcttggcacacagcagaggttcagcaccaagacccaggctctctgatggaccagacgctagcttcctacccttactcacttcatcacaatctatcagaacccaggcggagggagccgaataggggagcctttgggaaagacactgtacattttggctgtgccagaatgggaggtttctagggcccatgggatccagctggactggaccagcattgaatttcttccagctctttgagctgacactgacccagagtgggagtcatcagcttgctatccaccttcacccagggccctccactttgttgccccayctagatctgggcacagctaccacactgcccactgtcctgctgctacaaccaaagaagccccagtggtttggccaaggggagcccatcatcaagtgggcttgcattgaggccatgatgctgttgagttatctgtactgggggattgtctagtcctttaggactcaaagtgctggccaggaggaaccagcagcattgacatcacctggttgcatatttgaaatgtacagtctcaggccccaccccaggcctgaaaaaccagaatctgttattttaacaagaactgcaggtggtttatatatttattaataagtgtgaagaatggaatgaaagtacaccagttcccaagcagcmtggctgattgctggaatcactccaagtcctactgaattagaaccttcggcccaggaaatagtaattatacagagtcccccaggtgatgcagatgggcaggcacatttaggagccaatgactttaactgaacacttcatttaaaaaatgttgaaacttacttgatactacaaaggaaattcatgttcattataggaaaatgttgatatgtttaaaaaattactcataaagccataggtaagtggtgcaacaacacgagtaacatttctatgtatgtgtctctatgtgtggatttaaatagaattacagtgtacacttgatttataatctgcatttttcacctaatatattttgaaaatttttatgtcctaaaacaagcttctataatatcatctttaacaaacacatacatccttatttattgaattttgctataatttcttagccaattacctattactgaaaattcagatttttttcaacttcttgctattgtaaaaaattatgcagtgaacatttttgtaagtaaacatttgggcaatccgttatttttcctaagagtaagggaaacacatgcaatcacaaagtatacagaatgctttaagactttcattcacagcaccaacatccctccagaatttgcacttgttagtccctattatccttcactctaagtctcaaagtcataccccaaggcctggggacagaaaatgacttgtccaaagtgacagtgacagacccagtactaaaagccaccttggctacagccctgtttctggaacttgagagctgaggtggttggaagccgtatcctcagcacccacctgttccttctcacctgcctccccagggtccctcagcatctctctattcctccctgagccctattactttcttccacctgccttcttcctttctcttctctcattttctgctttcttatattttttcttctctattcccttcttatttggtgagaatcagatctactcggtaaacctcagccctagtcatacttgcgttactttcctgagctaatttccaactcctgattagctctgggtttatttccatgctaaattctggactggcctttccaatgggtgttcattttagggaagagctctaggacaggataacccatcgggaaggagcagagtcatgtgaggctgtgtggcctggcatttatacagggccactatcttcactgtgccattttccatctggaacagaatgggggagtttggatgggctgttttcggcagtcttggccaagcacttctagtcactaggaatgatgttttccaactctctggggagaccccaccagcctcactgctgctggagaccccttctagttgtgctctcttctttcactctgggctctagttatctaacccttggctagttatgggggcgggggtgtggtgccctgttggccaacagggcagtgggactgggtttgagctgggcttatcctccaactgtgagggaggctacagcacactccaccccactctcagggctgggaattgttgtggctcagctatttgggggaatctgttttccagtttctcagaaccagcgcaagcacacacatcccaggctcacacccctggtggctggacttgctcccggatagcctcagtcagggagaggcagagctgcctggagcctgctgggctggtggaagccttggtggattctggcaggccaattatagacgaatggcctggggaacccgtgcagcccttggctgagtggttctaagccccagcacgtctgcctctggcttcacccagcctccttttctaactgcccttctctcctccccatcagtgaggaccagacaccactgattgcaggaatgtgttccctccccatggcaagatactacatgtaagttgtcctggcatgtccctgctttccaagccagggggtcagggtgggaagaggaaaggaatgctgagtcagaggatgaggctccttctcaccttagaaattgcaagtgccccataattaagcttcatcatcaccacagtagcaacagctctttcctgaacgtctgcaagatgccagccaatctactgcctcatctctgttccaaaaagtctrtaagtggagtgttattaamcccattttacagatctggaagctgaggctcaaagagggtaaataacttcccccatgtcacacagctaccaaaaggcagagccaggaatcagacttcatgtcctctrtgctgctccatccgcctctctgaaatgtcagaaagttttgaatctcaatgacagcatcttgatggtggtccctgtggcctttactcccagtgtgggcttctaacamttacttacatttcatctcatttgagatttgcatccttccttatcttttactactttgttgtctgtgattttgtcataagctcctttcaggaaggaggtgaggcataagaaaaatcaaagaggactctgggaygcatttcctctgcycctcccatggaccctgtaatgtccagggctgtgtcctggacaaggtgggtggggagcagtcctggtctcaaggaggtgacagcctggctgggaagcaagacacatacataggaagcacataaatgacaaagcagatgtcagcacttcagggcatctaatctgggttctggtctccaaatagaatgctgctggcatgtgagttgtcacatctgggttgtcaaggtggcaaggggaatgccagatagcacgcccaggatctttccggaagtttatttttattgtacaagtgaacctgctttaaatatgtacagtcattagctaagggtattatcgttagctgttattgagrtagaaaaatcccctggaggtggtggaatttgtccagaggttctgccctaaaaggttaatgagagctctccagccctgacagcagctgacaggcatctttgaaaccaactaggtgactgagctaataccctgcatgactttgaagcctttaaaatatctgaaaagcaaatcacacttcagtatacactcwatctctgtactaaagagaataaacatttataaacaattagggcaggcccaaaaaatttaagataaggtccactgtatcccaaagtcatctgagcctcactaagaaatttctcaggaagccaggaacattttctttacccctctgtcagagggcattggctctccgttctcctctgaaggcctccccaagccatgagaaggcaggaagcacagcctctgaaaagcaagaacacaggagaccttccttgctttaaggctggcctggtctttacctgctcttgggagtgaccattcccctcttaccacctgtgaaggagagaaaatcgcccaaatgctcaaggtggtgattcagagcatggaagtggaagggcttgggggccagtggtgcataaagggaatgggccatcagcactgtcatactgtttcagaattaaatatgcagaccagaaggctctatacacaagagayggccagctgctggtgggagatcctgttgcagacaactgctgtgcaggtgagcttctggggcctccaccccatgctccatctgccataggccctcccttctcttcttccctttcctccccagcagagkgtcagcagctgcccccagtgacagtgagaagggccagagagcagctgtggcmtctcctagygaggggacatgactccygcagaagtcctggctcaccgtccagtctgcatgcagggccaggccaggtgtgcccatgtccagttccttcctgcctgagcctttacctgccaagagcctgcaacatggggttcccttgtcccttgactcttctctctcttccctcctagagaagatctgcayacttcctaacagaggcttggmccgcaccaaggtccccattttcctggggatycagggagggagccgctgcctggcatgtgtggagacagaagaggggccttccctacagctggaggtgagaggcctctccccattctaggggacactgcagacctggcctgacccctgggatgctctggcatctttgtgcctatctgtggattcccagccaggtccacatgtcctacttcctcaggtttccaccatctccctctgcacctagcaccaagacccttgccctctagaatctgcagaaggcagtcccttgggtaaaaaccagccctgtcaggtccttttttggccaagccccagaggcctccagggctaacacctccatcagcactctcattctgcagccatccaccttgcccccacaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaacyaagctcatcctgctcagggtctatggtaggcagaataatgtcccccraaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaacctctaagtttgtggtaacttgctatagcagccatagaaaactactacagagccttattcgaccctgtgtccagtgtttgatgcaagagacttggtgagttcttagaaggctacctgcagcttctcctccagtccatctgctatggagcctctagaaacaaccaagaagccccaggcagaactcagtgtcctctgcacagggacaaagccctgggctgcttacaacttaaattctagctcaagtcttgtgattttctaccagatacttcacagtgaatccacaattccgtggttgactgttggtacagtccgctatctgccaggtgcttaagtagtagcaagggccagacaatatgtgtgtcctggatgtgttgagtttaaggttacagtggagtctctaagttgaggtgatttgatatagctgggagtacagggctggaattcagctgagagtttgcaattggaattcatactcatcctcagagctcaaacgcttctctgtttcatggaaaatatttgactgggatcaagctagagcagaaagcccatggtatcaggactcagagaaggcacaggctgctggcgctgtccctctgttgtataactactyaacattcacctagcgtgttctgagttccaaccatggggcagcaattttaagaacattctgttgtcatcctcagaatgactcttcaaggcaagcattttcacctccatttgacagatgaggaaactggactaagagaagtgaaataacttgctgaaggtcatatgggctatcagtgttggagctcaagataaaacttggtgcagctgacctcaatgccattttgcaaatttttattccacttaaggagctgaggatagaatggtgaataaaaccaaacttccttgtagctgataattgaaagggagaaacactaaacaagcaaataaacaaacaagaaaacagaaagggcacttttcatgattagaaggtgagggcagcaggtattcaatggaaatattagatgsgggggtcaggggaggttttttttttttgttgttgttgttgtttttttacttttttgaagaggtaacatctgcactgaggttatggacaggaaggaactgtgactagaaataatcaaggcaaaagagtagcaaatgtgttggccctgagacagaaaggagctggtatgttcaagtaacagtagaaggctggggtgggggctggagcctggagagcaagggaggagtaggcagtgagcaagaccagcagggttgggtcatgtgtggccttgaaggcaaagtacaggcttccaagtattaagtgtgacgggagctacacgataggctctgataatgtttaggttctttctctgagctgcctctccacagcctgtatgtgccccgggaaattgatcacctggctggcccattataactatgtgtttacatggtgggactcaattttatgtcagctgtggccagaacagctgctggtaaatgcagaagaggctgagtaaatgcaaaatcttaaacaagttaatggataatcacacttgattcctattcctcctcctcctcctccccttcttcttcttcttcttcctcttcttcttcttcctcttcttcctcctctcctcctcctcttcctcctcttcttcttcctcctcctcctccttcttctccttctcctcctcctcctccttctcctcctcctcctcctcctcctcaggacagggtcttgctctatcacccaggctggagtacagtggtgcaatcatggctcactgcagccttgacctcctggatcaagccattctctgcctcagcctcttgagtagctgggaccacaggcatgcatcaccatgcccagctaggttttttttaattttttgtagagactggctctcgtcatgttgcccaggctggtcttgaactcctgggctcaggtgatcttcccacctcagccacccaaagtgttgggattacaggtgtgagctgctacatctggccaatcacttggttcttatgggacattcatcatactgtgtgagaagagctatggtaccaggtagagacaccattgtagcctagaggtggagctggcagggagggctgggcagggcttcacagaagaaagagcatataatctgggcctcagagaaaaagcaggtgttttccaggcagagaacgcagggatgggcatcccaggcagaaaaactgctcaggaaggtgtgatgatggagaagagctcccagcacatctgaggtgagtcatcaatgtggctgggacccagggcttggactgaggagtggctgcaaattcacatgagaagatgggtggctcctgattgctaatgccttgtgaaggagtttttatctgggaggccccaaggaatcatccaggtatttcaggcaggacccagattttaatcctgggcccctcagatcagcactgggccaacacagatgctactgggtcctcagctcttctcagccaccccctccctccccttctccctccctgacttctgtttagcactgccccggggtcagcttccatgctgtgatttcacagtcagcctgacccctgcttcatcttccctgaccagttcatcaccttcatgcatgtgttgaaagacaaactttggcatattaaaattttaaggagtttatttgagcagagaatgattcatgaatcacaaggtgccaaattgcaagtgattcagggctccacccaggggctaccggaaaaccttttataagttgttcaggaagcaaaaggaagaaaaaaattcattggttaagtggaaaatccttagttgcaggttagtcggcggttcctgattggctaagcttaagtttcgttttcttagtcaatgaccattcactctgggttgggttttagtttacttaggcaggaacccaacacgctggagttatctcagcctaataccttcccaattaattattttaacacatggtaactcatttctgctggcccttcccttgtgaactgtgcccatggaccacccaggcaaatgcaggcctcctcctacttactagtggtgctgttccaagttgaatcatgttctctatataactaaaaaaaattttcagcatgtaaaatatgccaattctctaacagtgcacagaagaggaagaggacataaagacttagaagacatgtctctatgactgaaggacacatagtgcagatgggaaaaccagaccttgtgaataaaagctcatatttattgactgcaagacactccaaatagcacttagaatcaaattctgcaggactgtggtagaaatagtgatgggactttctggcactagggtttaaaagtaaggaatggaggcaatttctgacaggtgcagttcagcgatgccaagagtattcttctcccacgccccaaggctcattccttaattccttctcctccctagaaaccacaccaaagtcttcactccaaaacctaaccaggctagagggttattattatgtgaattctagggagaggtacactttakgtcttatccactatttacatctcagaatgaactggtaggtccagagagagagcaaacaggcaattaaacacagtgtggccagctttcggtcaggtagcaccaggagcagggtgggtggggagggtgaatgtgtgtgtctgtatgtgcatgacgtgtccatgtatgtgtatgtgtgtgctgtgtgtgcatacgtgcttacaagagactccagatgtaggcagcagttgattcacagggggcctagtctttgttccaagaagctatggaacaacttcacacaagagggcgatgaacccagggtctcctataacctgtgtttcctaagtcattccaccaggattcagaatctagtcactcttccctttgacccaaattttcatctcgcgatcctaggcccacctctcgcatcacaatagcccctaggaataccggctcaaaacattgtacagaaaactccgcaggacacacaacgcatgtcagttctagggaaatctaaactcagatttaaggaggaaacagtaaaagtgaaggaaaatgcagacaactttaatggatactaacttttccttgatataattctctaaaatatacagctacttcataaatgaacttgacagaaacaagtgtaatgaatataaacagtaaagttaacatcttggactgaagcactggcattcggtttacctgaccttatttctggttggattttacatttgcataactaaaagggttcaccagaattctaccaaaacacagtctatccccagagcagattccaatctccgccctcaaaggcacagactccacgctatctagaggcgtgatccccctgcccatttctgaggctgggagcctgcagtgtggcctttgggctaaagatggcgacagagatcaacgttggcgctgcctttttggggctaggttctgaatgagctctaacatttaattcttcaaatacttagcagctactgtgtgtcagcccttgtgcctcaaatccccgcctcacttacagtagatgcatccttccacgcaatgcgtgagagtagaactggatcctgtgatgacttcaggaagtccgggtgtccattctgttgggtaacaatttttgttagctcccccttgtcacgagggacacagcccctgctctctaggagtttggagcttaggagggaaggtagatattagacacatactcatttcgacatttttcccacctatgtgaaggagcatcacacgaatgcttgatcccttctccccatgacagagacgttgctgtgaatctgtctcctgtacactcattccctccaattcccttggatgttcttgcccaggctctggtcacagaattgggtgacaaaggatgctgggagccttgagttctagcagaggctcttccatactggaatatttctcacagacattttctgaaggtccatagtcacaggacccatgatacaaaaaatagcactggttatgtaagtttgtctgcataaaggacagcagacgtaggtatcagctagttatgcattttgtagactggttccagtgcacacattccaatgagtgctcataggtttatgtgagaaaatgtgttatttttgataccttcttccacatgcctctccctgttcacaccctctgcttcagacactggtctcctcacaattctccaaagacacactctaggcacgatgctactccagagctccagcagtagccttgtgttttgaacacttgttccccaattacctgcctggcttgtttcctcagtgaggcctacgctggttacccccgtgaaaactgcaatatgcaccccctcaaatctcagcacccttagattacctatggtactatcacattctaatacactctataatttattttttatttactgtactttttttcctttatcctccactagaatgcaagatccacgggcagaggattttctttttgccttgtttatgtattaccagcatgtacaagcatttatgacgtgtcaagcactcagcaacatttgctgaatgaagaaaagaactcaaataggattcccaaaagggtcctacttagaggtcatgctctgcagagactagcaccagggcccctgtccagatttattaggaaagactgtggcatcaggtgggagtagtgggaagagggtctagtctccagaaggagggctggtgaggggtggacaggatatcagggtttccagtcaatatctgaatcactttgcatgrtgtctcagttatctattgctgagtaacgaaccaacccacaatgcagtgatttaaaacatcagtgattcattattccttctgattctgtgagttgactaggtggttcctctgctgatcttgccagggctctgttgcactcagctggaggctcaactcagctggaaagtccaagatagtctctcccatgtctggctgttggtgctggctgttggttgggggccttggctattcatgtgtcctcc

SEQ ID NO: 17627 - DNA, 13328 bp, Homo sapiens
aatcatcgtggaaacggatgctccctatttcctccctcgccaggtaagggggtcttcaggctgagtggaggcaccggagggagagggtggggaggtgggtggtcacccttacaaggttggcagggccagagccccagtgacttccaggtcccatcctgggctgtgtagatgcctccttgctgttactctgcagaaccaaaagtctagggggctgagaagctgaagggtaaccactctcttccaggcagtgcaaagccctaccctgtagagggtagtccaaggaagcgtgggaccctgctcacccagagcccccatgactaggactctccctgcacctgcaggtaaaggggtctctacagggcagccccaaagaggtccttgctggggaagggacagggagggagttctagattatgactgtgcacacatggcacaatgatgttatgaccacttgatgtcttccaggttcccaaaarcctttgccagtatgcccacccgggcctggccttgcatacggtccgagagattgccagagtcaaagatcagccactctccctcaccttggctgccttgcgtgagaacaccagtcgcctctacagtctttaagcagagaaggtacagtcctcgggagtctcctagaaaaggtcgtaaaactcacattctgtattttttaaaaaccaggacaagtcttttgttgcattttgttaatgtaaagaatataaacatagtatgagcattaagcctgatttgttttgagtgacatggtttggaaccttcttctttttctcttccaccctccagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagtttgtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaacccagtctctccgtgtttgtatagacttacctgagtgatgcagtggtttagtctggttgttggccagcattgtaacccaagaatccaggtagctggagactttttttctttcttttttttttttttttgagaaggagtcttgctcttttgcccaggccagactgcagtggcactatctcggctcactgcaagctccgcctcctgggttcacgccattctcatgcctcagcctcccaagtagctgggattacaggtgcctgccaccgtgcccggctaattttttgtatttttagtagagacggggtttcaccgtgttaaccaagatggtctcgatctcctgacctcgtgatccacctgcctcggcctcccaaagtgctaggattacaggcgtgagccaccgcgcccggccagctggagactttcttgagtatctatgtggctctctgtaaaattaaactgcatataagaattcttaaagttcggccgggcatggtggctcacttctgtaatcccagcactttgggaggccagggcggacagatcacttgaggttaggagttcgagaccaagctggccaacatggtgaaaccctatttctactaaaaatacaaaaactagctgggtggggtggcacgcgcctgtagtcccagctattcgggaggcttaagctgaagaatcacttgaacccgggaggtggaggttgcagtgagccaagatcgcagcactgtaccccagcctgggtgacagagcgagactctgtctttcccctccccccgcctccccccagaaaagaattcttaaagttctacagccttagagtgttaagtaattttactgtctgggaactcagatgcactgcttctttctgacctatgtaggtactttcttttcttttttttttgttttttttttgtttccagctcaaggctgtaggaggaagaaaaatctagtccctgggggtactgatgaatcagttggatggtgggcgttggactgtgaattcctgatgcctctgggtaaactctggaggaaattctgtttcattacttgcactcagccctcctattttgtactaaggtattcttgaatacaagtgcaccggccaaaaaagtaaacttacgcataaaaagaaaggctctcttccttccaagaatgctgaacacctttgaagtctctgttgctgcctcatcttttagatacaatcattgattatgtatttttggcatcgtcctgaactttgtttcatttccttcacagttgaatgtgcagttggctttgtccactcagtgatggtccttgtgactgttcttggcttttctgttgtttttccatctttctataggaagcttgagaccgatactcatcgtttgctttcagcaccttaattttgctttgttcatttttgtaaagtaagggcaaatggccaccggaatgtacagtgattaaagaagcaaactctgtcaaagatggtgattagtggccagccagtccctctcaggatcactgtattaaaaagtgctcatttgccagtgacatttttttttggttttggtttttttttttttttttttttttgagactgagtgtcactctgtcgcccaggctggaatgcagtggcctgatctcagctcactgcaacctccacctcccaggttcaagtgattctcgtgcctcagccttctgagtagctgggactacaggcgcccaataccatgactggctaatttttttttttttaaattttaagtagagatgagattttgccatgttggcctgtttggccttatactcctcatctcaggtgatccacctgcctcggccccccaaatgccagtgacatttgtaggtggattcagattaaggtgggtagcttagttgaggcgtctcaacccttttctgtgcactctctcaagatgatttctgaacacacaactataagtgcatgagaacttaaatacgtgtgctcttatgctaattatacacaaagtaaaagttttttcacaaggagaatttttttctccagcaaatagctcgctcaccctaggggtacatacaccccactttagagaccctcaagttacagtggtatcattaaacgatccataaaggagtgggtttaagaaagctgatacaggaacatgtttgaaataatacattttctcaagggtgtcctccaaccattttctttgataaattatatttctgcccattgttgacttgaaattgtcctcacccctctaccaagttcacccagtgtattctgaaggaaaatgaatgaatatggaaacctctctcatcctaggcagtagagcgagggaagctgcactggctgagaggctgtggaaccggatgaaaaagcagcccctgagtcctgtggcgttggctgtgagtcggccacgtgcttgctgtgtgctttaggaaagttacttaatttctctgagctttagttttctccctcataagtaggcttgctgtgaaaatgaagtgaaatcacattaatctgcatgagcatttaacacggtgcctggtgtacatcaggggtgtgacagtgagtgctggctgctgtagtaattgaatgcttagctacgtgccgggccctttgccagctacagctcatgtgagacctcatgttcagtcttggcagtaacccagcaaggtaggcattttacatgtgaggagcctgagaaattcagtcttggcctggatcacagagctggtatccaaattcaggtccgaggccaaagcccagatctttgcactacaccttgttgcctggcacaggtgagagtgcccagcccatagtgggtgcgcaatatctgtttctatttgaatgacccaggcaggcggttaataatgcttgtgatttctttgagagagaagtaagttcttgtctttggtgggggaagcatcaggtgaccagcatttgtccagagcctggtacccatcctctcccaagcccaatcagtggtgctttctcaaaaagaaaccatctcctgaccactttggccatattgggcctttgctcctcttctgtagctattgataagagggctgtgggcagttagtgataatcaaggtcgtatcccaactaagtgacagagctgagacagttaagttccaggacaagtgtgttgatctctgtacccacttgtgccaggtgcctggggaggtaggggcatggctgtctgagggtggaggggtgagtagggggcctgcagtgtgctgtgacgcctgggaaggggattctaagccatttcccatcagccrtttactaagtagcctggggatcttgttaaaatgcagatcctgatagattagggctggggtgctgcccaagattctacatttctaagagtccctggatgacggtggcattcacagaccacagcttctatgtgagggagagcagttgggtttctgtctgcctgccgcacctgatcagtagttagtgcctgcatgtgtggcggccagaattttacttggggagacgctcggctcctagcaccctctgtggtaggggttttccagagtgtgggcattaccccaactgtctctgcagacggcttcctgcatgtttcccacaagcgctcagatggctgaattggcaagtctgtggtgctrctctttggggccacctcgttctttgcctttccctccccttagcgatgtgtcccatccgttgcctacagtcaagtcagtccacatgtttaggctaaggtgggcatgaccgagtggccttcccccgggaagaccagtgtcgtaactggaattaagttgtggaacayaagagtcaaggctcgtgtctgctgtgaactggagttgagggaatgtttggggatcccacctggtatcagtaagggaaccayggcgacggccagccttgcccatgtgaggcatttgctttgtcaggccttctcagtagtggagaagggaggaaggagaatgcagctctttcagtgctgtctagcagtgcccaagagccgtgattgggcacctcacttaacgtctaacttcagattcactcttgggcattcctgtcttcctctccaatcttgaatggatgttggcttcgataatgtcatcctgaagtttctttgtccacacagccctggctggttgttaataagctgttaatgcagccttgcactcaggaagccctgatgtttaaaggaactgtgtctttgttcttcctctcttccctctttctcttagtcccactttatctcttctttctcttcctctccctcctccttttcccctctccctcctactctccccctttctctcctccttctctaagaaacccagtcttaattccacacaatgcatgcacatgcagtagcttctctgcttgagtgagctggtgtgattaggttttctaaacatgcacattggccttgctacttgtccttttattcccttcccacagaccataaaccaagaattatttttatttgtattattttgatttttttaaagtaaaatattaacttttcctctttgaaataaattcccatttggaacatcagcatacagtttgaacatttattcgcctcctgagcttgtacaacagtcgtgggagttgctgcagaagcaagcgaaaagccagatgagcgcttctaaacttagagagaggtgagtaaggcttgtgggcgatcacttgtcggctggggcctctggaaagcaagaggttgagtaagaatgctgggtgcaccgtcctgctagtgcttttcttccacggtggtgagattggaggtgggatgtaatggtgggggttgtggggaagcactggccttggagtcagagggcggcactcaagtgtggactgttgtgccctgggcaagtcacctcaaagctctgagtcttggtttcctcgtttgcacagcggggtgaatgctacccctgctgttccccaggggtgacgggtcaccgccttggtgaggacagtgctttgcagatgtgcaggtgtttctgccacctcaatcagttgggcggtttcttttttttcttttacaaggtgaggggattcaaagcaaaccctttgcttaactcaggaagctctaatatttgaaggaactgcttaacaggctgcagaacctgttctgagtgctattttggcaccaattcctttttgtttgtggagtaaagttacgcagtgaagacggtgtaacaccaaataattgtagactctcacaataggtaaaatagctccattttacagttaaggaagctgaggttcaactgaggccccaaagctagttaatgtactagttcttagaacattctttgaacacaaagactatgatgaactcccttctgagccactcacaaatactagccaaccactatcctgcagatctttgggaaagggaaattagaagttcttttggagaggcagaggttggggaaaactcatcacccacagagtgaactcccatgtggggctgcaaggaaaccgagcaaacccagtccaggcaggactcacctttggcctcttcccagaggatgtcctgaagaaacttccccagggcctggctgtgctgctggtactgaacccctgacagcttgattccaacatcaaagggggcgttgaactaggaggcagggcagggaggacccaggagatgtcagaggtcatgcccatccccatctcaaagggggctctgggctctctgcctctcttcaggagtggagagggagaatggcctttgggccccagcagggactgctgagtgacacctcagccaggttctcttcctttctcaggaccacagctcaccttcccactcaccatctttcagacacttaccttgcactctcatgcctctcagccttagcctctaatgggattgctgataaaagctgtggtgccccctagtgtgagattttttttctcccttgcagttttgaagacaaaaggttgagtcaccaatggcagcatttcaggccctggcagggggtctgcccagcattctcagcactggcctgctggccttctattccttccctgctcccagctctttctcctttctctcttgtctgtttcttctcctttttctccttccctaggtattttttctctcatatgcatagacctttctttgatgcctggaaaatcaaaaggaagttgatgttttcctagaaagaggctctgagccaagtcctttctgtgcttccatttcttcccctctacagggagagcgcctcatctcttccattttccaggtattcctgagatgatttattggagctcaaagctttgggtaagtgggaaggagctctgctgcagccacatggcagactttccttgagagcagagattgtctctgccagtggctacctcggtgcctggccatattgggcactgacttatctgagtcagggaaggatcttagtgctgggtcatttggtcctcacagtagaagcccaaggagttggaggccaaggactagaatgcaggacttttaaacccacttggccctgaaaactgctttagtcctattgcccttcctctgtgtgaggccaggcgtcctcagtgcctccctgtggggtaggcgctaccactgtgcccattttacaggtgaggacagaggcgcagagaagctattaaccaatagctatgcgttcccttttcgaaatctccctccccttaactccaccatgaaggtggacccagtggggaatgacatgattgaatttttttttttttttttttttttttttaaggagagttggggccttccattccctccagtaaatacttgtttttcttccaccgctgaggcaaatgcggggtggctgatcacctggcagacatcttaggaaacaggagcaccggtctgggaaactgctggcctggcctaacacctggcgctgtggtgcaggcaagtgagtggtgacacagtgctggctggtggggggcagcttccctcctggcctcagtggcccatctgttcaatgggagtgggacttggtctccaaagtcttctactctgaaacttgattttgggagggaaacgtttggggggaggtagaggggcctgagatgagagaggtgggtgggacactcggttgtgaggggtttggtagtggggcgctccaggtctctgcagccactcctcttctggcagccccaacaccccccaggcgtttgacttctggttccagccaaggcagtgtgggtcacatgctccaaggctagctttcacagaaactgcaaagttcccgctgtaccagccccaccttgcgtcgtcagccaccaagacctctttctcatctgggtactgggcagctcctctggctgggatgaccatgtgtggagctagccgtctcaccagcaaaatatcctggttttggcctaagggtatgcagctctttcagatgagaatctagtggatcccaccgtgtagaggaaaggtctgaacaccgccaggtgctggtgaggatgaaagcgagcaggggctgggggagcttccgacggctttattcctcgactggagaagagtatggtaaacaggcaggcagaggccaaggcgggcacatttcactcctctggaaggaagaggcctcccctgggccactgtgcgctgtctctgtccatcagaccagtgaggaggaagagggcttggggactggagtcagccctgaccttgtgtcgcgtcccttccacacaccgctgtggtaccttgggcaagtgagttcacctctgaactgttccttggctctaaagtgggagtaatgccagccctgcttacctcacaggttgtcgtagggaggaggtggggcagttagaggtgaagttggtatcctcgggcacagcgtctaatagctgccattattaagtgctaccttgggggaatcctgccttagctgcgaaatggtgtcaccaaccaaatatttagaagaaaccattccctgaaccacagccacaggaaggttgcatagaaaaccccgtaaaatcctttactccctcctcctctccatccttgggttgtcttaactttctccttgccccacgcacgatttgtcagagcacatcacccacacctgccccctccttgcctccaggcgaggtgagtgggtgccggagcctgggctggcgccagccctcccatccagggtgctgttcggaagcactccaccccacagtccaggccctggaagcccctgagtaaaacatggttttctgcagagcaacatcttcagtctgggcctgccgtttatttctgggtgtctttgtctctgggcactgtattttctgtcccctttgagtcgcctggaggctctggcaccctctctcctctgcccaggctccttccgtccctattctgttgtagcaaagttacttcttctagatatttttctcttaatgggtaaagacctcacagagcccagggcagagctcaactcctgtggtactggttttatagttctggggagcttgtagttgggaccctgttcactgccacctctccctgccctccctctcccctgaccccaccctcctcgctgccacagaagcataaaactgcagaggtaccgacccggacttccagttcatcctctgccccttctgcttgacctccatcttccgggcggagccagcctgctagagctcggggctgcagcttggctggtggcttcttcgactcctttctctgctggaagggggaaacagtctgtttaggactctaagcccccatgtccttccagaaacagtgaggtcagacccagagtcctttgtgctctgggagaagactgaagcccagagatggcgctgctgctccaggtcacagagctggttgctaagtggcagggctggaacaacatgtggggctttgtggggaggtctcacctggactctctggtgttcagggctcaggaagctggagcctgccatggccaagtccagccagagcatgccgaggagcaggaggctgcagacggtccctggggagggcatggcctcagctgggttgcagacaggtgggcctgggggagagagggtctccaggcagctgcctccccttctcatgtgcctctgagcttgctcaggtaggagcccagcagatggcgtgaagggctttaccatctggggtcctgactgctgtgtagagaggacccccgcttccacctcccaaggtagaagatgatggatgtgtgttctcttctccaaggccgttcagggcagaacacctggcagcaggacttgataggggctgggggtcctccccggtgccttttgtcccaggctctgagagctcatggcgagtcttttcatgaggagggaggaagctgaaccagcaagggccccagggcactcagcagggagggggttagaggtagctcctaaatgaagctctgtcttccagccagacagtccgacatcccccgtgtttagaggggactcctgaggcccagagaggttaaacggacgggcagcagtcacggacaataaacctgtcagcaaacgcacacggagagtagagagagcttacctgcagttcctggcggaggtggtgcctggtggctgtcaggtccttatataggatgactggcgtttgttctaaaccagcaaccccatcccagaggtggcctagcttccgtggggctgatgtacattccttgggaactaaaaatgttcttgtcctctgggtagaagtcaacagtggaggtcagatgccctgcggaattgctgggttggcgagggaagaagcatgtgctccagctgtccctggaacacggtggcggggtgccccaagtgggcatggccctggtggaggagggagggaggagagtggctctggggtctgggtgcagctttgttgctgtgtgaccttagcttactcgccctttctccctgggtaaaatgaggctgtcatcactaggagagctctgagacctccccagtccagcgccccgttgtttcccatgtgctgttgctgctctggcctctgtgagccccgggagtccgcagggagccaggctggtgattctacaccttcccgaggaggagtcccacctcccggttgagcagactgctcctgatcatcctctccagagagtgggtgtggggataacttcagccagtggctatgcttcagtcatttctgccaggtgtgacatgactgcctggcctggcgttttttcacatagcagcttgccttgcctccctccagcagctttggtccctattttagcggatgcctcttctgagagggaagtgcattggacctggaggtggaagatctacgcttagcacgggcctggctcctctctcattgactggccttacgccgaccacaaataattccccttacccagagtctttgagggtgaaatgaggcgatggggggaaagtggcttctaacctgtgaaacaccctgcagatgacaatggtttcataccaggcccataggacttcccagcataggccaaggccactgcctcatttccctcggccccaggaatttcttcctttctggagtgcttcatccaactgggtgcccaggcaggaacccctaagggcc

SEQ ID NO: 17628 - DNA, 23597 bp, Homo sapiens
agacctaactgggagttgtaactataggaatggcatttaaagccacaaggctggatgaaatcaccaagggagagagtagataaaagagcagaagttgcacagctgccggttgacagatcaacaggagacatgggaaattatgatttggtggttgtgaaatgtccatggcacatggaagctgagcagtccccacccagagcataatatggaggaggctggaggctcttgttacaatagtttggtcattttttgcagggcataaatccaaaactatgtgtattttatcatttggcaatacttaaagaatttgaaataaacccttttggagtaatgagctaaaaaacaaatatttaatggaaatttaagtactgcacttctgttgctcaaggaagttgttgatgagcagatagcttgcatagaacgtttgttgacatttgcatcactatggggtctgtagcaatttcactgattgcaagaaaacctaagacacagagctgctactttagaaattagtaattttaagaacattgcaccaggctgggcgtggtggctcaagcctgtaatcccagcactttgggaggccgaggcaggtggatcatgaggtcaggagttcaagaccagcctggccaagatggtgaaaccctgtatgtactaaaaatacaaaaactagctgggtgtgatggcaggtgcctgtaattccagctacttgggaggctgaggcagagaattgcttgaacctaggaggcagaggttgcagtgagctgagatcgcaccagtacactccagcctgggtgacagagtgagactctgtctcaaaaaaaaaaaaaaaaaattgcaccctaagacacggttctcatccatgtagctgcaaaagatgctgatataagatcattctgagaggcatgacttttcccttagatcaaatgactgttctttaagttaactcagctcacatttaattccagcttttcttgtgcacgtgcaacagtggaagtgatggctgactgtgtgttggctccataagaagaacatcacagaaagcaaaatggtgccagctcaacaccagtatcctcggactcttcagacagaaaaacctgttaattccaatcacaattcattctttcattcagctcatggaagccaagcagggctttgggacattcattctggcaaagtgaaacaactgactttttgtgaatgctatttaagttgtttaaattttccacattggaaataaagtcattgcatttttgtgaggataaaacacaaattgtggtggagtccagcgtcatggtaacaataatattcctactaaattaagacactaatgaaacagaaatgtgattggaacaggtcatggtgcacacacaatttgttattgcatataaataaatgtcaatattctataaattgacatttatagacgtacgtgacaaaatttacaaaatgttaaaacatatgcacagatttactgaactacaaacttgtgataaagttgttcatgaatttttttaaaaaactggactttcacatgtgttttctcttttattttcccattatcaatcaattttagtggacattgagtctcagcatcctaaaatgttattaaacagtgtattaaaacagatctataaattttcgttgaattttgttccaaatcagttggaaatatttagtcaagttattcaatgaatagagcagcaaaacgtcaactttcaaagcttttagtgaattataaatattgaaaacaaagctggtatgcagaaaaattataaaatgtatcagaaaatgatcaaaatcaaatgctgtacaagagttaattttgaaattctaaaatgagctctggaacatttcagcttgtgggaagaatctttttaattggataaattcatgttctgtatgaaatgagatgaaattgagaaagccaatgattttttttttttttgcagtatctgaatctgacaaaacattcaaaacttataagtaggtacaacttatttgaaaggtttaatctggttaaaaaaaaatacgtgtgggctgggcacggtgtggctcatgcctgtaatccctgcactttgggaggctgaggcaggtggatcacatgaggtcaggagttcaagaccaacctggccaacatggtgaaactttgtctctactgaaaacacaaaaattagccgggcatggtggcaggcgcctgtaatcccagctacacaggaggctgaggcaggagaattgcttgaacctgggaagcggaggttgtggcgagccaagatcgcaccactacattccaaactaaggcacaaagacagcacctgtgaaaatatctgggctaaaatatttatgcaattccatatgcaaagaattggacttgagaacagcctctgcctggcagaatttgctgagagcttatcactcagaacctgcacagggaacattttctcaatatattatggttcaagagaagagtcaattgaaggtactaatttaaatttgttaattgtaaaatttgtggaaaaaagatttcaggcaattatatggaaaaattaaaaataacaagaccccactgaagaaaatacattcttgtgaaaaatgccagtgacagggtatcagtcaggtacaagaaactgtagcatgtgaatatacaacaagaacaattattttgcttatcttatttttaaatgttcagttgattaacataaacatgttttcttttgctttaatattcataggtgtatgcatatatatttaaagacttttttgaaaatagtttttatctagaactactttataacaccatcaatataatataaccattttgttggattttttccccttccttccttccttcccttcattccctccttctctccttccctccctaccctccttccctccttccttccttccttcctccatccctcccttcctccctcccttcttccctccctcccatcctgctttccttccttccttccttcccttccttctttccttccttccttctttcctctctctttctacctgtaaatactaatttttgggggaaataatttttgactattggggtgccccggcagtgtgcacacacatggcctgaccatccctctcctagctatctctgatgatggccaggaagctgaggtctatggtgacagaggctggcaggtgggaatctgtagaattccccggcgattggttgggatttctcagggagaaaggaggcgaggtcctgacctgtggtggaggggctggggcattgagagtttgagaagagatgggagggtgttgagcactgatatggtttggctgtgtccccacccaaatctcatcttgagttgtagctcccataattctctcgtgttgtgtgagggacttggtgggagataattgaatcatggggatggagaacaaagccaagccaatatcttgactttagctcagcgagactgagtttgaactcctgatctccagaactgtaagataataacttgcatcgttttaagccactcactttgtgataattaattatagcagccttaggaaaccagcacgggggtgaggctgcaccctgcccaggaagccagagacgaccagctacgcagggactttagctcgaacctgattaggtcagtggacaccgcccccatccccaggacggggaggtggctggggccactgcagccacagcatgtgtctgctcacatggggcttatttttaaagggattgtcctcacctgctgctgtctgtgtttataaagttggctagagaggagaaatcttcctttgccagttttcagctttagctctgatatttgcctggaacatagtaggtgctcaataaacaatatctctggatattgttagtaatatgtgaccctatttgaagaactcagaaggggcactgggcaagtctacaagagatggcaattctgtaattcctgtgtggtattttctgaattctgcacattttaacctaggctatgagacagtgtgactttcttcaacaaattagttaattcttcaaattaactccaatttcaacagcatggtgatgttaaaggcattggaaattcagccacagatgttaaagaccatcagcacggtcacatagtaagatgctactttcaagccacgaataacccaaccagttattggtcttatgaaatcttgtaagccatcccagagagactaatttaatttttatgattcagaatttgcaggctgtaactggtcagtccatgcgaactctggtggctgcattcagccctgacatgtttcacctgactttgatataaggagctactggaaccttcctacgagttctaaaacctttccctcctcctcctgttctggaaaagcaattaagacccaaactaggcatgaaataaaagtctcttaaattgatttagaattatttttaaaaagtaccctcacagaagtggaaaattttgccaataggtaggtgtaaaaggaagttttttgtttttctaagagacacagatttcctctcatattgtactctcataaaagaaaaaaaaaaggtggtcatttacttactcaggcagaaaatgaaggcgttcacaactgtagttgggttttctgatagtgagagctgcttttggaggagttttctcttctgggaagtgctgtggagatgtggttgctttaaattatataacctccgctccagtgatgtcattgtggggattgccgcaaaagtgagtctttcgggactcactccaagtggatttggaaggaaaaatccactctcatttcactttgcactttagggatgataagagattattcagctaccatctccccctttactttggtaccatctgcagaggtctgcaatcctgcccaagacctgtatgttggcaaacacgccctaaaaacatgttttgacatcgccaacttgccccaaggctcgcaaagtgtcagtgaacattgagggatggcttttggccccttcactattggcttctgaatgtctggggctctgcagcagcttttgtgggagccacttcgaatggcctcttttgaattttggtcatgaaagatacatcgccaagaatccatcagagtggacccatcacacaaacagagagctaggaaaacgtttgactcatgcaatgttcagagttgagtaagaccagatacattttttcctaatcctccttggcgtctctcaaattatgtctgcatgggtcaagttgaactactcaagacctcatgtttcagacagtaagatatttttggctttgagaatcaggtgacaagattctccaactgaaggccccttacctgtcaacttacaaattaagatctttccaggccaccccctacacgtaggagaactcattcatgccagaattcaggacttcgagtctgacttctggaaaggtgaccctccaaatgtttggagcagaaggtgtcacctctgtctttagaatcttgccttttgcttgtgttccctttttctgctagtgacatctcagcgggagccaactgcacttcaagttttcctgctgtcttctcctgttgctgaagaccttaaaactgtggaagtaggtggaacaaatagcattctgaggctcagtagcggatgtacatttcagggaagaagctggaatttgccttagaggataggatggtcccctcctatcaggagagacctcctgggtgggatttttaataaaaaaaaattgtcaacaggcaagcatcttccattactcccgggatagatctgaaccggaggaaggctccaaatcttagcctttcctgttacttagtaatgtaggcgggggtctctccagcccgtggctggcttattctcccttcagtatgagtttagactatactgtttctgagaagcgtttgttcttaggagatgtctccctgtttattcacccaggagtgcgtataaggccagctctgccacaaagagcacgtgcaggtctcatctctgctttgcctcttgctggaagacagtctgtgaagagagctggcctgagtgagctggacttcggagatgcatctggctgccttgccaaggtggtggagggcggaaaggaaagttctttaagaagacccacgtttccccttgttgctcatctccacgggaaatgcgagacaggcccgggctcaggggagcagagggtctcctactgtctctggggccaagggagtggggctgagggcagggggaggggaccccaaatctgtgaaagaaaagcaggtccctatagtgtggcagaagatagcaggggactaagaagtgggtaggcactgaggaccctcttctgaggcttcgcttgccttttttcttttttttttgagactgagtttcgctcttgttgctcaggctggagtgcaatggagcgatctcggctcactgcaaccttcgcctcctgggttcaagcgattctcctgcctcagcctcccgagtagctgggattacaggcacacaccaccacacccagctaattttgtatttttagtagagacggggtttctccatgttggttaggctggtctcaaactcccgacctcaggtgatccacccaccttggcctcccaaagtgctgggattacaggcgtgagacaccgtgcccggccaatgcttgccttttctgaatttagttgtttgtaattcccacagcctctataaggtttggttaaaccttacagtctgatgtgtgctgtgcttgatgaagtcccctgggtacttgggtgaagaggtggtcacagaggataaaggcctgcctctggaaatagaggacaggccaaccttccctggsgtgtcctaaatactagtgagggggcactccaggcaggctggactccctgtagtatgcgtgggcttgggccatactggatgtgtattcaagggaaggtgagctctggagtttgyggcccctggggacatgcagtcccagtgcccactgtgacatcaagggccacttttcagttctctcatccatcagtcctggagtttttttctcctttacttttctagtcatatccagcaggttcttcaaaatgaaagactctagtacatgtcacccagcagacctctacaaatagcacccagatgctgagcctctccagggttcgttcttagtccttacacgacatctgatgtctccagtattctcccaattgtagacggaggacagaaagccacagctgggcagaattcttgccaggatgaaatgcagcaccctcactgtggtccagctcgtgtcctttcacccccgaccaaggctgttggcggtcacacctttcttcccatcacagggtttagaaactcatgcaacgtacatacaagtctgcaacaaaggactgtaaaccaatctcctggctttctgattcctttccttcagtctatccttctgctggattaatattctggaaacacctggattttgtcatgccacaggacaacgacccaaccccttggaattcaagagctccccaacggtcttgctgtaacacccagagccaccctccatgctgagcgagtgactcatgggctctgaatgcatcctgcttgtgagcatttgctgaaaatgacctcctcctcctcgcactgttcagtgttcatccatcactcaagtcctggtgtaatcctctgcttttctctaagcacggggcctgagtgctttcccctttattttaaaaacacatatggagcacccagctggtgccaggcaaatgccaccctagaagagcatgcgtgtctagcacataggaagcggggaatggatggggtgaacagacggtgtctaagtgtaaggggggaggtaagcagaaaatcccaaatatacatttagcaaagcacaaacacttggagatctacaggatgacagggtggacatgagcacgtcctgggcattcaggcagctccaggtgctgccatggcctggcagccagcccagaagtgaagggtcctgggtgctggctctggggtgggaaggtgcccacttagcagataaagctccactgggccaggggttcctccccgcccttgtgtggccctgctttgggagatgaaagccttctcgcccaggcagagcaggggatcacgagaccttcctctttagggagcctcgagaatcccaggagtgcacatgctctcagaaggggcttgtaccaggaaaatcagctgcatttctctgtctcctaaagccgaagccaggccgtctcacgtctcttctcgaactcctctgctgctgtctcaggcccaggaaaacagagaccttacggcggcaaggttgcacatgcgcagacccagctgtcccccagagcacatgcgtagacccagctgtctcccagagcacatgcgcagacccagctgcctcccagagcacacgcgcaaacccagctgtctcccagggcacatgcacagacccagccgcctcccagagcactcgtctcatggtgcctggctgccctggcttcctcgagctgtgttttttgttttttgacacaaggtctcactatgtcgcctaggctggtctcaaattcctgggggcccaagccatcctcccacctcggcctcccaaaatgctgggattacaggcactccccactatgcccagcctttcctctctgttttgaatgtaccacctcctctcccacctcagggcctttgcactgtccgttcccctacatggagcaccttcccatcgagagccccatgcttgctcccccaggtccttctggtcctcaccaatcctcccttgtcagagagacctttcctgaaataacctctcctcctcttggcctgctccactgctcttcacagccctattgccacctgctccaccaggcaacggatttatctcttttgattaggttcatcttcccaacttgtacaacagggctgataagtagcacgtgctcaaatatttgctgagtgtattcataactatgtattacaaataagtatataatagcaatagcttgtcttatgtcaacaaacatgtgccaaaccccttgtgggggccaggccctgtgtgggcacagggggtgcatagacgaacacagcccactccgtgcccacttaaggagctcttgggatggctgaggacagggacaagctgacatccagtgacaacatgttgtagaaagcagagtggcaatgaagttctgaggctgtgtctgagtgtgaggtttgaaaaaaatgagttctgctcgaggtggagtgggatgggtaatttatgtgtcatgctgactgggccatggggtgcccagatatttggttaaacatggtttctgggggggccgtgagcgagtttaaccttcctaggttaatttgaatgattaatgtttgaattggtagactgagtaaggcagattgtcttccctgacatggtgggtggcatccaacttgtcggaggcctgaatacaaccaaaaggagcagcaagggagaattggttctctccgcctggctgttttcaagctgggacatctgtcttctcccaccttctcgctggccatcctgggtctctggccttcacaatcccactggaactacatcactggtcctcctgggtctccagcttgcagacagcagatggtgggacttctcagcctccataattgcataaaccaattccttataacaaatctatctatatttatctattttctgttggttatgtttctctagagaacctcgactattatgcagagttggggaagaattcatggcaggggattatttaaactaggttttcagggctgaataggagtttggaaggcaagcaagctgagaaaaccatcgcaggtggggggaccagcatttgtattataacgcacacatgttcataagcctttgtggaaggctcacttggaacttggggtcagaaagcccaggttcaagccccacaccccacttactcacgctatccatgaatatcccatatcccctaccctccagcaggccctgtgcagctcttggtttggttcagggaagagaattgaatgatagttttagcccagagtaagggtgttttgagagagcaggtgcataaagttttgcagctcatggaagcaatttccatttccctgtacttggagttttatagctctaactgcatgatctattctaaagataaatgctcacggcaggtggagcccacctgcagggcttccagaagagagcagggccggtggtcctggaatgctctggtcctgcctgcttctgagagttgctgtgaggatcaaataactgtgtgggaaatgtcagtatcgtgctgtatagatgttcccaggataagatgaatatgtacatgttgatgcatcttttctcagtattatgaccttctttcttaatctagcagcaagtgccatatggaaaagctctttcatcatttttcaatcagcctagatgcctaattaagccatgtgtacagcaaagaatgggggtatggaataagatgttttccttagraaccagtagttcctttatgatgttttaaagagatggaattggattaccrtattataaagttgatgctgtgagcatttatctttcatataaatcatattggtccccatgatggggatgcaaaactccggatccagggaaactgaaattgcttctgtgagctgcagaactctgagtataggggaactgaaattgctgaagataaccataacttttcttgaagacttggggtcattctygactgtcccagccctcatgggggctacagacttgggatagagacagactaacagagaaacctgtacaggatygtgattgtgagttctatgaagaaacagaacaggatccagtggtcttcaaaacagaaaggaatgaggctctgtacagcagttcccccttaggcatggggaaaacgttccaagacccccagtggatgcctgaaactgcagatagtaccaaaccttataacactatgctttttgctrtacagtaatggkgggtagcttatatagcatgggtacattggacaaagggacaactcatgtcccaggtgggacaaagcaggayggggcgaggtttcatcacrctgctcagactggtgcataatttaaaacgtattaattgcttttttctggaattttccatttaatattttcagacctatattggccacaggtaattgaaaccatggataaagggggggactactgtacttagggaggtcaggragacagtgagcaaatctgactgcaaaaacaagtsccgtccctggtccttaaggtctgatttggaagtccaggcaggcaggtgtacggtgtggagctgcctcagcagcgttgacaccctagctccgtcactgctgagaaggtgaatctggaccattttcttcttcctcttcttcttcttcttttttttttttgtgaaagagacaatttaatgggaaattatggtagaaagcaacacattttttgtgtgcaattggagaatctggaccattttcaattccaccttccagagcctcagtctgtaaagtggagcatgttgtagaatttggtaatcacatgggataatgtggtgatgcaactggcctttagtaggcaccccacagtaactgttcctgattttatcattttactgttgcacaagacgatggtagtgtcattatgaggagggcccacacacaccgtgctctgtcttggccagaactgaagagaggaaacagacactcattgctcgcyggctgagtggacggcaaagggtgactcagcatgaagggaggcatccagagagtctcagaaccccatctttgaccatctttcagggttgtctataagtagcctcccacctgggtggggttggtggctgggctgtctggaagctgggagctgggctctgaggccatttatttatttatttgaatcctggtctgagactctttgaattggcctgccttttggttctggggaaggaagaaagaatcagcagatcccaggtcctaggtccgcaaggatgggcatttacactcagcacccggggcccatgattcacgctctgggggcttgggctggcccgcaatatgggaaaggcctcagtatcttccatttgaaaaaaatcctctacaatttagtaagatggcatttggtattatttcttaggaaatctgcacgaacaagtatctctaaccctaaaaagacctgagaaaaacatccagtgtgccctctcattgttgagagaaggggcctgcaggtaccttaatgggcaactggatggtgagyatgtgctcaaaaagactaaaatacctgtatccatttgctcagggctccatacaaagtatcaaaacctaagtggcctaaacaatgaacatttgtcctctcacagttctggaggccagaagtccaaaatcaaggtgctggcagtgttggttcctcctggagggtctgaaggagaagccactccttgcttcttcctcccttctggtgattctgggcaatccttcacatttcttggcttgtggaagcatcgctccagtctctgcctccatctctctctgtgtctctgtgtgtttttctcctcttcttataaggacaccagttattggatttaagggtcaccttagtccagtacaggttggggatcccttatccagaaatgcttgggaccagaagtttttgtgttttgcattttgaatgtttttggattttggagtatttgcagaatacrtactagctgaccatccttaatccagaaatccaaaatctaaaatgttccaataacatgtcctttgagcatcatgtcagtgctcaaaaagttgtggatttrggggcatttgtgattccagatttttggattaggaatgctcaacctgtgtaacctcatcttaatttaactacttctgcaaagaccctattcccaaataaggtcatattctgaagttccatgtggacatgagttggggtggrgggatactcttcaactcatcacaacatctttatctcactgaatcttcacaatacttggatcttcatttaatagatgagaaaagagacactcagagaaattcactgaccttcttcaaattcccacagctgggaagtggcagaggtaagatgtgaaccaggaacctgcctccaagcccctgtactgttggtgctggggccttcgtaaactatagaggacagcatcaacatcacataaggcagtccttcgagaccactgatctacatgccagaaacctgttagagtcatgacttattatctctccacttgacagacgagmaaactaaggccaaaggtggtgggagggaagatgagtaaagtggcttgctgagatcacacaagtggcatggtagggaacccatggactggtccccaraattctcccccaacaattaaacattctagctcagtgttaggaggtaaaaggagctagacacaaaaggcatgtgttataggctctacagagacagcatcctacaacatgtgcctggcttctttcacaacaggtaaatctagagacagaaagattagtggttgcccaaagccatgaggaagggagaatgggaygtgactgttaatgaatatgcgatttcttgggggatgatgaaagtgttctggaattagacagtagtgatggttgcatgaattggttattaagtaaaagctgaagtgggtaaactctacggcatgtgaattacatccaccagctctgggaaggtgatctgcaggaagcaagtatgcacaaggcctatgagatgcaaagcttttattgtggcagaaatagcccaagccctgggtcataagctcgtcatgcaagaaggcacttcgaggacttttcctgtgacagaatttgtatcctcggtttgttaaggcatgaacaccccaagaacagagagaatttccagagcaccctccttaagaactgcatggccttggaaagttacttccctctctgggccccagtttccataccatgaaccagtgatcatgcaaactcccagagtggttgtgagcgtgaagtattttgatggggtycctttgacctgggactattttgcctcagccagcaaaacaaaataaaaaactaaaaccagaataaaactctcatgaacaaacgattaaactttcagccattgctgttgccaaatcatgacctctgttgctcatccctgctccccaccctmatccttggtgaaggatcagagctacrtaagggtcaggaattgggtaacaaggagataatgcagcacatggctgggatctacacaatggagacactccccctctgagtcatgaaggctgtgctcaagaggctccagcactagcatgaattcccatgaggtcatctggtgtccagtttgcatctctgcatcctattctcacccctctgtggccagggaagactcaggagctaggccccttgcctggtctcctgagcccacctggacttcttctcattgcrccagcttgctggagccagagagggtcaggagttgaggggctgctcctgttgcctcgctggggaggctctcccagcattttttttttctttttttgcctgctaagagccctgctcaggtttccaggcatgtggtttcccctggattgcagactmccttgagtaatgcaggcatctgtgaacaaaattccctggaggagtgagctcccttgggcacttgtggacaacttcctccaagttcagggcacttagtgagggggtgcagtctgggtgggaagagtgggcactggaggcagaatgaaatatcttctgggatctgtctaggttcttgtgtccaaatggctggagggtagagaatgagcctggagcagagagagggagacatagagacaagacagggaccagatcatgaagggtcttgcaagccatgttacagctgtagaacyttatcgcaagaggggtgggacactatggaagggtttcccttggaggatgcccccatcacactcactgccaacaccaccaccayatcatcatcatcatcatcatcatcatcathaaagctagtacatgttcagtgccaactatgtaccaggcactgtgctagatgctttcatacattaatcctattaacaattttatgaggtagataccattattatccccattttgcagacaaggaaatgttgactcagaaaggataactgaggtacccaagactacacagcaaataagagcccaaggctgaaccacaagtggaatccaggtctacctaatcctaaagtcttggctcctgaacacagttctctatgtttatagcctccccatgaatgtatttgcattcttaaaagaccatgttggctgcagagtgaagaataagaattgggasatggtagtagttagtattggaggcacccatgacagacgatggttggacatagaaggaaacatagatttaggaaacacttagtgagtagaatctaaaagaggtgctgatcctattactgggtatatacccaaaggaatataaatcattctatcataaatacacatgcacatgagtgctcactgcagcactattcacaatggcaaaggcatggartcaatgtaagtgcccatcaattatagactggataaagaaaatgcggtacatatacaaccatggaacactatgcagccrtaaaaaagaatgagatcatgtcctctgcgggracatggatggagctggaggccattattcttagcgaactaacccaagaacagaaaaccaaataccacatgttctcatttgtaagtgggagctaaatggtgagaacacatggacacaaagwagggaacaacagacactgaggtctagtggagggtgggggttgggaggagggagaggagcaggaaaaataactaatgggtagtaggcttaatgyttgggtgatgaaataatctgtacaacaaacccccatgacccaagtttatctatgtaacaaacctgcacgtgtacccctgaactcaaaataaaagttagaaaaaaataaaagaggtgctgacccaccagatggaacagatgaaggagagggtacgttgagcgatgagccccaggttyctggcatggatggatggatgcatggatggaggaggggcatttatggagacagactaggcaarttttgtttaataaatgagtgaaggaatgaatacatgaataatgaagggatcccaaagtggcatggataatgaattccccatcactgggagtatgaaacaagtggcttttcatcaggatattgtagaagatactcctgatttgaagggaagtcaagtggtaggcactcagtaagtctatattgcatgaataaatgattgaatcgctgctgcgcctatgattctaggcctcatgagggtctcacattcatgtagtgggaacttggtaatgagttatccctgcagaaatgtaagatggaaggaaatattcaagcactgttaatattttttttttttacatcttctttcttaaatttctactggttgattatattttagaatgtacatcttcatacagattaataagtatacatacygggtatgcataatcaattctttttttcctataggaatatacaatcacaaaagcttggagaccactgatctacatgccagaagcctgttaacagattgagcagaaatgaatagcaccccttcccaaaggcttctgagtgtgcaaggcggtaccccagggaccaaactcgggggtttcgggagttgtaacaaatgctagagctatgcaaaaacctcatccatttattatgctctacagaaaagacacatgtttacatgattttctcgtttggatgtgaaatgcttcctgtttacaacataacagctcattgagtctttcacaggacagatgttctttatcagggcatctacaccatgcatagggccgctcttctcccgcagactcagttgcccctcagaccaggtgtggatccccacatggccattgcggcagagctctgctcctaagagagtctcagaccatcacgtgctctggtgctgaatgactgccctgtgtgacaaaacacagcctctttttttttttttcattcaccatgtgtggcacagtttgacttcattctaatactaatactaaatggtttttacttcttctttcacctgttttcttcctccagatacttactgaggcagaggagagtgggtggtgggaaaaaagagtgggttgggggtaaggagggaatcttttttttsacgcttttgctttaaaattcagagttggattggtcaggatttatgggctctttgccatgtaaatttttctcattctccaggttctagccctccaggttcattccctccaggttctagcttgccaggttctagcctgccgggttctagctctccatgttctagctctacaggttctagcccttccaggttctagccctccaggttctggctctccaggttctagcccttctaggttctaacctgccaggttctagccctccaggttctagcccttctaggttctagccctccaggttctagccctccaggttctagctctccagattccagccctccaggttctagcccttctaggttctagccctccaggttctagccctccaggttctagctctccagattccagccctccaggttctagcccttctaggttctagctctccaggttctagccctccaggttctagctctccagattctagccctccaggttctagctctccagattctagccctccaggttctagccctccaggttctagctctccagattccagccctccaggttctagtcctccagcttctagctcaggttttagcttctctaggttctagcccctccaggttctagcccttcttggttctagcctctccaggttctagccctccaggttctagttctccaggttctagctctccaggttctagctctccaaccagctaataaatattcatttatcaagtgaatgagtgctgccctggcactgccgatggtgaacaccattgccattccttttcacactcttctagggctcatactgggccaccttccaataaaccattgattgacaggaacaatcccttggttgctgagacaggaacagtccctgagcaggcctgcactctcccccttcccaggtaccggctggtggtggggggtctcagcactgtgatcctctgggcaagaccgattagaaatatcttcctctgcctcatcacaaatcagactttgaagacatggccttctctccaaatgctcctgtgtgtgtggcggttggggcctcagggtggtgggaatgacaggtggaagggagccaatgagcacctactgtgtgccagacactggtgcttcacaccgccaccggctcccaatactgattctgctccacggagctatttctagacctcagtgtcttttccttatagtaaacatatcccagttacgtctgcgtaatgatgcctcacatgtacgtagcaccctttgcttttctaagtactttatacctgttactgcctttaaccctcacaacgacttcatgttacagaagagggaactgaggcagggacaggtggttgtgcaatagttattggttgagctggaaccttggtctcccccttctgctgtccatatcacccacagcaccctgctcgaccgtctcgtcgaacagctttctggtggtggcagtgcccagtcgttcccacttgagtctttgagttccttcaagatggagatggctccttctctttcttccctcttgcctacagtgctcaatactgcatatacagcaagtgctcaatatgtgcttattggattcttctttggcacagacctccttgtccatcagtgaggggagccataaaatcctggtctccaggttgttatcagggacccctcagggcttaacctttattaatgcaagaaattgtccttcaaagttctagctgaatagattaaagaaacccagggcaacaactcacttgtgcactcagccattgcaccaaagctggatggcagttctcctggagatctaagttgtcttgctggggcagggacggagaacacacgggagggaagctcagtcactcctctccctgcccccaggcctcctccactcctgggaaggagcaggctggctcaggtgtggcagcaaataagaacagtaatgctgttgtgattttggagtccttggctgtgcgtgagttcaccccatcctcacagccatgctccctgcaaaattgggcagggcaggaattagtctccggtgttttaccggagacatcaactcatttcccaaggtcgtgcatagatgtctccttggcattcctgggcccatgctgaaaagcaactgtccctcaatccttacacaaattcacagcagccctgctggcgtttgctcactgtctgctccctgcccagtcctgcagtttgtgaatctggcgttccacggagatggaggtccgcagtgtgcccatggagttctccatctgaatgggttctgacctgcagccccctttctggcacactccctggtacacctcccaagacttctttcggaagcgcttgcccacgatcacgtacaccagtgggttgaggcagctgttgctgtaggccatgaaggaggcgatctgtgtgattacatcgatgatgcgctcgtcctggcagctggagaggatgccgaggcgatgcagcgtatccaggaaggtgctgatctggaagggcagccagcagatgatgaatagcagcagcacaaccaggactagcaccgtggccctcctctccgtctggatctccttgaacttctgcatctcgttgttccgcagcacctgcatgatctgcatcgtgcagaaggtgatgacactcaggggcagcaggaagcccacgacattcaggagcatgttggtgaacacttcccagatgagggatgggtagctgatgacacaagcggtgacgttgtggccctcatcgctgtactccttcatggtccggaacaccagcatgggtgagctcaggagcagcgtacacccccagatcaccaagctgtagagcttggcccagcgcacgccgcgcatccggcccatggacatggttttcaccagggccaggtagcggtcgatgctcaccagcatcaggaaacagatgctgctgtacaggttcatggagataatggcattcaccacgcggcagagcgtctccccaaagagccagtcgaagttgttggagatggtgatggcccagaagggcagcccgcaggccaggatcaggtctgctgcggccaggttccccaggtagatctctgccaccgtgcagctgctcttgtgcaggcagaagacgctgaggacaaagatgttctctagggtggccagcacgaacagcacccagaggaaggggggctggatggtgttgagccagcccagccactccacttgggggcatttgctctgggcaaaggtcccgttaagagtgggcccttgcaaggtgacattgagcatgtcggcgctgaaagaaagtggaaaagaggctgttacccctcagggtcacaagggaaggacaaaaactggtccagaaggagacaggggttaaggacaaccagccagggcaaggagaagccgaggtggagctcaggctgttttctgcagcccgcgctccagtgcacctgactcccctgggtcttacagagccccctctgatccttggatctaaacgggggcctcatgttcttcatctcgaggctccactgggatatttccttggccagtatccaccaacagcactaacaatctcaagtgttggacccttgacctccttgaagcttccgtgatgggaggattcacattccttccttatcaaccggggccctcccaagggagttggtcacctttgagcctctcaaagccgtgtggtgggtgagttaatttattaaaagagaaaaatgatatcattccagacctggagattccagtctggcttggagaccatggccagcccatctgcctagtttctgtcttcctggacagtctgtggcatcgtatttccgtaccttctatcagcaaagcactgaagatgattggaggatacagatggcgagggagggtggggactttgcagccagatagtcctactgggttcacatcctggctgccttacttataagccgtgtgacgctggggaagttacttaacgtccttgaaccacaatgacctcacctgtaaaatgggagttaaaaaaactacctctcagggttgtgatagggatcagagacaatgtgcaaaatgccccaagcactgcactaggctcaataaacattagtaattaacaattcttgcaaacccattaaaataaccagtggtaaactccaacaccaccgtttgttggtgacctcatctttaacccactggctcctctttcattcttaggcaagactcacagaccatagggcaggcacctttctagacttgttgctgtaattcatctctaccttcagcagaggcgtggggcttggacagccatgagttccactcctagctgtgtggtcttgggcaaattgcttgacctctctgagcttctattttgccttctttggagtagggtattgctctcatcctgaatcgctttgcatttcttttttcatggctgttgcaacattcaagctgaagagtggatgcgaagacacactgaaaagtccaaagcacaacccagagggcaggactcattgggcattttcccagtgccctgtgctgtgggtgagagaaggaaaaggggctctttctggaaggtccactgatagtcaggctcatggaggaagagctgaactacgagtcacgggagagatactgatcatcacctctgggatttcccaggaaaagtccgtttgcttctaggagcagctggctggcatcctggagccagactgggggacccacaaatcaatgcttctatcctttaaatgttttttgagcgtctgctctgtgctgagctctgccctgagtgcaagaacacaaagaagacaccacccggcccctgccctgcctgactcctgacaactgtggcccagagggtggagggtgccctggagggagcaggggggttgtgggacacagacttggagagggggctggtgggtaaggggttggaggtgactctagagctgggtcttgaaggataagaagcattttgacgggacaagaaggaggacaagtggaccaggcagggggaacagcctgagcagaggcacagaactggggaagctgttggtatgttctggaaagtgacactagatgttggacaggagaggtgggaagtagcaagaggttgagtgagggagtaagcgtggtcttcactgggtgctaaggaagtgaggctttgcccctgagtcttaaggaactacagtgatggtataagaagtatgctctaaaaagatccctgtggtgtgtggtggctttcatatgccccccgaattacttgatattcttcatttcaaaaggaggaatctgcttcctcttctcctggacgtgggctggacttcttactaatggtggcagggatggtgtgtgatttctgaggctaggtcataacatgctttgcagcatctttcttggccttttgcattgcttacttggaaggatgtgagccgccatgtgaggatactcaagcagccacatggggggaaccaacttgccaccttgaaagtggatcctctggccccagttacgcttttggtggctcctggtttcctagcctttgaatcttccaaccaaggccccagacatcttggaacagagataagctgtctctactgggctctgaattcttgacccatgaaaacttgcagcctcctttccagagtcctctgaaggtaagacttcccctgggtagtccccttggtccaaccctcaaccccatttctgtagctacagaaaacccatttcctgcatacccctggcttggagagtctgtcatctttcatgagctaactcactagagaccaaagtatagcaccagatgctgcttattaatttctcagcaagacagtagccaaggggatggatcctggcccatccctggctctgagaagccatcggatcatcagaaagatgcctgctgagtgcggaattggaaactataggtccagtgcactgtggccccagctgagatggccatctgctcatcttcatcataggcagcacctgcagcagggtggagaggttggagtggacccctcagccttgtttcttgcaaatgctgtccccaagaacagatctccctatcctctgcttctactctggctcaggtcctcctccccctccccttaaattctctctttagggtgttctgatctcccaccaaatgtcagccatgtgttggagatattttgtctccaaggcaatctggcacattgctgtctgatccactgggtatttactttaatgtttaactctcttcccttcacttccaagttcatctgggatagatcacatatgacaaccaggaatgtgcccttcttctccctgagcccctcttcctctagttccgcagaacattccctctgctcccaacaggcctacagggacttggacacctgagaggttttgtctttgggcttaacatcactggttccttcaactgttgtccggggcatgag

SEQ ID NO: 17629 - DNA, 30151 bp, Homo sapiens
gaaccttccatttgacccattcaaattattgaaatatatacctccttgtgcccaattcagtttcaaggatattccaaatttgtcgaaaataaatgtgctgaaggcactaaaacaatctgaagtccgtttaccaagcagagtgtcagaaactttggagtgagcatggcatctccatttggctctttctaaattgaaatgttactgcaggttccatcaccaagtgtattgaccgagtgaaatgactcagcactgcttgctggacaccaaacactccctcctggccaaacggtcacttgaggacctaccacctgctctaccaactacatctgcacgacagtaaacagcaaaataaataccttctacagccacatatagattaggtcttcattaccttaaacatagataaaactgtgagtgtgatttatatagacaagagtcttttggcagctagatcaagcagaaataaatattgatattttgttttagagtcaaggagattagaagctggctctgaataaaatacagattgttttacttagcacagccattttgttgttgttataaaagaatagagatggacaaaagtacctaagaaagggcttcttgctataaccacaggttgacggctgtgcaacactctccagcccggcttccctgtattcacttgtagccacaactacaatttcatactgtttaagttttcattgacaacggcagccaaatatctgcttatttcagatattctgaatgctaagaaagtagatggtcagatgtttctttcacagcctttgctatgtttgcatcttgtacttttgaaacaagtttcagttcaggtaaaggattacttaatcctctaaaggatgaaaaagtgtagctgaggtgtctaaaattcttgattcaagtttgtccaactgagagagtttatcaggagctaatttggctcacactggacccagaatcccaccccccaacttcatttgtggtccaattatagtcttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggcccaattatagtcttatattaaacagtatccactgcagctcccaaatatccataagatcacctgttattagtctcttcgtgtcagtgaacctgctgcatttgtgtcagcaagtgcaaggctgcctctggacgtgttcctcacctctgcactgtactataagccccttggcttttgtttttggaatgaccctttgaaataagtaaaatcctgaaagcaatagtttaggaaatctacctgtcacttctgtagtcatacaatgccacatgtaaggttatcttgtaggtgcacttataccctggccagctggctaatctggcagcttatttttcaatatctggccaatgatacagactcatgagttctgatactttattgccctagttatttaacgttatattatctgtacagcgaggacagaaaaggctgttttaaagctgtttgtgagagacaactattattttccttattttttaaagcagactctccataatatcagcaaacaatataaagacattttggcaattaatttgaattacctgtgtatttcaaagggctaaaatgggcatgttttaaaattcaagattgtagttcatttattcattttccattattcttccattggtaagttccactttaatggaaacacatgccatatttggtgagagagcagattttttaatttttaaattttaaaaaatgacatatactgtctgcagacagatatttttaagtattgcaaagcaaaagttgaatgatgcctaaaaaatagtttatcctaagtactcctggagttccttgccagatcctgtttgctatggttccaaaggggaagtgcttttaatcactgttgagcagaatttatgaaacaaacctgaaaattgccacagatgatgttaaatgtaaacattgggacagaaggaggtagtaaatagcacttactttgtctacatttactcctctccaactttccatttttcttttcttttcttttaagagttggagtcattctttcacccaggctggagtacagtggcaggatcactgctcactacacccttgaatcctgggctcaagtgatcctcccatctcagcctcccatagctgggactacaggtcggcaccaccatgcccagctattttttttttttttttttttctgtaccaatgaggtctccctatgttgcccaggctggtctcgaactcctggactcaaatgatcttcccactttggcctcccaaggtgctggaattacaggcatgagccacctccaattttctattggcctctaattttctaagtctgatcttttctcctcttagagggagaagatcttttgtcctcttaggggagaagaggaaagagagactttttttctgcttctgaaatctcccagcatattgctttcgacttgtcaatggcaacacagcctttggatgctcacttgaccctcaacgtgtctggtcctttacaattctatgcattttcctgtagcgagatcccttctccgtcttccaccacccactgctttggctcccctcttgctgttccctgcctgcatctgggcaggaagttccamtcctgacttgaccctttttcagctgtgtggcctaggactcattgctcttttctccccatttcatcatctgaaaatggaaaaaataatacctgactagaaagtgaaagtaaaaaagagatataatggacaatgtgcctcgcacagggcctggcatggagaagtccttgatgtacgtcttttccttcccttttatgcagccgtttccctcacacccacccattgattgatttttctgaagagactacttttgtcatgtcaccctctaatccccagactttaaactgggaggtagcagagtggtctgattaagaccttagacaagggtttcttgtctgggcgcagtggctcacgcctgtaatcccagcattttgggaggccaaggtgggcagatcacttgaggtcaggagttcgtgaccagcctggccaacgtggtgaaaccccatctccactaaaaatacaaaaattagccagatgtggtagcaggctcctgtaatcccagctactcgggaagctgaggtggaagaatagcttgaacccaggaggcggacctcagcacttctgcctgggtgatgggagtaaatcctgtctaaaaacaaacaaacaaacaaaaaaaacttagacaatggtttctcagctttttttaatcactccccaacaagtccttttagatattatattcttttgtgtgtggcggggtacatagcgtgtgtatatgtttgtaggttacatgaaatgctttgatacaggcatgtaacgtgtaataatcacatcagaggaaatggggtatgcatcamctcaagcatttatcctttgtgttacacacaatccaatcatactcttttagttatttgtaaaggtaaattaaattttttttactatagtgcccctgttgtgcttgtaaatactaggtcttatttattctaagtattttttgtgcctattaaccacattatatatatatatatatataatttttttttttttttgagatggagtctcgctctttcgcccaggctggagtgcagtggcgctatctcggctcactgcaacctccaccttccggtttcaagcgattctcctgcctcagcctcccaagtagttgggattacaggcacccgccaccacgcctggctaatttttatatttttagtaaagacagggtttcaccattttggccaggctggtcttgaacccctgatctcgtgatccacccacgttggcctcccaaagtgctggaattacaggcgtgagccaccatgcctggcccacattacattcttactcacctccccctaccatggaattttattccacagatatgctattggtttagctactatatgtatatctgtgttttatacataaagcacaagaaccttccagaaccaattttcgccaccttggaagtaataccacctctactaagaatgcacagcatagaccataaaacctcaatgctaagttcaaatattggccctaccacacatgagctgtgtggtcttgtacaagttacataacttctcctccttgtctcaaactcctcacatataagatgaggataataatagtacctgcggccacacacagtggcttaaacgtgtaatcccagcactttgggaggctgcggcagaaggatcactcaaactcaggagttcaagagcagcctgggtacatggcgaaactctgtctctacaaaaaatacaaaaattagctgggtgtggtgatgtgtgcctgtagttccagctacttgggaggctgaggtgagaggatcgttcgagcccaggagatcaaggatgcagtgagctatgatcatgtggctgcactccagcctggataacagagccagaccctgtctgaaagaaacaaaaacaaaaacattagcacctgcatcatagggtcactgggggcactacatgagttcatgtacatcgaggacttaggacattgcctcaggcagacctagtgctgcacaattgcttatgtaattattcccaaatttctccagggcccacagaagaacatggaagtatcttggtttggcaattaaggtgaatcacattctcactctccttttctgcatctctaccccacattcccacaaagctttattcacaccaagtctccagtccttgcctgcattgtgtgatgggtgcctgcagtgatgggtggggacacccatcactgtccagggtgtccccaccatcctcacagcctctctgtctggcctcctgcctttgagccagcccaccacactctcatttctctgcccagcagaaaccaaactgtcctctgcatttactgtctcaactggaagagaaatgcagaatgacaaagaacttgtgaacaagggtcagctccaacagagagtgaagccaaaggggctgggcagaaagagagatgaagacggggatctaaggaataaggctgtaccagagtgagagtacgggggaggggttgaacaagagttcagggaggagagaattcccagcgctgagccagagactcctttacagaggcccaaggaggcgtggagggagggggaaggctgccaaggctctttctgtctccatgagtgtgtcaagaatgcaaagcactaatgctcttcacttggtccatcttgcagggttgagtttgcagtgagcaaccttgaaggatgagctgacatctcgctcagggccaaataaccgacttgcttactgcttgctataaaatggcacgttacccaaggtcagagttcccttcctataacctccccatccctcacacattcacaggtatctatccaagccatggcatcactctgtggggcttgggggcaaggcaactgacactggacgctggttctcatgcttgccaagcatgaagccctgtgctgctagcagctgtggaacatagccgttagctttaaaagagggtaaaatcacgtcctggacaggacagccaggtgagttgggaagggaagagagcctgccacgggcacaggcatgttgggggaagtggaagtggtgagagcacagtaggaagtgagaaggggcgggccgtgcttaccaggccgtggacttaaaccaggatgagagaacccctggaggcgtttaagttggcagacttggatttcaggaagagctctctggcttctgggtggagaatggccagtggggtaagtggtgagaggaaagacagagaacggagaaggttagatgggcttgggaaattatccaggccctggatggaggtagagatgtgtgctcatgaacacggaggggattactgatgtggggtggatgagactgtcgtcaagagtgtgggacaggaagagagggagagtcttggccagatccaagaaaggagccctcagaagaggaggggagtcagaggcaaggaaggggctgaggcagccagcccagctgagtggascccaggagaggtatcamrgggtggtgtggggtggggaggggccagtgtcaraaagtggatggggagcggcctgactctgcttttgtcctgtggccttctggccaaaggcagggaaaggtggccaaacactgagaccaagaacaaagaaagaaaactgctggtggacttcttccaccaygagcaggccaccaagcccgcagcactgcactgcagcccccagctctgtcctggggttgggggaggtgaggaggggcaaggtggggagcacacagagcacccgctgtcctcggaacaccacagcgactagaggtaagggagcaccggatgtggctgggatgtgggcagcaaggggccagaggggccttgaaggggtcacrgaccatttaatgaaggtgtattgaaggccaccatgggccaggccctagttagggatggatcagaattatatagcatatgccaggggtcaggcaggtaatgaagtgatcggaaggtgatgaggcagtggcagttgagattcacgttgcagtcgccccaagctggccaggccagggagcagaagcatggctggatgccggagcccaccaggctccccactgcagggcaagagtggcagggggagagactgtgaaaggagcataggccaggtcctgggtgaaagctgtgtcctcagccttgactgatgggtatagggagccactaaatgccttggggcagagaggtgaggaaaaaaatatttaccgagcatctacaaggtgcaaggtactcactagatgccttcagtaccaaagcttctcaaacttagtatgcatatcactcttctaagaatttcattaaaatgcagattctaattcagcagatatagggcagggcttgaggtgctgtctttaataagctcccagtgcctgggactgcactttgaggagaagagctgtgtgtgccccagtgtggtccagtgagtactctgggctccctctcrtgggcagggaagctgagggccccatgagctctcccagcttcctgaaggctccccattaatgagagctgactgtgctgtgctttgctgactgcagggcctgctccctgccccccacctccaggttggggtaagtggcacctctctccctccagctccgcagtcttccctgaggtttagatcttccaggtttataaagtcaggccctcctgttggcagctggcctccaccctggagtatctgagcttgcctgtggcagcatctaaagatagtctcccttacaggaaacaagatactattggctaactctgcaaataaaatgctcttagagggaaggaaagggaaatactcgtctctggtaaagtctgagcaggacagggtggctgactggcagatccagaggttcccttggcagtccacgccaggtaggtgcacaggactagttgggtacctgtgggtggggtggagcagtggacagctaataggttaataatgcctgtttgcttacgtgcagacaatggaaaccattttcctggggatgttgtagcctaaatatgtccaaggggatggaagagtgggaggcaaggggtgatcagatcatttataatacactcaacctggtggaatagtattagaagcattagtaattacrttttagagacatggagaaaagctcatgattttaaactaactgaaaaaagcatgaaaaattgcatctggatgctgttgaggaattattgctaattttttgagatgagaaattgtattaaagtctttttcaaaaaagagtccttaacttttagagaygcacacaagtgtttatgggtgaaattaaataattcagtagagacattaagtgggaaatagaggaaatattgaccatgggttgctaatagttgaagccaggtgttgggtataaggaggttctcgctgcttttatttgaaaagttgctttttatttgaaaatttaataataaagagtttttaaatttgtatctgtattttaatataaatataaatgcacttaatataaatataaaatatgtataacatttagatagagaaaagctaaaagattactgtggttgattctaggaaactgcattgcagatagtttcatgggtttttttttcctttttcttccactttttgtaccatctatgggtttttgtttgttttttgttttttgggttttctttcttgtttgtgttttgttttttgagacggagttttgctcttgttgcctaagctggagtgcaatggcacagtctcggctcactgcaacctctgcctcctgggttcaagtgattctcctgcctcagcctcccaagtagctgggattataggcatgtaccaccgcccggctaattttgtatttttagtagaggcggggtttctccattaataaattcctggcacaaatttagtgttcaattttgatatatgttgttataaccattgtgaggatactcaggctcaggtttgtgtgggtggaaaacatggtcttcagaaagaaattatgagtgcaagacaggaggaaatccatcagaggccccagctgaggactgaccacggcttgttatttctcttgccttgcctctggcaatcacagcctcacagagcctgcaatccttgctttgtgagtttatagctcagtccagagaatggctaagaaagtttaggattctttcaacacccactccacaaaaaaaaaaaaaaaagaaaagaaaaaaaaattaatttttgaaatacttgaggtagaaaacttgaggcagaaaaaaattgagccaaaaaaaaggaaaattgaaccaygtgaaagcaggcaagaaagcttgcattgctcagggcatcccaggcccagagggcrctttggagggagctgggtttcctgagaggaggcagggtgggtgacggacctgtgctggagagccttgaggaccactgtgggttgggaatgggggcagtggattggggttcaaaaccsctgggaatgagaaatgggctcaggaaggctagggtggattctttcatcttcctctttgcttggctttattttcacaaaggaaggcagggcaggaaatagtctcagcccaacttcagtgtggttcttcttagtgctcaggcttacctggcacttgccacacctctgggatgggagcacctactatccatcagccacgtgccagtctccacaaagtctgctcctgaaccctgctcctcagctggccccacttcacagatggggacataggcagcttggctttggaatgaaggaatgaagtcaggaatgaagtcctggctctgcacttggtgactgtgcactgggcttgctaagtctgtttcctgcttttaaaatggagattgtccatcagcctttgaagccatgtaatgggtatgtgtcaactttctgcaaggattaaaggcatggtataggaagtcccaaacacactgcctgacccatctttgatgctcaagaaacgatatatgttgttgtcatgaggaaactgagcctcagaaagtttggatacctgaaaaacactgactactattgaatgaggttgtgaagaatccagagctgtaggggcaggaaagcaaagaacgtattagagctgacccagtcaggacgatcgtctatccccttcctcaccccaccccattccaggaggaagtctgcccggccctaggcagctatggcacagtggcaatgtcaggtatggttctccctagccagagaccctagcctcaaaaaacctccttcttgggatccaggcatccaactgctcctccccagccccagcctctgacccagtatcctgagtccagagacgtttggaaccagcacctgtaatggaggagctgaacaaggaggggaacttctgctgctccacagcaggtcacggtcataggagggagtggaaccagaatggcagaatccagatcttggctgcctttcccaaggacttgttctgattcctagcagcacagcccaggcattccgagaagttgggctctctggcatcactcactctgcccagaagagccaggggaaagttggggcttctagctgaamcttgatcccacctgccctcttgaggggctcagaatctgctggctgcttcacaggtgggattctcacggcacgctggccacagctgatgcttcraccccctcatcttgtttggccaaagtgcagctttttagcttgtgagtaaggaagaaaagctgtatcatatgtctttaaacatcttcctagaccacctttgttttccccttaaagtgtgcttaaggagaaaatggaaagtctcttttcagtgtgttgtattttgtttattgcaaaatacaacacactgaaagaacaatgtctgggttagcaaagtattagatttaatttcccacattactaccatccaggctgagaaagagaaccccagaagcctctctcatgtcccttcctgaccacagcctcttcctctcccacaaagaaccacaagtctgacttctatggtgatcacttccttgcttttccctatagtttgactgaatctaaatatcatccctaaacaatatagcttagctttrcctatttttgatcttcatatttggattcatactttttggtttggctcaagactaaacttttaaaatgcatccacgttgtaggagatgtacatgcacaaaaattttcacggcaacattgtccaaactagcaacaaactgaaagccacctatgtgtgcattagcagtagaaatggcaataaaycatggactagtcacacagtggaatcctacgcagcaaggagaattagcagtctacagccaaaccaacagcatgggtgagatgcttccagaaatactgagatgaatttagagataaaggcacaattggtccatatctacagggcacttaatccagtgcatctccactagacaaaatttgtatttccatgagcaagggtcatttgcactgctatctgctataacctacggtgctgtaaaattagctcaggcaataaaagggggaggtagccccaaagagtatgccagaaaggactcccagtaatcttcagtgtgtgtctatttcaaagtctttcatcatttttccttgtagttacttagtgtggaatttcagacccctctctatgtccctcttctcccttttcagccttggctttctctgcatccttccccgaagccctgcactcagcctaaactgactttcctgaacactctgggagcatgtgggctcctcccaactccaccatcttcactgccttctgttcctatttccctctgcctggccttggccccaggaaaccttcctatgctcagaccctctgtgcctttgtcttcaaagcccacccactattcactgccacctccatcttggtcaacctggaagactttccccatccttaaaacatcagctcaaayggcagattttttttttttttttgtgatatcctcttgatcaccctcccccagtttttaaggagacagatatagaggttcaatccttgggcttcccatgacttttcttatattctgttactgagcaataataaacacttctaggaactgtatcttaaacacttttgcctctacagaatctagcacagtgcctagtattggtgaaatataattaacaaagtcttctttcaacacagagattctctccacaaaaggagtagagaaagaacagttttattatggaataagcagtaaaccaaaatatgcagagcattataggccatctactaagaggttgcaagaacagaaagaaatctcccccttttgtatagccaagtagatacaacctgttacatacatgttatcaaggcaaacaataactgttcctcaagtaagaggtcttgccagcaccgtttgccrtayatggttcactctaaatttacctggtaattagggtaaccacttgtgttagctaactggctctacccagaggaaaatcaaatttatctttaagacaaggggtaattttgcagcactgagcaaggctcttcagttaggctcataccttcccacagaaactargagatagaagcactatctcccttaggtttgtttacatttcaaagagatgacgcccaggtccttgggaaagactagcttagctcataaagctgacaaaaagcctatctagtttcaaaaggatttacacatgttcaaagagaggagaaagtatgtaaaagttttctaggtgggcacggtggctcacacctgtattcccagcactttgagaggctgaggcgggtggatcacctgaagtcaggaatttgagatcagcctggccaacatggtgaaaccttgtctctactaaaaatacaaaaattagctgggcatggtggtgggcgcctgtaatcccagctacttgggaggctgaggcaggagaatcacttgaacccaggaggtggaggtggcagtgagccaagatcgcaccattgcactccagcctgggcgatgagagtgaaactccatgtcaaaaaaaaaaaaagttttctaaagtaaatgctctgagaaaaaaacagaaggtgaggagatctctgtccttatttttaacaagaataattaaatgtttttatttttaatttctacttagactagaatatggtacagatgctcaaaaatattgacttaattaataattaaacaattaacaagtctatctctttcctaattattaaaaaaattatgaagtatttcccttcaaaatttcacagtttactttgacataaataaataaataccataaagtattttgaagaggaaagggaagggtggggcttcaaacacaaaataatggcaggttttgtaaaggggcaattcactaaacccaataggattctcctgttgctattttttttttttttttttttttttggtggtggttggagggaagggttgggtgtgcatttggcctgtgtgaaaaactggtgggtagacaatgccatgctgttctaratgggctcattgctataggaatagatagtcactgaatttacttgcataggggatggggtataaaatgkttccttatagctccttaacatggaattmagmacccctytccccatmagccttagctctctctgaatcccaagggatatgtgttataaaaatagctgccatcataaatgagaaaaccatcaggacctggtaaaacttggcttcccaaacagtcaggggtctgggcatggcagccgactgagaacctttctatctagtacaaggtaaacaagatttgccaagacttgatcaactgatccagctccctatctccaaacagaacctcatctgaatgctcacaggctgtgccccagaagtgtagaagtgtcatgttccctgggcaggctgctgggcagcctctctgttgacaatagaccacacttttgctgacctaggactcatgttgctctttaagactgcttccttggccaggcatgatggctcacacctgtaatcctggcactttgagaggcccaggcaggaggatctcttgaggccagatgttcaagaccagcctggtcaacatagtaagaccccatatctaccaaaaatagctgggcatggtggtgcacacctatactcccagctacttaggagactgaggtgggaggattgctacatcccaggagttcaaggctgtagtgagctatgatcatgccactgcactccagcctgggcaacagagcgagatcctgtctcaaacaaacagtttccttctgtttgattcttgctgaaaaattgagcatgccagagctagcaaggctcttagaggtggtctggtccaatgctttaatttcatacatcaagaaactgaagcagagcagagtgacctgcccagggtctctcagccattcatgctcagaaatgtatgggctcctgtgaaacatgtggctcttaaaagcactatcatatatttgaaggcagaaaataggctaaaccttcagccttcagacttttcctctccagagaaaatgaccccagtttcctcactatggttgctgggagctagattcctggggatctggcagtgtggaccacctagtggtggctagaggagcaaataatatcccgcattccattttccactcaccaatccctgaggggcagcctgctgggttatgagcccacagggggagaaccccaacgaattcagagatgcatcatggaccagtttctcttaaggggcctgggtctactattttcagttctacttcgagagaagtggcctgcaatatcctgcagatttcccctccagggagaaaagcattgtgcrgtgcaaggagcacaggctttgtggaaagaggcatctggggttgagatcctggctcttttgcttccttgaacaagttaaccaaatctctgggcctctgctggttaatttataccatggggatcatcatttctccagtggggttgtgaagagaatgtggtgggatcttgtgtgtggagcatgacacttagcaggcatccgggaatggcagcctcctccctttctaaactggggctttctgagggtgacttcagattccacaatgtcaacagcacaatggcatcctcataaggaaagtttgggttggggctcctcaagcaattctctactctcatttggtacaaagaaaaaaattaagcctcacaattttcttggcaccagactgaacctcaaacccagtcttcacttttactaaaaagccataaacagagaccaggagggtaaaaactaccagaagatacactggatttagaaaacagtaagctggatgtgaagccaaaagagagggagaaagcaacataaaagaatgtcagattgaagaagaaatggattctggccacctaaagaagaagggaagtatagaaaagggaagctgattggaaacaatgggtaatgatgagtgtccctcccctaaaaagttaaaaaataaatgagcaggcatgagaaaaggaagtaggccagaggaagtagaccaggatcagccacggatgtgagtggggaattttacaaatttctacttgggtgtgaaacatgtgtacactcaaagctctgtctaggttcaccgaaactctcccagctcaaggccatttagtaaaaccttggcttaactgaatagtgggtaaggaggcctgaggatggcccagagaaggtttaaattcttactggctgctgcactaagttgtaaagtgcagccttagttgatgatgcctttattagtgcaacatcccagaatgcatgcgtcttacaacccttgtggatatgaaacccagctgggtagacactgcaaagtcttctcatttgattcttccacttggtttctagtgtccctcagggacaaaggaaagccatggtccagtctaagatgaaaaccaattagacctctggcaggcctttgaccaccctgagggccacccccaaggcacggccacactcgcatctgctgccaggaggccctatcttaggctcmgctcccaaaccttgaacatcttggaggatccacaaataggaggtacactcagctcaggctcagtcttccttaaaaagygccttgctaaagctatcaagttcactggaatacttctgcgaaggacacagcttcagcgatgtcagattttttatgtaaatggtgccttcacatgctctggggcatttggctaccaagggcggtttgaactagctccagcacacagaatacaagtctcttcagaaccaggcaaaaccctatgttgcccaatgactcctgctgtttcttgagatttgcacagaagacagagctgcaattacccacgctgatatctatttcatgaccacatatgttcaaaagccacatgtgagaggtatggttgaaatgagaggttgtgtttgccaagttgtcttctgactgtggagagctggtgagcctcttctcatctcctggggctccatattatagagctgacgaatctcttttcttgctccttgaagtctttcattcacttatttattaattcatttaacacatcaggcacctactaacttctcagagttcaaggcttcctagcctatgatcagaaaggacacctgtgtgctcatgagcacccctgggatcagggtgactgatagggtgctgtcatcactactagatgaaactctttggaacaaaggtctaggatataatatttatccttctgcaaatattcatatggcattcgctgtgtaccaggccttctgttgaacattggcctgcagagctgaagaggacgtgggtcttctcttaggaactcctagtcttgggaaaaaggaatggggaagggctgtaatgtgaagttaaaaaaaagtgctgaggccgaacacatctgggccctcactgcagccctattgcacacacactgcatcacctcgaacaagttattcaccctctctgaattcatctatttgcccataaaaatagagatgatccttttatatgttggctaccacttattatgtgcagcatgcttgttattgtactaagttactcattttttagtttttcatataactcatatttttgttgatttttattttaaaattccaaacgaattaattaaactattttccaaaatacgtagtatgtgtacatggtaaaaaacatttccaaaagtttaccataaaaactgtctcctttcccatatcctcaatccttcagaatccctctccagggataattaccaccaccagtgtattccttaagagatatttaaactttatacaaaatacgcacacatcattcttttccacaaatgacagcatactatgtacatggtacctcacctagcttttttcacttaccagtatatcttagagattgttgcatgacagaatatacagatctgcctgtttttgttgtttttcccaagtttccaagagctagaaactgtttggtttttaagcagctgcttggtattccattaattggacttatcgtgctttgatctgtccctagtgatggacattggggttgtttcccttcatttatatttgaagcttgttgcagtgacagtgtacacacttgcttgagcatgtgtgtgtctacgataaatcccaataagcaatttaaagtaatttaattcttatgctctcaacaaacctaagaggttatttttttagaggaggaagctaaggctgttgttttgatgcctttttaccactggacttgggactcaactgtttgatagtcatcgagtccttgactcttctcccctgccaggatttggcccctaagcccagggcccgagtctcctccatcttcaagggagagtgggaacagcacaggccttggcctcagtcctgctccccctgcttctagctgtgggatgggccaggtgcttcacccagctgtgcctcctgtgaggcacagtgtgtgcaaaatggaaatgtgaacatgaagatcaaaaatgtccctcaatgaccagtgctgttcctcagagtcacgtgggaactcatagaaagcgatattggtactgctctttcctctgtagcatggtccagatggctcatagcagggaccatgatatgctgggtgagcacccactgcatgcacccactgtgccagcactgagagactcctgtgggagccacagcaattctagggtcttcactggggactctgagacagcagggagctaggatgagggctgcagagtgttcgtctgccctcactgagcagaccccctggatggcagggagcagtcccaagccagatggatgcccataaccagccatttggctctcaatacataatatcaccacgtatcaggcaaaaccatcctgcccagagcattatctgaatttgcatcccatctgcagaagatacattcacccacttcttccattctgtcttaatcaaagtctttatgtgaattttccccattgagaagacaagccccttcctggcttagactgtacctgactgatcttttcatgagctccttgccaagccagaccacccccagcttatatggagacttggtgcaaattagagatgcccctgtgcacgtggcagccctgagcccaagcacccagtaaggcaaagggcctgatttgggacccctctgccactccaccaggcaatcagttgcttatttctaactttcccttccttctccacatttgtcccattccttcctctcatcatgaatatccccagaggcattcagcagtgcagtgaattaaatatagaactttttttttttcagaattgcagaacggattagatcaatattaatccaaacagagcaatgagcctgacagtttagtaaaagctcaataaagggtggcttacctcccccaaaataatctgaaaagaaagcatgtcttatttcagggggaaaaaaaaataaagtgacctttaaagaccaaattcccaggatacccagggtggaggtggaacatgggagtccacaggcagcctggatgtttccaaagatccaaagggcttttgcttcctcacataatgcaggaaacaaattgaacatgtattaagtgcttgctgtatgtgacacactgtgccaggtgctccccttaaaacagttctgtgggcaggcatgagaatgaatcccgatcttacagrcaaggaatgttaggctcagaggtttcaagctcacccatcactcagccagagaggacagatgcaggattcaatctcgggagtgcccgagtccacagaagttcctgtgctgaaggaccgaccacaggcacataaagagatgcgagacaatttttactggatttggccacctctcgaggtcggctttgccagctcttctcactgggggaaggggagggagaaagtagctagctccagggtccctaacatagaaccaccaaggacttgactatttttactcatacagcagcttgtctgggaagatcatgctctgtgacaagctgcaggcactaagtagcaatttctgtttcccacatattagcttgagtcatataaaactgacatggatgtggctcaaaaatagctgtatgtcagccattttataccatttgacttaaatgttattaattaacgtcacagccagagattattctctgagaaaagggcattgtagcctgaagcagagaaagcatacacgttccctggggttgagaactcatcacagcctgagacagcttaggttgtaaagccccggcccacttatcccaggagagtctgggtgagatgcaggccccaaagcagaggctgggaagcgagaagtgacacaccctggctgggtgggccctcatcttggtgagacaccacctgggtaaaaccatcatggaaagggtgtagtggggcgtggaaactccctcggttaaagcgtgagctttgctgtaagttgtggtaaggagggaggcagtgacaaccaggaggcctgttttgagggtttctgagggacccatctgtggtatcacgaggagacscccagaggagccgtgtgaaagggctgcctcccagccggctctggagtgaatgagcagcaagtcctggctgcgaaaagaaggggagtgcagcctgcaraagtgtcttcttttttcaattcctgctcagaaggaaacaggagataagaatagtggggaagtccaaaccaaagtgaactatagggctggtaatcgtagggggaattagtcacccggagactagcccagcagactaacggagccccatcctccatcttgaatcagtcagcccctctatgactgcagagtcctgaatgatggcaacaccttctcttcacttagsgttgtaggatgaccaacagtcctgatttgcctgggactgaggggttcccaatagatgggactttcagggctaaaaccaggaaagtcctgggcagcccaaaacaaggtagtcactctagagtgtatgactctgtctgatacctgctaagaaagagaaggacttgttgattataaggagaagaggaggtgaaatggttctcaaaaaacaaagatgagggcttccgggtgctgttctgcccaaggctctgggtctgaggcttctctctccaggcctagcttcatggaaaagtaaggggccagagggtggaaaaggtggaaacaaaggaagaggatggagaattgctttggggaagtttggactggaagtgtgaattacagctgcacccccaattcaccccatctcacccccctccccctcctgctcatggttctccctttctcatccacacattggtcaaactagctagcttttggagagattttgggcagtaaaagtaaaacagatctgtctcaagcttcaaaaagcctagagctggctgggcgctgtggctcacgcctgtaatcctagcattttgggaggctgaggcggaaggataatctgaggtcaggagtttgagaccagcctggctaacatgatgaaaccccatctctactaaaaatacaaaaattagccaggcgtggtagtgcacgcctataatcccagctatttgggaggctgaggcaggagaatcgcttgaaccccaggggacagaggttgcagtgagctgagatcgcaccactgcactccagcctgggtgacacagcgagactccattwaaaaaaaaaaaaatgcctagagccaaatgctcacagagccatttactgcatggctttgggcaagtcaaaggagtccgcctctcctgtcagaagagtctgttgcagtcttcatcacaagactgttgtggggattaaacaagatggcaagtgggaagttgggaaatgtagtgtgcacccaaccaatatttgtttcttcctgcctgcctacatatgaggccacacagaattccaactttgtttctctgataactaacacagttacttgtttttctttctgatccaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcrtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagartcatccagacgctgttytcctgcaagaaccacaagaaagccaaagccattaaactgatccttctggtggtcatcgtgtttttcctcttctggacaccctacaacrttatgattttcctggagacgcttaagctctatgacttctttcccagttgtgacatgaggaaggatctgaggctggccctcagtgtgactgagayggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcaytgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaaytgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaaggrtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcytctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaactttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttccatctgtgtaatcttctttctcctattcaattatttcctgtggttaaattcattgccatggggaaaactgagtcaaagggcatgggaacacattatctttgcatacacacatatgaaagtcatatattacacaacctttactgagtcgtattatatacaaaacatgaacgcagatccagagctattccaaaggcaatgagaccaagcctcttccctcaataatttaaatgcagaagagaagtgaaggaataatcacgctttgcattaggtggtagcagaggagtactacgtgacttctgacctgcgtctttaagggacaggggttctccaggtaaagaaagaggtggcattccaggctgaggaaacagcatgtataaaggaagtgtgtgagagccacaatgtgagaaaactctgtgcgaatattaaaaggcgttagaagcggagtgggtggtaggaactttctgagctgagctgttagctgtgggctgagctaaaacaaccaatggagggggtgctggttctcctcagggtgtttacggggtttcttcgttattacctgatcctcattccaactgttgaaccataagacttttaattaaagtttaacctattcctggacttctaagaaggaggaaataattattttggcttgagaaataaaagaagagaaataaacactttcatttctagaagaaaattaaatttgtaacattaggaacctatatttattcattcattttgctgaataggacagaatagggagaaaataaggaagctcattgaaaaatccaaaatagcaaggatgttggtgtctaaataaaggaaggcatttttggaaaggacagctggccctcagagcacacctgaatcagacccactcctgcttctgaggtctgggcttcccaagagcagagggatctgcctgtgatgaatcccgacatattaactctctgcttcggcaggttgcttaacatctctgaggctcaatctcctcatcagaaaaataaagataaaagtagttcccacctggtagggttggagcagaggattcagtaagattacccctgcaaagatcacagtgcagaactggcaaagcaagctcgagtgaatggtggtgattatttttatacttattatttttaatattagactgagctttccccagcaactaaacacatgctatcttgtacttgccttttgcttttcttagtagcagaatcacagactcttgggtggttggagataactgggtccaaatccacatttcgtgggtaagaaaatggaggctcagagagggccagcaggtgccccaagatgccacagtgaattactgggagaggtagatccttgattcacagtctaccatctccttcctcatcttgataaaaatacagatcaatctgacctctaagagcagagaacacagaaggaaggtctgcaggcagataatgaggcagggaaaagcagcccacaagatagctgaagagtttaacagaatcaatctgcacatggacaggtgtgtgctgtgtggcacagcctttggcaattgccttttggagacatctgtatctgcaatgatagatggtgtcaactgagactcatcagcaaaggctgcagaattcccagaggcaaatgctatcagtggcttccaagaggatctgggtgggtgggtcaagacttagacagacaggccactgtggagggacagccacacccaggggctgcccagtgcttgggtaaaatgctgaatcccttccacataattccactcacttcatgcttattctatggtcatttaatgacattctaagagaatgtctccttcccagggaccttgccatcaagaaagatggagcatataggctttcggttactaagaagagctatcaacccttgtaatccattgcacctagagtgtgtacagggtctcatggtttttccattcacctctctctgagatgctgtccctgagcatccagggagagagttcacccaacaactacacctgggagcataagagcctgattgagaggtccaccttgggtagtacccgggcccaagatgatgcccatttgtgccttcaaaattggagcagtttgtcctaactcagcagctaattttttctccacctgcaccgtactcactggcccatggggaccacttcagtttcaacatgatttgtaatattgtttgcttaacttgctgagttggcaacaaaattttgggctactcaaaagtagtgtgatctgagagcaagtgagaaaagcgagtcttagcaaatttagaaatatccagtttctcttcaatatactcttcatccacaggagggccaagggccaagtcgttttctgagggatgtgtggcatcatgcttctatttccgttacattacagcagttgttaggcaacagggagtgttcctccagacacacccggggcagcgctggcaaccgcaaaacatgctcagcaggaagattactcttttactccatatttccttatttactgagatagaaacaaaaataacattttaatttgcatttctttgaatactaggtaagattgttcatttttcaaggcgtttgttttaaattatttgtacatttttctgattctaaaagaaagatactcagtatagaaaacatgaaaaatatacaatttaaaattaaaaatgtttaattacacaatattcaacctcccagagataactgtggtttaacactgaagttattttctgctatgaccatattttaaaaaaaatacataagaatagacatttttcaaaagaagacacacgaatggccaacaggtaagtggaaaaatgttcaacatttctaattattaggaaaatgcaaattaaaatcacaatgagatatatctcagatttgtcagaatggcttttatcaaaaagacaaaagataataaatgtcagcaagaacgtggcagaaggggaactgttgtgaactgttggtagaaatatgaattagtacaaccattatggacaacattttagaggtgtctccaaaactaaaaatagaattactatatgatccagcaataccacttctgagtatttacccaaaagatgtgaaatctgtttgttaaagagatgcctgcacccccatgttcattgcagcactattcacaatagccaagttatagaatcaacctaagtgtccatcaacagaggagtgaataagggaaatatggcatatatacacaatagaatacaattcagcctttaagaagaaggaaactctgttatctgcgacaacatggatggaattggagaacatgatgctaagtgaagtaagacaggcacagaaaggcaaatactgcatgttctcacttatgtgtggaatctaaagcaatgaaactcatagaagcagagtagaatggtggttacagatggtagggggtggggagagagcagagagctgatggtcagagggtacaaaatttcagctagataggaggaatatgttgcttttttctttttcggagttttattacacagtgtggtgaatctagttaagaatagagtattgcacatttcaaaattgctaagagagtaaatttcagatggtctcaccacaaaatatgttaagtatttgagatgatgagtatgttaattagcttgatttaattatttcacattgtattcataaatcataacagtgctttttaccccatagttctatataattataaattgtccatttacaattttaaaaactgaacaaaacctaaaagcacttgaatttcatcaataagaaaatggtccaataaatttcaatttagccatacaataaaatacagtataatttaaaagaatgagtcaattctataaatatgaccctaaagggatgtccataatatatccttaagtcaaaaagacaaatttcagagttaagcacatttttatttttaaatataaactatatatatatgtttatatatataaaataagcacatttttattttttaaaaatttgagatgagaacatatatacagttttatatcttcttttttcaattagcattatagtatgatcattttcccatctattatattcaaacatgattttgaatgattgcaaaggactcaataatagactttatccatccaagccctactgacagacatgggtgttactcccatgcttttctctatgaggagtgacagtatgatgaacataaatctttgcacatatctttgattgtatgaaaggaattagtagactaagagatttcagcatttgtaaatctcttgctagctactggaaatttacttttcagagagatgacactgtgttgctggctctctaagactcccaatccctgaccttagcaccacctaccttcctagtctttgaggtcaggatattgtgggcttttgttattgggtgacaaaccagctactgactttaagaggcagaaagaaaagacttctgttcttaaaaggagatggtaaggctgccctttagaagagagaaaagaagagggatgaggggatttttaaaacaggacccataacatcccaaaacagttattttaagggaacagagaccacttagcacctgggctaaggggacacaggacaagccatcagagccatacagcatcaggcaagagcaggaggtggagagacttgttctgaggataatggggtttcctagcaggagaagaagaaatagaggtgagcagagcaaccataaagcccttgtgcagtttcaatgttcaaaatatccacttctatacaaaacttaaacaacctgcaaaaggcaacagagagaactgattcaagatttagcacagttgattggactttcaacgtatccaccgtcattctggatatacttgtacatagccatctcagcataatgtagagctcacacctgtaaaataaaagaaagaacaaaatcaaacattagcaactttatttaaatattttgtaaattatctctcggttgcatttcacaaattatctatacgttacatggaagtaaaatttattaaaagttcaaaccatagtgactttatgcatactttataccttgggctttgctggcagcagtgatgctccaatcagccagggaaatccatgagttccagctttaagaaccccttggcatatcccggtactcttgctttggggaggaggatgcccagctgccagactgggaaacctaatatcaaaaggctcatttacacttccagcactactatatgagtttccctttgaaagcgcattatttcactgaggaaatagaaccagaaaagaacttccatggcctaccccaaccacatcttcccatcttyctgcagctgtgccagtgcactctgcagtccctcctcgtatcatggaagaatcgtccctgcgcttatctaaagccaaacctgccacctgaacgatgcatcccagcccctttaaccttcccctcctgcatttatcccctctcctgcattatctgtctctcccctctgctggataattggtatgcaagcaggccagaatacttctcatttttaggagcctccccttgataccacatctcccccagctcctgtccatgcagaggcactcaaaagagttctctccagacagctccctatgagcttgccccatgtgtaacccttctatagcccgcaacccaatgtccctggcctgtctttccccttgaggtgagctcattcttgaattttcttctcaaccctcccccagacacactcttgtcaaagtcaccagcgttctctgtgttgctaaatcccatggtccataatcaggcctccccttacttgacccattagcagaattaggcaaagtttcttgaagcagcttttccattcagctttggagatgccactctctcggttctccaacaacttcactggatgctcctctgcagtctccttctctggttccttcttgcctccctaacctctgtgcatcaagggcttcaggctcagtctccagacttatctgctcctctttccttc

SEQ ID NO: 17630 - DNA, 62555 bp, Homo sapiens
acagggttttaccatgttgtccaggctggtctcgaactcctgacctcaagtgatctacccgcctcggcctcccaatgtgttgggattacaggcatgaaccaccatgcccagccttgcttattttaaatctgaaaacataatatgataaaaacgtataagcttgcctgctgaaaattaaaccctaattcaagtctaaattttgaagatggcttgagggaaaaccttcacacaggagatggctgacttagccattaattctcagatgttctgtggtgagataattacagtttttccaaacaggtcaaacctgtatggttaactaatagaactaattttttttcttttctttctttctttcttttttttttttttttgagacagaatctccctctgttgttcaagctagagtgcagtggcttgatcttggctcactgcaatctgtgcctcccaggttcatgtgattctcctgcctcagcctcctgagtagctgggattagcgcgtgccacaatgcctggctaatttttgtatttttagtagagatggggtttcaccatgttggccaggctggtctcgaactcctgacctcaggtgagccgcccacctcggcctccaaaagtgttgggattacaggcatgaaccacagtgcctggcctaagttttttttattcatgaaaaatatatggcttcaattgttaacaatgattcctcttgggatttagggatgggcggtggacactaaaacaatgcttggggccgggcacggtggctcacgcctgtaatcccagcacttggggaggccgaggtgagtggatcacgaggtcaggagatcgagaccatcctggctaacatggtgaaaccccgtctctagtaaaaatacaaaaaattagctgggcttggtggcgggcacctgtagtcccagctactcgggaggctgaggcaggagaatggtgtgaacccgggaggcggagcttgcagtgagctgagatcacaccactgcactccagcctgggtgacagagcgagactccgtctcaaaaaaaaaaaaaaaaaacaatgcttatccttctttacacattccatagtgtttgaatctaaaaacttatactctttttgtaatttcagagcaaaacaaaagaatttggttggaactgctctacagagaatcaaagaaatcagcctgaattatctgatcttaactgaattttcaaaagactgtctaataccttctaattaccacaagccagcttgtccttttccagccgcctggcagtacagatgatagataatccgtctgaaaaaggcttcctcagggcagtgacatctttccaggttgaacgggatttcttcaccgcacagggagagtctgaagatccttcccaatttcttgtaaacgaatatagttccttcactctgttgtgttttaaatatttttatgttttggtttgtttgtttgtttgtttgtgtataaggatagggtatcactctgtaacccaggctgcaggacagtggcctgatcacagctcactgcagcctctacctcctggactcaagtgctcctcctacctcagtttcccgagtagctaggactacgtgcgtgcaccagcacacttggctaattttttatttttatttttagtagacacaagggtcttgctaagttgcccaggctggtctcaaactcctgagctcaagcaatccgcccactttgacctcccaaagggctgggattacaggtgtaagccaccatgcacggccaatattttttgttttttaatggtagtttaatttttttttttttgagacagtcttactcctgttgcccagactggagtgcaatggcgtgatcttggctccctgcaagctccacctcctgggttcaagtaattctcttgcctcagcctcccgagtagctgggattacaggcatgcgccaccacgcccggctaattttgtatttttagtagagatggggtttctccatgttggtcaggctggtcttgaactcccaacctcaggtaatccacccgccacggcctcccaaagtgctgggattacaggcatgagccgtggtgcccagcctattttttatttattttttattttttgagatggagtcttgctctgttgcctaggctggagtgcaatggcgcgatctcatctcactgcaacctctgcctcctgggttcaagctattcttctgtctcagcctcccaagtagctgagattacaggcgtgcaccaccatgcccagctaatttttgtatttttagtagaggcagagtttcaccatgttggccaggctggtctcgaactcctgacctcaggggttctgcccaccttggcctcccaaagtgctgggattatacgtgtgaactactgcgcctaatttttttaagtggtaaagttatacatcctcattgtaaaaaaaaaaatgcagaccatatagaaatgtataaatctcattttacagagctaaccactgtttaaagtatggttgtatatcctttccaatttaacaaatatatacatatatataatttcatgtttattttttattgagatacaattcacataccataaatcaccattctaaggtatacaattcaccaggcacagggctgtaatcccagcactttgggaggctaaggagagaggatcagttgagcccaggagtttgagacctgcctagacagcatagtgaaaccctgtctctacaaaaaatacaaaaattagctgggcatggtggcacacacctgtagttccagctacttgggaggctgaggtgggaggattgcttgagtcagggaagtcgaggctgcagtgagccatgattgcaccactgcactccagcctgggtgacaaaacaagatcctgtctcaaaaatttaaaaaaaagaagtatagaattcagtgatttttaaatagattcacaaaattgtgcaatcattaccacagtctatttccagaacatttcatcacctaaaatgaaaccctatgcccattagtactcgctccctagcctccatttccccagcaagcaccaacttgctttctgtctctctagatttgcgttctggatatttcacttaacggagtcagactatatgtgactttttttttgctggcttctttcactaagcatattttcaaggcttactcatattgtagcatgtaccagtactctactttttttttttttttgagatggagtctcactctgtcacccaggcaggagtgcagtggcacgatcttcgctcactgcaacctctgtctcccgggttcaagagattttcctgcctcagcctcccgagtagctggaattacaggcgtgtgccaccatacccggctagtttttgtatttttagtagagacggggtttcaccatgtcggccaggctggtctcgaactcctgacctcagctgatttgcctgccttggcctcccaaagtgctgggactacaggtgtgaatcgccagcctgattcttttttacaggcaaataatattacattgcatggctataccttattttgtttatccatttatcagctgatagacatgtaggctgtttccagtttggggctagtgtgagtcattattcatactgctatgagcatacatgtataagtttttgtacgaacatatgatttcaattcttttgggtatatacctaggaggagaacttctgggtcatatagtaactctatgtttaacgttttgtttttgtttcctgagacggagtctcactctgttgcccaggctggagtacagtggtgtgatcttagtttactgcaacctctgcctcccaggttcaagcaattctcctgcctcagcctctcgagtagctgggactacagggcgcaccaccacacccagataatttttgtacttttagtagagacgggattttgccatgttgcccaggctggtctcaaactcctgacctcaggagttctcatgtcagcctcccaaagtgctgggattacagggatgagccaccatgcctggcctatgtttaactgttttaaagaactgttgggctaggtgcggtggctcacgtttgcaatcccagcactttgagaggctgaggcgggcaaataatttgagctcagaaattcaagaccagcctgggcaaggtagagagacccccatgtctacaaaaaataaaaaagtagtcaggtgtggtggcccgcacctgtagttccagctactcaggacgctgaggtgggagaatgactcgagcccgtgaggttgaggctgcagtgagccgagatcacaccactccagcctaggcaagagtgagaccctctctcaaaaaaaaaaaaaaaaaaaaaaaaaaaaaaagaaccatcaaaatgttttgcacagcagtcacgccattttacatttctgccagcaatgtgcaccaggcttccagtttcttcacatcttcactaactcttatttcctttgctttaaactctaaccatcaaagtaggtgtaaagggtatctcactgcggttttgatttgcatttctctaatgactaatagtgttaagtatcagttcatgtgcatgttggccatttatatgtcattggagaaatgtctactcaaaccgtttgctcatttagaaacttaggtaggttggtctgagtgcagtggtgtttaaaactaatttttttttgagacaaagtctcactctgtcgcccaggctggaatgcaatggtgagatcttggctcactacaacctccatctcctgggttcaagcaattcttctgcctcagcctctcaagtagctgggattacaggcatgcgccaccacgcccggctaatttttgtatttttggtagagacgggggtttctccatgttggccaggctggtctcgaactcttgacctcaggtgatccacctgcctcggcctcccacagggctaggattagaggtgtgagccaccgcaccaggccgtttaaaactaatggagcacaaccagttaccaatatctttgttccttctccactccctctgcttcacttgactagcctaaaataaataaatttaaaaaactgggcacagtggctcacacctgtaatcccagcactttgggaggccgaggcaggaggattacttgagcataggagttcaagatyagcctgggcaacatagtgaaaaaccatctcaaaaaagaaaaattagccaggcatggtggcatgcacctgtggtttcagctacttaggagcagaggtgggaggatcgcttgattctgggagttcaaggttgcattgagctgtgatcgcgccagtgcactctcgcttgggtgacagagcaagaccttgtctcaaaaaatttaaaacaaaacaaaaaaaactggttatttgtctttttattgttgaattataagagttttaaaaaatatattctggaaacaaatcccttattagagatatgatttgcaaatattttctccaattttttttttttttaaagacaaagtttcactttgtcgcccaggctggtcttgattcctggcttcaagagatgctcttacctccacctcctgaagccccaaagggctggaattacagccagtgagccactgcacccagcctccaattctttagattttacattttagaaccaaaatgggttaaatacactgttctgtaatctgctcttttctttaatagtagttcatgtacatctttcaaggtccagagaaagctctcactttctccccgttttatttttccttccctcattctttttcactgctgcatagcattccattgtaattttgccactgtttattagaccagtcctctgctgagctttacagagcccttagttgggatgttagtgagaaaccatgacagcagtggagactgtcatctccctgacatgctgtcagcttttggatgatgtgaaaatgcaagcaggcacaggaaatgtctctaacttgcttacacttcctccctgaacccctgcggtttcacaactcctgcaggcacacctccctccccgcctgccagtgtcaccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcggtaggcaagggaggaggcaggggaagggacatgtgtctgtgaccagagaaactgcagggcttggtgcagctggagtaaacaaggagctgccccctaaaagtgggattggccttagggatatggggcccagggatcttggaaggagaaaggggagagtggggaaataaaagaaacaaataagcaaggggtggaggcaaagacagagaagggagcataagaaggggcagtgggttctttaaaaagacagatagggccaggcgcggtggctcacgcctgtaatcccagcactttaggaggctaaagtgggcagattacttgaggtcaggaatttaagacagactggccaacatggcaaaacctcgtctctactaaaaatacaataaaattagcttggcgtggtggcacaggcctgtaatcccagctactcgggaggctgaggcatgagaatcatttcatcccatgaggcagaggttgcagtgagccaagctcgtgccaatgcactccagcctgggtgacagagcaagactctgtctcttaaacaacaaacaaacaaaaggcagatagttattgagtagctagagctgggaggagggtgctgggttctggggccacctctgcgcgttttaggcaagtcctttcccctttccagccccacacccttcatctaaacaaatgaaggcccagcctccatgacattctaggatgctctgaactaaactccatgcggggagagaaagcagggcggaaaggacagctgggtgtgccagggcgcctgggcaggctgactgagggggaagggagctgggatctacagatgctccgaaagactggcccggtggggtggggaggcagccccccagggatcaggggagctacaatctgagactgtgggaggaggcgcctgggccccatgaccgcaggagaagtgggtggcagaggcgcacccggctcgggggcatccccatcttggcctctgcctgagaacttggtcaccctctgccttggggccccttgggtctgctcctctctctggagcctctaacttctcatccttccttttttgcagagaggccaaacgggaagttgtatcctcaggccctgggaagagctttcagagctctaggggggccgggagttgctccttccatattcccagaagtcaacgccctggagsggaagcgcagggtgcgggtggcctggggagcgacatccgggtgggcctgggatcggccacctgctgggcacgtgcaggggcgggggtccctcggtcgcagctgacgacccttgccttcctcagcgccggcctcgagctacaacctggacgtgcggggcgcgcggagcttctccccaccgcgcgccgggaggcactttggataccgcgtcctgcaggtcggaaacgggtgagctgtgccccacaagtcctcctcctgatgcccgccctggggcagcccccgaggcggtggccgcctccccgaccctcgcctgggctagtcggtggcacgaggcagctctccaggggttcccgtctggaggagcctgtggtgggaatcctcagagacaggagtgagggatcaaaaagcgggatacacgcgatcagggaggccatggaagtgcagaacagggaaggatcccagccccaaaacacttcgcattgcccagtaggttcctgacactcccttactcccctgcgagcgcctggaagccaggagtctgttctctcttcctaacccttcttagatacgccaccgcccagcacacagtaggtaagccatgaatggcttttgaatcaaggattgaatgaatgtacttatcatgagacattctggcggatcattctctgggcctcagagactgtaaatgcaaaggaaccttaattttctaggattttagcatttggaattatttctctgcgattctgtagggaagagatgaggacggaggcatcttctttttttttttttctttttttttttttttgagagggagttttcgctcttgtcgcccaggctgtagtgcaacggttagatctcacctctctgcaatctgtgcctcccaggttcaagccattctcctgcctcagcctcccaaatagatgggattacaggcatgcaccaccacgctgggctaattgttgtatttttagtagagacggggtttcaccatattggccaggctggtctcaagttcctgacctcaggtgatccaccgacatcggcctcccaaagtactttggcctcatgcgaaagttacaggcatgagccaccccacctggccagaggcaccttcttgaaggggaatggctgcagtgcttggagaaatgagacaggagatctgaacctccttagcaggcaggagtagatgggtacagatctgggccactccctctcacaggtgagatttctcaccagggtcatcgtgggagctccaggggaggggaacagcacaggaagcctctatcagtgccagtcgggcacaggacactgcctgccagtcaccctgagaggtgagtaactggggggtgagctgggaggaatgggatcttggggaaactgaggctggccccascccacctagactgcctgagctcctccagaccaaccttctggtgcctacaggttccaactatacctccaagtacttgggaatgaccttggcaacagaccccacagatggaagcattttggtaagaattttgtgcagtggtgttatcagagcctgtgaagctcaattcaagtaatgagagaagaaaagaagaagaatgtggataaaagttcccacagatggtcaaaggcatcagagtcaattagtgtttattgagaaccaatgatgaaccagccttttttttttttttttttttttttttgagacaaggtctcattctattattctattgcccaggctggagtgcagtggcgtgatcacagctcattgtagcctcaacctccctgcactcaagtaatcctcccacctcagcctcccaattagctgggactataggcgcatgctaccatgcccagctaatttttatattttttgtagacagagagtgtcaccatgttgcccagactggtcttgagctcaagaatcctcctgcctctaatcccagcacttgggaggccgaggcaggcggatcacgaggtcaggagatcgagaccatcctggctaacayggtgaaacccccatctctactaaaaacacaaaaaatcagccgggcatggtcgcgggcgcctgtagtcccagctacgcaggaggctgaggcaggagaatggtgtgaacccgggaggcggagcttgcagtgagccgagatcatgccactgcactccagcctgggcggcagagtgaaattccgtttcaaaaaaaaaaaaagaatcttcctgcctcagcttccaaagtgctgggattacaggtgtgagccaccacacccagcagagccagctattttcaataacttaacctcacttttcttccaaatatgaaatatctgtgatcattgatatgcaatatgatttttagtggtatacaaacttttaatgttttcatggttataaatttaatggcttattagaaaaaaatatatgacaagcacatcaaatttataatttcttacatcatattgcttaggaagaggctgaagttaaacaaaaatttaaaggaaaatattaagaaaataatagtatgctcatatggcagatattgtgaagtattacacaaatgcctaaagtttaggaaacactgcttttttttttttttttgagacagagtttcactcttgtcacccaggctggagtgcagtggcatgatctcagttcactgcaacctccgcctcctgagttcaaacgattctcctgcctcagcctccggagtagctgggattacaggcgtgtgccaccatgccttggctaatttttgtatttttagtagagatggggtttcgccatgttggccaggctggtctcgtactcctgacctgaggtgatctgcccgcctcggcctcccaaaatgctgggattacaggcatgagctaccacacctggtcactttatttcttttaaaccctcaagacactccggtgagatagggatcagtgtacacatttcacacacgaggaaacaggaccaaagggttaagagacttgaccaaggtcacatggttgcaaagtggtagagtcaggatttgaataaaattctcatttgatcccaagttcattgctctctccaacttatcccagccagcatccttctgtgtgagagatagaagactgagtgaaatattcatccagtatttaagtagagcttgtttatttagctactattatagccaggcattgggcgaggttctgacaggggaaggggagtgagatacaaagttgatgaggccgggctggtggctcacatctgtaatcccagcactttgggaagccaaagctggaggattgcttgaggccaggagttcaagaccagcctggtcaatcctgtmcctacaaaaaaaaaaaaaatgtttttttcattagctgggcatggtggcacacacgtgtagtcccagctacttgggaggatcagttgaggccaggagttcaaggctgcagtgagcttgatcataccactacactacagccagggagacagagtgagacctgtgtctaaaaagaacaaaaacaaaacaaagcaaaaagatgaccatgatacaagcccagactttgaagaaattgcaatctggcaggaaagggtcataaatgaaagaaatgactttgggaggccgagacaggtggatcgcttgagcctaggagtttaagactggcctgggcaacatggcaaaatgccatctctacaaaaaaaaaaaatagccaggcatggtggcgtgtgcctgtagtcccagctatttgggaggctgaggtaggagaatcacctgagcccaggaagttgaggctgcagtgagccatgattgtcccactgcactccagcctgggtgatgggagtgagacctgaaaagaaagaaagcaaggaaagaaagcaagaaagcaaagaaaggaaagaaagaaaggacggagggagggagggaaggaaggaaggggagaggaggagagagagataggaaggaaggaagaagaaaaagaaagatgaaggaaggaaggagaaggaaggaaggaaagaaagaaaaggctgggtgcagtggctcactcctgtaatcccagcactttgggaggccgaggtgggcagacacaaggtcaggagtttgagaccatcctggccaatatggtgaaaccccgtctctactaaaagtacaaaaattaactgggcgtggtggtgggcacctgtagtcccagctactgaggaggttgaggcaggagaatcacttgaacccgggaagcagaggttgcagtgagccaagatcgcaccactgcactccagactgggtgacaaagcgagactccgtcaaaaaaaaaaaagaaagaaagaaaaagaaagaaagtggggggcggaggggaggggagaggaagggaaaaagaaagaaagaggcatggccgggcgcggtggctcatgcctgtaatcccagcactttgggaggccgaggcaggcagatcacgaggttgggagatcaagaccatcctggctaacacggtgaaaccccgtctctgctaaaaatacaaaaaattagccgggtgtagtggcgggtgcctgtagtcccagctactcagaaggctgaggcaggagaatggcgtgaacccgggaggcgaagcttgcagtgagccgagatcatgccatgcagtccagcctaggcgatagagcgagactccatctcaaaaaaaaaaaaaaaaaaagaaagaaagaaagaggcactgtatattctgggaatcttgataatttgatttggctggaacacagaaaaagagattgggactaggagaagatggacctggaaatgtggggtcgtgcccagtgtaagcccagataaggagtccagactcaccaccagtcctacaggcggtgagcatccattggcatagagcattggtaggatgggagggatggacagtagagactgtggaggcggacattccttgccttggtaaccagttggatagaggaagtgagaaagaggacaaggactctgaacgttcctagttttggttgatgttgcccaaaagacacatagcaaataggagacccaaatctttggcctttgctttctttaggcctgtgaccctgggctgtctcgaacgtgtgaccagaacacctatctgagtggcctgtgttacctcttccgccagaatctgcagggtcccatgctgcaggggcgccctggttttcagggtaaggaactggggactcattgggtaaaaatacctccaaatggctgtccctagagagaaccagcatgggcaggtcaaacaccagagatgcttcactgggtcccttgcgtctggcttctgcagaatgtatcaagggcaacgtagacctggtatttctgtttgatggttcgatgagcttgcagccagatgaatttcagaaaattctggacttcatgaaggatgtgatgaagaaactcagcaacacttcgtaccaggtaaaaaagttagttaggattcttggttgcatgcaatagatgcctacctgaactgacttaaaccatgaaagraaatgttagtatgtggaatcctcagagcctatgggcatggctataactgggcctctggaagggacaagaaccagggagtagaaagcttctaggagtctctctagttctcatttccttttttttttttttttttttgagatggagttttgctcttgttgcccaggctggagtgcaatggcacaatctcgactcactgcctcccaggttcaagcaagtcacctgcctcagcctcccaagtagctggtattacaggcaactgccactacacccagctgatttttgtatttttagtagagatggtgtttcaccatgttgccaggctggtcttgaactcctgaccttgtgatctgcccaccttggcctcccaaagtgctgggattacaggcgtgagccaccgtgcacagccattttttctttttgagacagggtctcactgtgtccccaaggctggaatcatggtggcacgatcatagctcactgtagcctcaaactcctgggctcaaatgatcctcccaactagctgggactacccatgtgcaccactgtgcgtggctaatttttaaattttctgtagagatggtttatcattgtgttgcccagactggtcccaaactcctggatctctcaagagatcctcctgccttggcctcccaaagtgctgggattacaggcatgagccactgtgcccagctagttctcatttctgtttctttttgcgtctttgcttccttcttctcttttctcagtctccgtagactggctcccttagcgcctttagaccacatagacctatggaaagctcctaagttcatgtgttaaagttccaagagggttttttaccttcccctcaaccaacacctccctttgcaaatttccagttctcagagaagaggttctggctggcgtagcttcagtcaggtgttgatccccggcccagccaactgtatctagttaagcagcgtcactcagcagaaatatggctgctggaacccatccctatcagtgacataggtggacccagaaaacaggagctcaacacacagtgttacatgagggagcaaggtttatttcattttatttctgtgtttatttgtatattgcctcattttcaaaagaattatctgaggcaaggatgtggagttgggttgcccaggtcctgcataagaagagattgagccaggcatagtggctcacacctgtaatcccagcacattgggaggcttagccgggaggatcacttgaagccaggagttcgagaccagcctaggcaacatagcaagaccccatttctacaaaaaataaaaactagccaagtgtggtggcacgtgcctgaagtcccagctacttcggaggctgacgagggaggatggctcgagcctgggaggctgaggctgcagtgagctatgattgtgaccgtgcactccagcctgggagacagaacaagaccctgttttgaaaaagaagaagtagagtttggggctgggcacggtggctcatgcctgtaatcctagcactttgggaggctgaggcaggtggatcacctgaggtgaggagttcgagaccagcctggccaatatggtgaaacaccgtctctactaaaaacacacacacacacacacacacacacacacacacacaccacacacacacaaatattcgggtgtggtggcacgtgcctgtaatcgcagctacttgggaggctgaggcatgaaaatcgctggaacccgggaggcagaggttgcagtgagccaagattgtgccagtgcactccagcctgggcaacaagagcgaaactccatctaaaaaaaaaaaaaaaaaaaaagmagtagagtttggaacagacaaatggaaagggatatataactgaatgtcatttcttccttccttttctagtttgctgctgttcagttttccacaagctacaaaacagaatttgatttctcagattatgttaaayggaaggaccctgatgctctgctgaagcatgtaaagcacatgttgctgttgaccaatacctttggtgccatcaattatgtcgcgtgagttcccttttgcaggagagcacgtgtcctgtgatttgttctgggtgatctacccacttccagctgcagggcatgggaactcagtaggtagrtacagcaaggggcagtttattgtctgaattgaagtggaacaattttactgcagattcttttggttgtacgtaacagaaatctactctgtactaattaaatccaagagaaagtctaagccaggtgcacagtctgtaatcccagggctttgggaagctgaggcaggaggatcttttgagcccagaagtttttgtttgtttgtttggtttttggtttttgtttttgttttttgagatggagtttcgctcttgttgcccaggctgtagtgcaatggcatgatctcggctcactgcaacctccacctcccaggttcaagccattctcctgcctccgcctttcaagtagctgggattacagacctgtgccaccacgcctggctaattttttttgtatttttagtagagataggctttcaccatgttggccaggctggactcaaactcctgacctcaggtgatccacctgcctcaccctcccaaagtgctgggattacaggtgtgagtcaccacacctggcctatgagccaggagtttgaagctgcagtgagctatgatcacaccattgcactccagcctggacaacagagcaagatcttaactctaagaaattaaaaataaattaaaaaagaagarccaggacaccaatgtggccggagagaaataagtgaggggggaaaatagtaggtgatgaggtcagagagatcatgagggtctggatgggttagtgacttggaggccatagtgaggactttggctttcctctgagtaagatgagaagtcattagaggttttgagtagaggagtgatgatctatgttttttaaaagatccctctggctgcagggttgatattagactgtagagggggcaagggcgggtggaagygatagggccagttagaaggctactgaaaaatccagatgagagacaatggttgtataaaccagggtggaaatccatgaacaggacccgcaataggcccatgtctgtgtggatggagattggagaagcattttgcatccaagatagaaccagaggtcttgacagcaggtgttcatgggtaagacggttcacaccttgctgctgttccagcaagagctatggccaacccaacttgctcagaggaaggctgtgggcaaaacaggaattttctttttcttttttttttagagtcaaggtctcactctgttgcccaggctggagcgcagtgacgtgatcctagctcactgcagcctcaaactcctgggctcaagcgatcctcctgtctcagcctcctgagtagttgggactacaatcacacaccaccatgcctggctaattgttttcatctttgtagagttggagtctcgctatgttgcccagaatggtctggaactcccagggcagaaatttttagccttggcccatctggtgttcagttctcccttctttattttatttttttaatttttttgagggtggaggattttagcaaaaaacagaaagcctgctagacaaattctaaaagagctgtaacactagttctccctccttcatctcacatgcacaaccgcctcctttgtgctgggagccagagatacagcaacaaatccaacatggtcctttccttgaggaactcatggtttagggggaaaattgacagagaaatgagtcacggtaattcactaggttcactgctatggtagagatccggaggcagcctgtggactatgggaaggcagaggaggtgctggaagagcttgctctggaagagtgactccccagttttcttcagctgtaggaccctctcttccacattgaaatctcacttggatcaatatctgtagctgattaaagagtggtggccatgtggttgcaatggagggtaggaagcccagagtcattcctcacaaaacctcctcctcctgtccatgggctctgggacaccctctggactgcccaggatgcagtgtgaggaccactggtccagaaggaaaggggtggcagcaaagaggtttagaggtgactgctgcaggcttggaatcccggcctgggagatccaggaagggcttttgcgtaaccagcatggaggtgacttgatgagcaggtggggaaagagacctcaggccctagtttgggggagtctctcatctcctcctttcctggacacaggacagaggtgttccgggaggagctgggggcccggccagatgccaccaaagtgcttatcatcatcacggatggggaggccactgacagtggcaacatcgatgcggccaaagacatcatccgctacatcatcggggtagggcccctgctgcttcctrcatcatatcttccctctcctctttctgaaccccaagcccctttctccctggggccagactcttgtgaaaataatagcaaactggactgaggtttgggggatttcagctcytcactctccactccctcacagattggaaagcattttcagaccaaggagagtcaggagaccctccacaaatttgcatcaaaaccygcragcgagtttgtgaaaattctggacacatttgagaagctgaaagatctattcactgagctgcagaagaagatctatgtcattgagggtgagtggcaggccctgggagagggctcgggagtctgcataaagaaattcccctgggacatcaggccgggctcggtggctcacacctgtaatcccagcactttgggaggccgaggcaggtggatcaattgagctcaggagtttgagaccagcctgggcaacatggcaaaaccccatctatactaaaaatacaaaaaatagccaggtgtggtggtgggtgcctgtaatcccactactcaggaggctgaggcgcaagaatcgcttgaactcaggaggcagaggttgcagtgagccaagatcgcaccacactgcactccagcctgggtggcagaggaagactccatttcaaaaaataaaaaacaaaaaacaaaaatggccggacgcggtggctcacacctgtaatcccagcactttgggaggctgaggtgggcagatcacctgaggtcaggagttcgagaccagcctggccaacatggcgaaaccccgtctctactaaaaatacaaaaattagctgggcttggtggtgcatgcctgtaatcccagctactcagggggctgaggcaggagaatcgcttgaacccaggaggcggaggttgtagtgagctgagatgtgccattgcactccagcctgggcaacacagcaagactcagtctcaaacaaaacaaaacaaaacaaaaaaacaaaaaaaaacctcccctgggacatcctattagaaacacaaagaataataagcacttactgaatatctgatcttgtgccaagggcttgcctaaataaaacagacctttagaaggaatttaggagagggccatttgagagcagcctctgtgatctttctttctcttccttctttctctccttccttccttcctcccttccttccctttccctctcctcccctcccctctcctcccctctcctccccccttcctctcccctcctcttctcttcttttctcttctctcttttctttttttttttgagacagagtcttgctctgttgcccaggctggagtgcagtggcgcagtctctgctcactgcagtgcagtggcgcagtctctgctcactgcaagctccacttcccaggctcacgccattctcctgcctcagcctcccgagcagctgggactacaggcgccagccaccacgcctggctaatttttgtatttttagtagagacagggtttcatcgtgttagccaggatgatctcgatctgacctcgtgacctgcccgccttggcctcccaaagtgctgggattacaggcgtgagccactgcgcccagcctcttttcttttttgcttttctttcacagggtctcactctgtcacccaggctggggtacagtggcatgatcacagctcactgcagccttgaccttccaggctcaggtgatcctcccacgtagctgggactacaggtgtgtgataccacacctggctaatttttttttttttttgtattttttgtattttttgtagaggcagggatctcgctatgttgcctgggctggtctcgaattcctggccccaagcaatctgcccacctcggcctcctaaagtgctaggattacaggcgtgagccactgcacccggccctctctgatatttctttctgaaattccatcttctcttggagctcaggttgatctaggactgacctatgtcttgctggtgtgatctgagccccgcagagtgaatgtaattcctcccccttcttgctcaactgtcttgctgtcacttatccaaggctccacattacttcagaagggcaggctggcaggggccagtgtgaagaacccacaagtcttctttcctggcctagaataagagaagatttatattgtggtcaccagatggaggactggttatggagggcatttccccaggaagcttacttgactgaaagatatgtgattcctacaggaaagtctcctttgctaggacacagccttggtgttcggttcagttaaagaagcaatgggctgagcgtggtggctcacgcttgtcatcccaacactctgggaggctgaggcaggcggatcacttgaggtcacccagctacttgggaggctaaagtaggagaatcgcttgaacccaggaggcagaggttgcagtgagctgagattgtgacactgtactccagcctgggtgacaagagcaaaactgtctcaaaaaaaaaaaaaaaaaatcagcagcaatggtccagcctgggcagcatagcaagaagccatgtctaaataattaataaaaatgaaaagtgattttttaaaaaaaagtttttaaaaaaaactcactctcaactggcttttaagctgagatatgaaagatgagattcaaacagcaatgtgagaaaggtggaatgagggcagagagaagcacaggtgcaagcccaggggcggggaaagggctcggcatgccaggaaaatggaaaaagttcagtgtgaccgaagcgcagtgaggaagggagagagaaggttggcagggaggtaagggtcttccaggccctcagaaagagtttggatttcagtgtgaagatcgatgagaaatcatgaaggagttttttkttgttgttgttttgagacagggactcactctgttgcccagactggagtgcagtagtgcgatcacggctcactgcagcctcaaactcctgggctcaagcagtcctcccaccttgacctcctgagtagctggsactacagatacacaccaccacacctggctaatttttaaattttttgtagagacaagagtttcttagccaggcgtggtggcgggcgcctgtagtcccagctactcgggaggctgaggcaggagaatggcgtgaatcctggaggtggagttcacagtgagccaagattgtgccaccgccctccagcctgggcgacagagtgagactccgtctcaaaaaaaaaaaaaaaaaaaaaagagtttctactatattgcctaagcaggtcttgaactcctgggctcaagcaatcttcctgcttcagcctcacatagtgctgggattacaggcatgagccactacgcccggccgagacagagtttctactatattgcccagcctgatctttaactcctgggctcaagcaagtcttctgcctcagcctcacaaagtgttgggattacaggcgtgagccactgtgcccagcccatgaagaggttttttgttttgttttgttttgttttttgagacagtcttgctctgtcaccaggctggagygcagtggtgtgatcttggctcactgcaacctcagcctccttggttcaagcgattctcctgcctcagcctcccaagtagctagtagtacaggcgcctgccaccacacccagataaattttttgtatttttagtagagacggggtttcaccatattggccaggctggtcttgaactcctaacctcaggtaatctgcccgccttggcctcccaaagtgctaggattacaggtgtgagccactgtgcctggcttttttttttttcaagacagagtttcactgtgtcagccaggctggagagcagtggtgcgatcttggctcactgcaacctccagttgtttttgagcctcccagcctcgagcaattctcctgcctcagcctcccaagtagctgggattacaggcatgtcccaccatgcctagctaatttttgtacttttagtagagatagggtttcaccatgctggtcaggctggtctcaaactcctgacctcaggtaatctgcttgccttggcctcccaaagtgctgggattacaggcatgagccaccacgcacagccagtgaagagttcttaaggagaagctatataagccaggcacggtggtgcataccagtagtcccagctacttgggatgctgaggcaggaggatctcttcagcctaggagtttgagactgtagtgagctatgatcacaccactgcactccagcctgggcaacacagcaagaccctgtctcaaaaaaaaaaaaaagaaaaagggtgtatttcaaaggcaggagtatcatgatttggtgatgtgttggagatgagatggagtatagagaagactccaggtggatttggtttcttagcatggttcattaggtgagtgggggtgccattcattgaagtgagaagcctgagtcagagcagaaaccaagagctgagtcttggacacatggagatgagtaattggatattcaaatctggaggctgggcacagtggctcacacctgtcattgtcccaacacattgggaggccgaggcgggtggatcacctgagttcgagaccaggctggccaacatggtgaaaccccatctctactaaaaatacaaaaattagctgggcatggtggtgcacctataatcccagctactcgggaggctgaggcaggagaatcgcttgaacccaggaggcagaggctgtggtgagctgagattgcactaccgcactccagcctcggtgacagagagagactccatctcaaaaaaaaaaaaaaaaaaaaaaaaattagccaggtgtgatggtgtgtgcctatagtccccactatccaggaggctaagcccggagggttgcttgagcttgggtggttgaggctgcagtgagctgtgattgcgccactgcactccaacctgggcaacagagcaagaccttgtttcaacaacaaaaaacaaacaaatctgggactcccagggtaaaagccaactccgcattaagccacttcctgggtctgcctgaccctcacatgcatgccttctaccttacccagaagtaaatacctcacttcttccccgtcctgccatgaatttttttcactgcatttactgctgttgggtctcacctgttctctgctttgttccccaggcacaagcaaacaggacctgacttccttcaacatggagctgtcctccagcggcatcagtgctgacctcagcagggtgcrtgctgggctggagcaatgggctgcagggagtgcagttggctctggggggtgggtcggtgggtagctgacccgctcatctccttccctgggcagggccatgcagtcgtgggggcagtaggagccaaggactgggctgggggctttcttgacctgaaggcagacctgcaggatgacacatttattgggaatgaaccattgacaccagaagtgagagcaggctatttgggtgagtacktctcttttctgctgggatcttctggttgttgaggtcagatggtcrctcagcctggcttccaaaacaataatgaaagcagttaagcaaccagcatgaacaaagtcagagtttaaatatggctataacattcataatttattgtctgtattttctgatgctttgacatcttggggccgtgctaatcctgaaaagactacctctcccagggtaggcaaattcctagagatagtaaacaacttgcctgtgaatatgccttgtagctggtcctrgtggctcatgcctgtaatcccagcagtttgggaggctgaggcaggtggatcacctgaagtcaagagttcaagaccagcatggccaacatggtgaaaccctgtctctactaaaaatacaaaagttagccaggcatggtggcgcatgcctgtagtcccagctcttctggaggctgaggcaggagaaacgtttgaacctgagaggaggaggttgcagtgagtggagatcacgcmgctgcgcaccagtctgggcaaaagagcaagactctgtctcaacaaacagggccgagcacagtggctgacacctgtaatcccagcactttgggaggctgaggcaggtgaatcacctgaggtcaggagttcgagaccagcctggccaacatggcaaaaccccatctctactaaaaatacaaaaattagtcgggcatgatggcgggtgcctttaattccagctactcagggggctgaggcaggagaatcgcttgaacccaggaggcggaggttgcagtgaactgaggatcatgccactgcactccagccaagatgacagagcgagactccgtctaaaaaaaaaaaaaaaaaaaaaaaggccttttatatgcaaaccagccaattccgagcccatatcctcagccacctcctttgtctaatccttacacaataagccgatagttcctctgccctaaatcagctcagagccaggcatcagtcaaccagaggccaccgctatagcccagagccagccaaaattattcaaactgtgcaatcctaaacttgcttgaacttgccaacctagctcgccacccttccttgtggaaaccacaagaagagctctgggccatgctcttccctggctcctcctgcctcttcactaatgtagtgtttccctctctggccctgcatggcatccagtgcctactccctcttggaactgtggctagtaaacttctttcaatgacagtgactctctgtatcatcagtcacacctatatattaaatcccaggcacattttaaaacaacctgccttattagtaagaggactggccactcctttttaaggcttcctcctcttgaattgtccaagagcacctgaggtcaagagttcaagaccagcctggccaacatggtgaaaccccgtctctactaaaaacacaaaaaaattagctggacttggtgacacgcacctgtagtcccagctacttgggaggctgaggcaggagaatcacttgaacctgggaggcggaagttacagtgagccgagattgcactactgcactccagcctgggtgacagagagagactttgtctcaaaaaaaaaaaaaaaattagttgggcatggttgtgcatgcctgtggtcccagctacttgggaggctgagatgggaggatcacttgagcctgggaggttaaggttgcagtgaaaaaaaaaaaagaagaaatgactctaaaatttaatctctagctgggtgtggtggctcacactgtaatcccagcactttgggaagctgaggctggcagatcatttgaggtcaggagttcgagaccagcttggccaacatggtgaaagtccgtctctataaaaatgcaaaaaattagccaggcatggtggcatgcacctgtaatcccagctactcgggaggctgaggtaggagaatctcttgaactctggaggtacaggttgcagtgagccgagatcgtaccactgcagtccagcctgggtgacagagcaaaactctgtctcaaaaaaaaagaaaaaagaaaaaaagtttaatctctagttagacacccaccccactatacacacacataaatatatacatatatgtggatagataaataaacagaatcctgagtgtctactatgctacttatccttcagatctcagtttagctatcactagtgtagcactaagcattttatatacatgtcttatttaactctcaaaacacaccccatgagattggtactgttccttttttttttctttagacatagggtctcactttgtcacctaggctggagtgcagtggcaccatcttggctcactgctgccttgacctcctggctttgagcaatcccccttcctcagcctcccaaagtgctgaggttatagccgtgagccacaatgtccagcctcttccctttttgtagatgagaaaactgaggcacagaggcatgaagcaatttacttaactactacacagctaggaagcagtagcactaggatttaaaccttgtctcatggagttcaagaatttggagttcttaacccttgtgcttccagactccatacgacaatagggaagcggttccgtctcttcactcttccttccatgtgctgtagggccttggacagctctgttttcttcactcactttcaactgctctgcacagagaccatcagatggggtcagtgactcatctcagaggatkcttgctggtggctcttggctctagcccaatcttgggtccaatttcctgcagtgtttcctcgaacattcaatagaggttgtcctggtatcttagaggaaagaacctcattacaggaagttgaagatgaagacagcctgacactgacatgatatcttttttttcttttttttttttttgagactgagtctctctgtcgcccaggctggagtgaagtggcgcgatcttagctcactgcaacctccacctcccaggttcaactgattctcttgcctcagcctcctgagtagccgggactacaggtgcccgccaccacgcccagctaattttttgtatttttagtagtgatggggtttcaccatgttgaccaggctggtctcaaactcctgacctcaggtgayccacccgccttgggctcccagagtgctgggattacaggcgtgtgccaccgctcccggccaacatggtatcttttttttttttgagacggagtcttgctctgtcacccaggctggagtgcagaggcgctatctcagctcactgcaagctccgcctcctgggttcacgccattctcctgcctcagcctctcgagtagctgggactacaggtgcccgccaccatgcccagctaatyttttgtatttttagtagagacggggtttcaccgtggtctcgatctcctgacctcgtgatccgcctgcctcggtctcccaaactgctgggattacaggcgtgagccaccgcgcccggcaacatgatatctttaagcatgaaaatttttcaagtttcctgctttattttattttgttagagacagggtctcactctgtcacccaggctagagtgtaatggcaccatcgtagttcaaggcagccttgaactcctgggttcaagcaatccttttgcctctcagcctctctagtacctgggaycacaggtgtgcatcaccacacctggctagtttttgtaattttttgtagagacggggtctcactatgtttcccaggctggtctcaaacttctggcctaagtgatcctcctacctcggcttcccaaaatgttaggattacaggtgtgagccactgcacttggcccagacatgctttatttttaatatccatgccaactttgcattcttctgactaatatataccattttattttattttattttattttattttattttattttatttatttatttattttgagacggagtctcgctctgtcgcccgggctggagtgtagtagcgaaatctcagctcgcttcaagctccccctcccaggttcacattctcctgtctcagcctcccaagtagctgggactacaggcgcctaccaccacgtccagctaattttttgtatttttagtagagacggcgtttcaccgtgttagccacgatggtctcgatctcctgaccttgtgatccacctgcctcggcctcccaaagcgctgggattacaggcgtgagccaccgcacctggactcccattttaatttattatttaagaaaaaagaggccgggcacagtggcttatgcctgtaaccccagcactttgggaggctgaggtgggtggatcacctgaggccaggagtttgagaccatcctggccaacatggcaaaaccctgtttctactaaaaatacaaaaaattatctgggtgtggtggctgggcgcctgtaatcccagctatttgggaggttgaggcaggagaattgcttgaacccgggaggcggaggttgcagtgagctgagatcacgccattgcattccagcctgggcaagagagcgagactctgtctctaaaaaagaagaaagaatggagtcttccttactaatcctcaggtaaactgaggctcagaagaggctccacgctccacttgttgtgcatagctgcttttccctgggtgtgcatgtcacccacagttgaagacatgccatccccaagatggcaggatttgtttggctgggagcacatggatgcttttctcaggagaaggtcttcagctgtttccatgcatctctgctactaacccaattccctggggcccctgcccctctcctgctgggtgttcttccagcatcctgtgttcctaactccayrccccacacactttcctcaggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccaggtgcgcccagtccgagggcatctgcagaccagggactggcgggacacacatcacactcccttctgtcctttgaatgctcatccacttaccatgtggcagcccctgtgctaaacatgatcacatttatccctcataayacacagaggtaagccctgtcatctccctctctagtttaagaaactgaacctcaaagagcccaccttgtcttaacgcacatagactaggggtggatccaagattggaacctgcatttgagggagtggcacaagatgaacacggtacaggtatctccctgccaacccctgctgttcccacaggcgcttccccaaacacctgcctctccccacagattggctcttatttcggtggggagctgtgtggcgtcgacgtggaccaagatggggagacagagctgctgctgattggtgccccactgttctatggggagcagagaggaggccgggtgtttatctaccagagaagacaggtggggccaggatctggagctgagagggaggagggagagcagcagagattcgcagctcccagttattctgaaggctttctctgtctggtcacgtggcgatcaaacttttagaacgacagagaggcaatagcaaatcctcactggggaaagactgtatgcagggtccagtgccaatatttcttttttcttttgagacagagtctcgctcttatggcccaggctagagtgcagtggcacgatctcggctcactgcaacctccacctcccaggttcaagggattctcctgcctcagcctcccgagtagctgggattacaggcatgtgccaccatgcccagctaatttttgtatttttagtagacatggggtttcaccatgttggtcaggctggtctcgaactcctgacctcaggtgatccacccacctcggcctcccaaagtgttcggattacaggtgcctgccgccacacccagctaatttttgtattcttagtagagaccatgtttcgacatgtgggccaggctggtctctaatcctgacctcaggtgatccacccgcctcggcctcccaaaatgctgggattacaggcgtgagccgctgcacctggtaggcagcgccaaactttttatagatatgacctccctttcctcatgaccacctgctgagatactacaagctttattttataaatgggaatccctggggtgcggtggctcatgcctgtaatcccagcactttgagaggctgaggcaagatgattgcttgaagccaggagttcaagaccagcctgggcaacatgacaagaccctgtttctacaaaaataaaaataaataaattaaaattttaaagttagccagatgtggtggtacatacctgtagtcccagctacttgggaggctgaggtgggaggatcgcttgagcccaggagttcgaggctgtagtgagctgcgattgcaccactgcactccagcctgtgcgacagagcaagactccatctcaaaaaaaaattatcaaaaaaatgtatatatatataaatggaaaccccaagctcagtaggggaaaccacaaggtcacagtaagaggacagtaagaggctgggctggtgcttgaaccctggttagtctaacagcaccattccaattctgtgagggaccccatcttacgtttctttagcattcttcactcagttgttctgtgacagcatgctgagtgacttgggtgtgacctgtctcttgctacttcctagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcaggtgacgtatgctgcctgccaatcacactccattctcaggtgccctaagcccccaagcccagaccccactccccagcccgatccttccctccctccaacctacctctcctcagcttagtggcaatttctttcttgctctcagcggatagaagggacccaagtgctctcaggaattcagtggtttggacgctccatccatggggtgaaggaccttgaaggggatggcttggcagatgtggctgtgggggctgagagccagatgatcgtgctgaggtgagatgggtctcccaggtcacacctgatgaccccagctcttatcctgttttgtttatattttattttatttatttattttggttttttttagagacagggtctctctttgttgctcaggctggagtgcagtggcatgatcataactcactgcagcctcgaactgctgggcttaagtgatcctcccacctcagcctctcgggtagctgagactacaggtgctcgccaccacacctggctaatttttttttttttttttggtagcaatggggacttactttgttgccccagctggtctcaaactcctggtctcaaactatgctttctcctcagcctcccagagtgctggagttacaggcaggagccactatgcatggcctaatttttattttttttaatatatggtcttccaggccaggcacagtggctcacacctgtaatcccagagacagcttacatattggaaaacatataattaaaaattagcagggtgtggcagctgggcacggtggctcacacctctaatcccagcacttcggaagtccgaggcgggcggatcacgaggtcaggagatggagaccatcctggctaacacggtgaaaccctgtctctactaaaaatacaaaaattagccaggcgtggtggcgggtgcctgtagtcgcagctactcgggaggctgaggcaggagaatggcgtgaacccaggaggcggagcttgcagtgagccgagatcgcgcccctgcactccagcctgggtgacagagtgagactccgcctcaaaaaaaaaaaaagattaacagggtgtggtggctcatgtgggtaatcccagcactttgagaggctgtggcaggaagattacttgagctcaagagtttgagaccagcctgggcaacacagtgggacaccatctgtactttttttttttcttttgagagagagtcttgcactgttgcccaggccagagtgcagtggtgcgatcttggctcactgtaacctccacctcctgggttcaagcgattctcctgcatcagcctcccaagtagctgggatcacaggcatgcaccaccatgccctgctaatttttttgtatttttagtagagacggggtttcgccatgttggccaggctggttttgaactcctgacctcaagggatccgcccgtctcggcctcccaaagtgctaggattacagagtgagccaccgtgcccagcccttttcttttttttttttaattggccaggtatggtggtgcatgactgtaggcccagctacttgggaggctaaggcaggaggatgacttgagcctgggaggtcgaggttgcagtgagctgtgatcatgccactgtactccagcctgagctacagagtgagatcctaccacaaaaaaataataaataggccggatgcaatgactcatgcctgtaatccagcactttgggaggccgaggtgggtggatcatttgaggtcaggtggacgtggttgtgggggcccctctggaggagcagggggctgtatacatcttcaatgggaggcacggggggcttagtcaggagttcaagaccagcctggccaacctgttgaaaccccatctctactaaaaatacaaaaattagctgggcatggtggcatgcgcctgtaatcccagctactcgggaggctgaggcaggagaattgcttgagcccaagaggaggatctcaaaaaaaaaaaaaaaaataggagccaggcactggggctcactcccgtaatcccagctacacaggagtctgagacaagaggatcgctggaggccaggagtgtgaggatgcagtgagctatgactgcaccactgcactccrgcctgagcaacaaagcgaggctctaacaacaacaaaagctgcaactttattatgaagcataataaaattcatgcaagcatcactgaaggcttaaacataagcatgaaagtaactcagtatgatttctcttcctaagagctttctcttcttcatggaaaatgggtcagaggctgctagaatgaactgggagccctaattagttatcaccattattggccaggcatggtggctcatgcctataatcccagcactttgggagcccaagcygggaggattgcttgagctcaggagttcaagaccaccctggacaacataggaaggtcccttctctacaaaaatttatttaaagttagccaggtgtggtggcacatgcctgtggtcccagatccttgggaggctgaggtgggaggattactagagcctgggaggccgaggctgtagtgagctgttatcatgccactgcactccagcctgggcaacagggtgagaccctctctcaaaataaataaataaaaagtatcattattattttccttaagaggagacagtgacatgttgaggtctgctttagggaaggagagttctctggctttgctggcgggagccccacatctgaggggggacgtgcagttgggttggagggagagagttggttgccttctgccctgcagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggtcagagctctcctcytgctcccagggcagctgccgccccaaatccaggcttatggcctgggatcccccaccatttaactcttgccttttccgccctgcccaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtaagggagccagcgccaatgctctgggatgagctacctgcaggggcaggctcagctccgtcactgtccagtgggtgacacgtcacttccatccctctgtgctgtcacttcctctcctgtgcaatggtagtaataacacccttagcatattttcttctagtgtttttkttaaattatatatatatatgtgtatatatatgtatatatatgtgtatatatatatatgtatatatawrtgtatwtatatatatayrttatatatatatatatatatattttttttttttttgacacagagtctcgctctgtcacccaggctgtagtgcagtggcacggtctcacttactacagcacgatctcggctcatggccacctccacctcctgggttcaagcaattctcctgcctcagtctcccgagtacctgggattacaggcacctgccactatgcctagctaatttttgtatttttgggagagatagggtttcaccatgttagtcaggctggtctcgaactcctgacctctggtgatctgcctgcattggcctcccaaagtgctgggattacaggcatgagccatcgctcctggcctattttatattatttatttatttatttatttatttatttatttatttatttatttgagacagagtctcgctctatcacccaggctggagtgcagtggcatgatctcggctcactacagcctctgcctcccgggttcaagcgattctcctgcctcagcctcccgagtagctgggattacaggtgcatgccaccatgcccaactaatttttatatttttagtagagttggggtttcaccatgttggccaggctggtctcgaactcctgacctcaggtgatcctcctacctcggcctcccaaagtgctgggattgcaggcatgagccactgcccccggccatattttatatttttagagatgggggtcttactgtgttgcccaggctggactctaacttctggcctcaagaggttctcttgcctcagcttcctgagtagcagggactacaagtgcacaccactgtgcctggctgcttctagttttttaatttttttaattttttattaaaaaaatttttttagagacagggccttgctctatcgtccaggctggagtggagtgatgcaatcatggctcactgtagcctccaacttctgggctcaaatgatcctcccacctcagcctcccgagtagctaggactacaggcatgcaccaccacatctggataatttttaaaaatgtttttgtaggccaagcgcggtggctcagcactttgggaggccaaggtgggtggatcacctgaggtcaggagttcgagaccagcctggccaacatggtgaaaccccatctctactaaaaatacaaaattagckgcgtgtgttggcacatgcctgtgatcccagctacttgggaggctgaggcaggagaattgcttgaacccaggaggcagaggttgcagtgagccaagatcgtgccattgcactccagcctgggcaacaagagtgaaactccatctcaaaaaaaaaaaaaatagtttttgtagagacaaggtcttgctgtgttgcccaggctggtctaaaacccttggcatcaagtaatcctcttaccttggcctccaaaagtgctgggattacaggcatgagccaccgtgcccagcagcttctactttttaatatatttatgggcatttttaacatgattacaatggcaatgtagttactatttttccctactcttttcatacattatatattaatgctgctacacagctttcataatttttaattatgaaatattaaaatgtttggctgggcacggtggttcatacctgtaatcccagcactttgggatgccgaggtgggcagatcacctgagattggcagtccaagaccagcctggccaacatggagaaaccccatctctactaaaaatgtacaaaattagctgggcgtggtggcccatgcctgtaattccagctacttgggaggctgcggcaggaaaatcacttgaacccaggagatggaggttgcagtgagccgagatcgtgccattgcactccagcctgagcaacaagagtgaaactccatctcaaaaaaaaaaaaaaaattaaaatatttaatttttacagaatattcaatcatcatggtatgttgttatttgccaggtacatatcatgcatcccagaaaaacttagggtattttttaaagtttttaaattaagtctcatgtatggtacatggaaaaaaaaagtttttaaaaaagttaaaacaggccaggcacggtggctcatgccagcactttgagaggctgaagtaggtggattgcttgagcttaggagttcaacaccagcctgggcaacatagcgagaccccttctctacaaaaaacaccaaaaaattagccagccttggtggagcgcacctgtagtcccagctacctgggaggctgaagcaggaggattgcttgaacccaggaggtggaggttgcaatgagctgtgattgtgccactgcactccagcctgggcaacagaatgagactctgtctccaaaacaataaagtttgaacaactgttgaaatacccagattcagttgcttataagcaatcctgtataaaaatgggattaatatggccgggcgcggtggctcacgcctctaatcccagcactttgggaggccaaggtgggcggatcacgaggtgaggagatkgagaccatcctggctaacacggtgaaaccccgtctytactaaaaatacaaaaaattagctgggcgtggtggtgggggcctgtagtcccagctacttgggaggctgaggcaggagaatggcatgaacccgggaggcggagcttgcagtgagccgagatcgcgcccctgcactccagcctgggcgacagagcaagactccatctcaaaaaaaaaaaaaaaaaaaaaaaggattgatatcaaattgttatgttctcttaaatatttcataaaaggccaggcatggtggctcatgccagtaatcccagcactttgggagactgaggtgggcggatcacttgaggtcaggagttcaggaccagcctggtcaacatggtgaaaacccatctctactaaaaatgcaaaaaattagccaggtgtggtggcaggcgcctgtaatcccagctactcaggaggctgaggcaggagaatcatttgaacccaggaggcggaggttgcagtgagctgagattgtgccattgcattccagcctgggcaatgatagtgaaactccatctcaaaaaaaaaaaaaaattcatataagacagtataagattgggacataagaatttgaagtttgttttaaagtttttttttttttgagatggagtctcactgtgttgcccaggctagaatgcattgttatgatctgggcccactgcagcctctgccctcctgggttcaagtaattctcccaccacatcctaccaagtagctgggattacaggtgaacaccaccatgcccggctaatttttgtatttgtgatagagatgggttttcaccatgttggccaggctggtctcaaactcctgacctcaggtgatccacccacctcggcatcccaaagtgctgggattacaggtgtaagccactgcacccagcctgttttaaactttttattatgagaatatgaatcatacaaaactagaaaaaaaatagtttaatgaatccccaggtcctcatcacccagtttcaacaattatcgactcaccctctatttcattcaaacctctactcagtgcccctctgcctactcccattccacctcttataagatttagacattttaaacataaatttgccagaaaagaaagcagtgtgacatggtggaaagatcctggactttggatttggacagatttgggttcaaatcttgactgtcactccaagttcttaggacaactgtgccacctttttagttttcattttcttttttttttttcttttctagagggggacagaaggagggaggatgaaagagaaagagaaagaaaggagggaaggaaggaaggacaacggaggaaggaaggaagggagggagggagggaggcaggcaaggagggagggagggaaaagaagaaagaaaaaaagaaaagaaagaaggagagaaggaaggaaaagagaagaaagaaaaggaaggaagggagagctcattttccttattttaaatgttggggtaataatacctacctcttagggctagtagaaccttcaggtgaaaaacaatttgagtacctacaaaatgccagtgtcaggcattggtaatagcaaatgactaagacccagccctattctcaaggaacaaaattctagaactaggatattctagttattctgaaattttcttaagcaaactttgataatggctgcctaggtcaaaattcaggggcttcagttaggacacagtgggggaaaagtgctgggattgattagtgatgtctgctggggaaccggggctcagggatgataactgtgctgagaagccccctgggtgtgctgtacacacctgctatgtagtcaatggattttcaatactggtagggtcttagacaaagaactaccagaatttcatcacttgtaaaatgctgacaaggtatacatctaatcggaagtgcggtaaaagttagattcatgacataggctgtattcttatcaccctcaggtatgtgttcaagacctcatctcccccatcaatgtttccctgaatttctctctttgggaggaggaagggacaccgagggaccaaagggcggtaagaagagatggctagggatggtggggagtttatcagagaaatccatttggcaagaagagccgcccatggccgggcagcacactcctataatcccagcactttgggaggctgaagtgggtggatcacttaaggtcaggggttcaggaccagcctggccaacatggtgaaaccccatctctactaaaaatacaaagattagtcgggtgtgatggtgcacttgaggccaggagtttgagaccagcctgggcaacatagtgggactccctttctacaaaacataaaaaattagttattgtgatggtgcgcccctgtagtcccagctacttgggaggctgagcagggaggatcacttgagccagagggttgaggctgcagtgagctattgagctatgattgcaccactgccctccagcctaggcaacagcacgaaaccctgtctctaaagaagaaaaaaaaaaaaaagagccggccgggtgttgtggctcacacctgtaatcccagcactttggaaggctgaggggggtggattgcttgagaccaggagttcgagaccagtgtgscaacatggcgaaaacccatctctactaaaaatatttttaaaaaattagccaggcgtggtggtagatgcctgtaatcccagctactcaggaggctgaggcataagaatcgcttgaacccaggaggcagaggttgcagtgagcagagattgtgccactgcactccagcctgggcaacagagtaagacagtcttaaaaaaaaaaaaaaaaaagagctgccagcagagtaagactgcacaaatggcagtaggctgaggcagcagagtggggcagccctggaaaggcagctggctcctgggcagggccaaccacagccagcccagttgagctaagcccctgcccctccrgctctccttcatgaggtctgctgcctcagttaatctctyctctctccatcctgcccactacccctcgctcagmagggcaaggacataccgcccatcctgagaccctccctgcactcggaaacctgggaggtaagaggggagaaggggcaggcagagaggcctgggaacaagtccctcctgatctgagcctgttactcctttcttcttggtgtttcagatcccttttgagaagaactgtggggaggacaagaagtgtgaggcaaacttgagagtgtccttctctcctgcaaggtcagtaaggcctcccaccctccagcctcccatccactctgttttaagaccccccactccactcaccagatatgtcatttgcagacaccacttccctctcttgggccttagtttccttttctgagaaatttgaggctgaactcaggggctcatgcctataatcccagcacttcaggaggccaaccaaagggggaagattcgttaaggccaagagttcaagaccagctatgggaaacatagcaagaccctgtcactaaaaaaaaatttaaaaattagctgggcacggtggctcatgcctgtattcccrgctacttgggagattgaggcagaggatggcttgagccaggagtttgaggctgcagtaagcaccactgcaccccagcctgggtgacagagcaagactctatctctaaaaaataaaaagcaaataaaataaaaagcaaatccctcatggaactcctatcagtcatcagtaaatgagattgcaagaattgtaaaactgaaagtctgagcatggcctggcgcggtggctcacgcctataatcccagcactttgggaggccaaggcgggcagatcacctgaggtcaggagctcgaggccagcctggccaacatggtgaaaccctgtctctactgaaaatacaaaacttagccaggcatrgtggcacgtgcctgtaatcccagctatttgggaggctgaggcaggagaattgcttgaattctggaggtggaggttgcagtaagccgagactgtgccattgcactccagtctgggctacagagtgagattctgtctcaataaaaaaaaaaaaaaaagccgggggcggtggcctgtaatcccagcactttgggaggccgaggcgggcggatcacgaggtcaggagattgagaccatcctggctaacacagtgaaaccccgtctctacttaaaatacaaaaaaaaaaaattagccgggcatggtggtgggcgcccgtagtcccagctactcgggaggttgaggcaggagaatggcgtgaacccgggaggcggagcttgcagtgagccaagatcgcgccactgcactccagcctgggtgacagagtgagactccatctcaaaaaaaaaaaaaaaaaaaaaaaaaaaaaaaaaaaagactgagcataaaagatgattggttttgatttatttctttctggcccaccagatccctcagttctgatattccccaccctgatcctccctcctccatctttccctgatcatcccccacagatccasagccctgcgtctaactgcttttgccagcctctctgtggagctgagcctgagtaayttggaagaagatgcttactgggtccagctggacctgcacttccccccgggactctccttccgcaaggtggagatgctgaaggtgggtgagaggacagcgcctgcctgcgggcatctgttcggcagacactgcccccttctttgagccccaggcagccaggacagcctgaacacatvggcagctgcgggtggacaggggtcttagggtyatatctgggttcccagcctcgagctgtatgatccgaggtaccaggtttaccctctcaggctgggtgcggtggctcacaactgtaatcccaacactttgggaggccaaggcgggcagatcacctgaggtcgggagctcgagaccagcctggccaacatggtgaaaccctgtctctactaaaaaaatacaaaaatgggccgggcgtggtggctcacgcctgtaatcccagcaccttgggaggccgaggcgggcggatcacgaggtcaggagatcgagaccatcctggctaacacggtgaaaccccgtctctactaaaaatacaaaaaattagccgggcgaggtggcgggcgcctgyagtcccagctactcgggaggctgaggcaggagaatggcatgaaccccagggggcggagcctgcagcgagccgagatcgcgccactgcactccaacctgggcgacagcgaaactccgtctcaaaaaaaaaacaaaaaaaaaaacaaaaaaaaaacccacaaaaattatccaggcgaggtggtgtgcggctgtaatcccagctactagggaggctgaggcaggagaatcgtttgaatctgtaaggcagaggctactgtgagtcaagattgtgccactgcactccagcctgggtgatagagcaagactccatctcaaaaaaaaaaaaatttaaatagagagagggtctcactatgttccccaggctagtctcaaacttctgagctcaagcgatctgcctacctcagcctcccaaagtgctaggattacaggtgtgaacaagtgtgcccggccaaatttccttcctttttaaggttgaataatattccattttatgcatagaccatattttacctatttatctgtcaatgaacacttgaattattctttttatttttttattttctttaaatttatttatttatttattttctgagacggggtctcgctctgtcacccaggctggagtgcagtggcgcgatctcggctcactgcaaactccacctcccgggttcacgccattctcctgcctcakcctcccgagtagccgggactacaggcgcccaccaccacgcccagctaattttttgtatttttagtagagacggggtttcactgtgttagccaggatggtctcgatctcctgacctcatgatccacccgcctcagcctcccacagtgctgggattacaggcgtgggccaccacgcccggcctattttttttttttttttttttgagacgaagtcttgctcttgtcccccaggctaaagtgcaatggcgcaatctcggctcactgcaacctccgcctcccrggttcaagtgattctcctgcctcagcctcccgagtagctgggatacaggcgcctgccaccacacccagctaatttttatatttttagtagagatggggtttcaccatgttggccaggctggtcttgaactcctgtcctcaggtgatctacccgccttggcctcccaaagtgctgggattacaggcgtgagccactgcacccaaccgaattattcttatacagcaacattaaatgtttctttgctggatgtggtggtgcgcacctgcaattccagctaccttgggggctgaggtggagaagtgcttaagcccgagagttcgaggccgctgtgagctatgatcatgccaatgcactctagcctgggcaacagaacaatactctgtctctacacaaaattaaataattagccaggtgtggtggggtgtgcctgtagtcctgctactcaggaggctgaggtgggtggatcgctggagtccaggagtttgaggctgcagtgagctatgattacaacattgccctccagcttgggcgacagagcgagaccttgtctcaggaaaaacaaaaaacaaaaaacaaaaaaaaaactgggctgggtgtggcggttcacgcctgtaatcccagtactttgggaggctgaggtgggcagatcatctgaggtcatgagttcaaaaccagacggggcaacatggtgaaaccccatctctactaaaaatacaaaaattagctgggtgtggtagcatgtgcctgtaatcccagctgcttgggaggctgaggcaggagaatcacttgaacccaggaggtggaggttcagtgagccaagatcactctactgcactctagcctgggtgacaacagcaagactccatctcaaaaaaaaaaaaaaaagagagagagagagagaaaataactggagtcaaacagttctgtgttcaagttcttacggatccctactgttacccagttatgacaccttgggaaagtcccttagcctccctgaacctgtatttccttatctgtttccttcccagtctgagactgaaatctgtcctttacaaaattgggatgaagatgaatggtttaataatgcttagcccaggatcaggctcattttttaaatggttactgaatgtatagaggtagtggcattttaaaaacttcacgatagtctcttctttgattgtaccacactttactgagccgttgttatctctttgacctgtttgagcacttccagtttttcagtattataaatagtgttgcaattacccccctacacccaacttttatttttgagataaggtctcactctgttgcccaggctaaagtatagtggcataagcatggcccactgcagcctcaaactcctgggctcaagtgattctcctgcctaatagctgggacaacaggcacgccccactatgctcagctcattttaaaaaattttttgtaggccaggtacagaggcttacacttataatcccagcacattggtaggctgaggcaggcagatctcttgagcccaggagttcaagagcagcctgagtgacatacacaggctccatctctactaaaaatacaaaaattagctggacatggtggcacatccctgtagtcccagctactcgggaggctgaggcaggaggatcgcttgagcctgcgagtcagaggttgcagtgacccgagatcgcaccattgcactctagcctgggcaacagagtaagatcctatatttaaaaaaaaaaaaaattttttttaatagagatggggtctcactcttgcccaggctgatctcgaactcctggccttaagtaatcctcccacctcagcctccctgagtgctgggatttcaagtgtgagctaccttacccagccttccagtgactattttgtactaagcctctgtctgcagccctgattcttgggccctttcccgctgagaaggttccatgacagggacagagcccctgggggaggtaggccaggagggctggtggcctctgggggaaacttggccttgctcattaacaaacttgtttcctcctttcactcccagccccatagccagatacctgtgagctgcgaggagcttcctgaagagtccaggcttctgtccagggcattatcttgcaatgtgagctctcccatcttcaaagcaggccactcggtgagtgcttcaagtctccagggaccaagcagcctaggggccctgagctggtggagggcagggagctcttggctcaggagaagggagcaggtgattgtcaagaagggtgtaccttgcccctacctaagagaaatgtatgtgaatctgttctgtgtcatgtttgagagcctggactttagaatcaggcaaagctgggattgggttattcattttgtgaccttatagacataacttaaccgtctggagccttggttgcctcatctttgcaatgggtagaatcctagctcagtgcttggggtgcagtgagcacttgataaggggtccctgagatgatggtgattagatgtgggggccatgagrctgctcctcatgacccttccatttccattgccctctcctttcctgccaggttgctctgcagatgatgtttaatacactggtaaacagctcctggggggactckgttgaattgcacgccaatgtgacctggtgagcaggccccgcccacatccctgccatggtctcagacctggccaagcccttctcctaacactggcctcttccttgccccaatgcagtaacaatgaggactcagacctcctggaggacaactcarccactaccatcatccccatcctgtaccccatcaacatcctcatccaggagtaagttcttcccagcagacagccaaccctctcctcccaccgcagcctcccaacccagggccccgactttgctcctggggctctccttctgaacctccttcctttcttagagccccttggggtaattagaactgattccagccacaaccccaaaagttttcaacattccaaaatgtgagggccatggaagagctcagggaaggattagcatttactgatggaagaaaaagctcattgaacactaattttatgtcagactgagggccagctgcactgcgcagttgctgacattgcctggagccctcagcacctctgtgaggcagctgtgccgctctccattttaccaatgaacaagctgaggctcagagaaggccggcacttacccaaggtccaatagctggaagtactaaagccagggtctgagcttcagcctgtctgactccaaaggcccagccaagctcctgactgtttcagtcaccctagattctctcccctcctgggggccgataatgccaggagagataggagaaaagttatcacaataccccttgccctcagggagcttacagtcaagtgggagagcccaaactcatgcacacacagagtcagtgactctcagaacacagtagcaggaaggaaccatggggatcgctagttgggtttgtaactgaactctggtctggctgcttgttacttgaaagccagacttaagaagcaagagttggtgggaggaaaggcaggtttatctggaaagccaggcaattgagaagacagtgaactagtgttctaaaggaccatctgtaatgttaagggtagggggaagagaaaggggttaagatcaagaggtaacttagcacagacatctgggcaccagagaggatacaaggaggttgggaacttcttggtccttggtcaggtcacagtgcttctataaatctttaacaaaacatagttagttgtttacaaacgtcccctttaatgccagacttagttttaaaaactacatgatagctgtttttgcatgttatctcagtgctctaaaattatcctagcctatgggcaggaatgggtaaaggcctcttcaacaaaaatggagggagttatgtccgttttttgctatttcaaaaaaacctgttacaggtcttctcgcttatagaaaaggaaacttggccaggtgtggtggctcacacctgtaatcctagtaatttgggaggccaaggtgggtggatcacttgaggtcagtagttcaagaccagcctggccaacatggtgaaaccttgtctctactaaaaatacaaaaattagctcggcgttgtggcaggcacctataatcccagctactcaggaggctgaggcaggacaattgcttgaacccgggtggaggaggttgcagtgagccgagatcatgccactgccctccagcctgagtgacagagtgagaccctgtgtgaaaaaaaaaaaaaaggaaactcaaaatcgagtggctttttccagttggctcagttacagaaggacagagaaggacggggacagtgtctgagctcaggtctctagtgctttttaaattttttttattttttaagagacagagtctcgctctgttgcccaggctggagtgcagttgcacaatctcggctcactgcaacctcctcctccagggttcaagcaattctcctgcctcagcctcccgagtagctgggactacaggtgcctgccaccatgcccagctaatttttgtattcttagtagagacagggtttcgccatgttggccaggcaggtcttaaactcctgaactcaggtgatctacctgcctcagcctcctgaagtgctgggattacaggcgtaagccaccgcgcctggcctccagtgcttttgaacatcaatgccacacagtatgatactgacatgaaattagagccaggaaagatgagtgtgggttgggggagaaatggaagagttcgtggagaaagtgcggcttggactggggtctggaggatgaggccattaggggaagagctaaaaaggaacctagatgtcctcatcagagaccatggcccagacaaaggcaaggagggaggaagcagtggggcatacctgggggacagggattgggcaggattagccaagggcaggtgtgtgcaggggagcagtgaggagactgcctggacatgggaggctttggacctgaccctccctcgcagtagggggccgttggcyaatgctgagcaggtgagtggcaggactagagagtgatgttgggaaggtcacccagcagtgtgtgttggaaggatgggtgcgaggggcatcagcagtggatacgattatctaggagatgagcasggcccagaggacagtggagacactggtgaggtggcgcgcagtggggaggacatagcctccactggacacacttccctgggctccagtcctgtctctccactgtggagaagctttggacaagaggctggccctgtccaggagccttagtttctgggaaagagcaggttgtggtagggattgaatgagatggtatctgtgccgttcctagcacagtggctgggcgctcagaagcttcctggagcccgggttgctgtcacttcgttcttccatcgctgcccttctctctccgcagccaagaagactccacactctatgtcagtttcacccccaaaggccccaagatccaccaagtcaagcacatgtaccaggtatgaatcccaatgtggaaggtccttataggtcacacattcattctttatcccggggactgaggatgcaggcaccaagtagacacagtactcatcctagccatccaactgttcaataatcctttctctagagtgtcacagcctccacttacaggcttccagcagcagcatatgctaactcctttctgccactggatgcattatttcaagaatcacaggacttgagagcaaggaggatgctgagagagaacctgctttttcataacaacactgaatgagctactattctttgctctgtttgttacccaggcttgagtgcagtggtgcaatctcggctcactgcaaactctgcctcccaagttcaagcaattctcctgtctcagcctcccaagtagctgagattacaggcatccaccaccatgcccagctaatttttttttttttttttgagacggagtctcactctgtcacccaggctggagtgcagtggcacggtctcagctcactgcaacctccgcctcctgagttcaagccattctcctacctcagcctcccaagtagctgggattacaggcatgtgccaccatgcccggctaatttttgtatttttagtagagatggggttttaccatgttggccaggctggtcttgaactcctgacctcgtgatcttcccccctcggcctctcaaagtgctgggattacaggcatgagccaccgcacccggccctatgcccagctaacttttgtattttttgtagaggcggagttttgccctgtaggccaggctggtctggaactcctgacttcaagtgatctacccacctcagcctcccaaagtactaggactacaggcatgagccaccacacctggcctattctaagttaggtatttagctaggtgctggcatcctgcccagtctccaaacccaggttctgtgcctggtgctttatttttaccttttcttttttcttttctttttttttttttttttgaggtagagtcttgctctgtcacccaggttggagtgcagtggcgtaatctcagctcactgcaacctccgcctcctggattcaagcaattctcctgcttcagccttctgagtagctgagattacaggcgcccaccaccacgccaggctaatgtttgtatttttagtagagagagggtttcatcatgttggccaggctggtctcaaactcctgacctcaggtgatccgcccacctcggcctcccaaagtgctgagattacaggcgtgagccactgtgcctggcctggtctcaacatattctaaaccaaatttgctgtcttcccctaagccagcatctcctctggcttgcgtggaatcttttgaaagcaccatctctttctcaaggaaaacttaacgtgtctgggtgaatttctccttcctcctgctttgtcccactgcctgctggagtctggttgtctgtgtcctttttctgctaccgcccagacccaattcctcaccttcttgcaactggactattgagagaggctcccaacatgggccatgacccgcctctcccagcctctttccagctcatgcctgcaggggatggacctccctggagccactctcttcctctgccaccttctgtgacttcccactgcctccttgatgctgctccaactcctcactctcaagccttccaggccccatagtgtgatcttgggcttcctttccagcctcagctcctgttctccttcccaggcaccctccttccagccacatccctctcacctggtgccatcctggctccccacatgtctcttcttggatgccctctcccaccttcatctgttaaaatcctgtccatctggtcaggcgcggtggctcacacctgtaaccccagcactttgggaggcccaggtgggcagatcacctgaggtcaggagttcaagaccagcctggccaacatgatgaaaccccatctctactaaaaatacaaaaattagctaggtgtggtggtgtgtgcctgtagtcccagctactggggaggctgaggcaggagaatcgcttgaacctggaaggtgaaggttgcagcgagctgtgatcgtgccatcgcactccagcctgggtgacagagtgatattctgtctaaaaaaaaaaaaaaaatcctgtccatctttcacagtcaaattcaaatactgcccctgacatttggcctttttaatttaactggtatttcaagtgtccacaaatgttcgttgaatgaataaatgatagaatccttctaatttgatacatttccctgcttcctgagacattgttagtgccacttctgtgtcactttcttacacatatctgagtctcccagccttaacacaggtagttctttttttaataaaaggtgctcagaaatttttttttttttttgagacggagtctcactctgtcgcccaggttggagtgcagtggcatgatctcggctcactgcaaccttcacctcctgggtttaagtaattctcctgcctcagcctccagagtacccagcactgtaggattgtgccaccacacctggctaatttttgtatttttagtagagacggggtttcaccatcttggtcaggctggtctcaaactcctgacctcaagtgatctgcccacctcagcctcccaaagtgctgggattacaggtgtgagccaccacactaggcactgtgtcaagcagtaggggattggaggtggagtaagaatggctcctgtcctcagggagttcatggtctagtggagatgcagacatccaagcagatcctttgccgtcctgctggggacgcagagcacactgtgggagcccaggagggggagctgccctgtccttggggagtcagcgaagccttcagagataatattagagcaggcccttgcagggtgtgtgagagtgtgctgggcggagaaagctggaagagcatggaagccacactgcaaggccctgaggayggaagctggccatgcccagtcactggacactgcctaaccgacaagggccctggggactcakccaatgaggactggaagaggcgtgcaagggcacacagggtctggggggcagctggggtggctggcattcagggctctgmatcccttgtcctctgtgccaggtgaggatccagccttccatccacgaccacaacatacccaccctggaggctgtggttggggtgccacagcctcccagcgaggggcccatcacacaccagtggagcgtgcagatggtgagtgctgcctgtagagggagggtctaccctcctcaggtcttgggggtgagtgcatttgagggtacagagggcagggcttggccaggtgcggtggctctgcctcccaaatcccagcactttgggaggctgaagtgggagaatccattgaggccaggattttgagaccagcatgggcaacatagcacaactccagtctctacraacaaattttaaaattatccaggcatgcatggtggcccgtgcccgtggtctcagctactcaggaggcagaggcgggaggatcacttgaacctaggagtttgaggctgcagtgagctatgatggcaccactgcactccagcctcggtgacagaacaagaccctgtctctaacaaagaaaaaaaaatcaagggggcaaggctgggtgtatggagagtaaggatggatgaattcaggtcctgctggactcagagatgtctgaactcacccaggsccagggccagggcaggggaaagctgggatgccagtgtcttatctgggttggggaggctctaactgaagacctgccgcttgttcctaggagcctcccgtgccctgccactatgaggatctggagaggctcccggatgcagctgaggtatgggcgtgtgagctgagagacggtggggctgggcggtacacgggtcggaatgaagccgccctgaccccgctttcctcatccttgtcagccttgtctccccggagccctgttccgctgccctgttgtcttcaggcaggagatcctcgtccaagtgatcgggactctggagctggtgggagagatcgaggtagtccccgctcctaagagatgtggagctgctgtgggggccccaatgcctggggccgttgtgggtgggctcccaccagatagtctgcctccatttttgttttccatcttgatgaaaaatcccatttacacagtcacaggtgaaagagaacaatgatttctgtgatatttgcaatgctgtttccatgggcctatggatagttcctgtgtgttctttatagaaaagctttccttacaacaatggggagcgacatattagggtgccacagtagaggctggggcggggctcaagcctataatcctagcacttcgggaggcttaggtgggtggatcacttgaggtcgggagttctagaccagcctggccaacatggtgaaaccctgtctgtactaaaaatacaaaactttagccgggcgtggtggcacatgcctgtaatcccagctacttgagaggctgaggcatgagaatcccttaaacccgggaggcagaggttgcagtgagccaagatggcaccactgcactccagcctgggtgacagagcaagactccatctcaaaaaaaaaaaaaaaatagaaagaaaagaatgccacaatagagagttgtgtagagatgggtgcacccccctggaaccccttctctgcccctccccactgtgttgtggtgggggcaaaagccagtgggttctgtcctcgttctcccgggttctgacgcctttccccgctcccacaggcctcttccatgttcagcctctgcagctccctctccatctccttcaacagcagcaagcatttccacctctatggcagcaacgcctccctggcccaggtatctccacctccttggaagccccaggaacaggcaacagagggagcccaggagccccagggcagacctagatgtgggagagctcctgggctctgtgcgagtcagaacttcccactgccagagccatcagcctgggagaagcttcttctccccttggtgggcacacaaccccagagttgcctgagatgtagtagacttatgtgtcgagtaaagttcaatcgaggccgggcgcagtagctcacacctgtaatcctagcactttgggaggtcaaggtaggcagatcacatgaagtgaggagttcaagaccagcctggccaacatggtgaaaccccatctctacaaaaatacaaaaattagccgggcatgatggtgggcgcctgtaatcccagctgttcgggaggctgaggtgagagaatcacttgaacctgggaggcagaggtggcagtgagctgagatcccaccattgcactccaacctgggcgacagagtgagacttcatctcaaaaggatctgtcagaggcaggcgtggtggttcacgcctgtactcagtgcctcgggaggctgagatgggaggatcgtttgagcacaggagttcaaggctgcagtgagctatgattatgccactacactccagcctgggcaacacagtgagaccttatctcaaaaaaaaaaaaaatcaatctgatggcagcttagcaaaggagttaccaagccaagtcagacagtgaagaaagagcgctctaagcagaggcagtggcaaggccaggggcctctgtggtgagtgttggcagggcaggtttgaagagcaggaagttcagtgtggctaacaggcagaggggaggagggaagctgcatctaacaggtaagcaaaagctggattctggacggctttgaatgctgagctgcgtgcgattccggggaagccattgaaggcctagggctgcctaaggtgtgtgttggccaactcatggcagcgactgcaataggtgacgtgttaaagggagagggtctgcagctggagactccaggcgggtgatgcagtccggataggaggagatggggaatggaaccaggttcacagggactttcaggggtggaaaaggcattttccggcactcccctccccctgctcccaggttgtcatgaaggttgacgtggtgtatgagaagcagatgctctacctctacgtgctgagcggcatcggggggctgctgctgctgctgctcattttcatagtgctgtacaaggtgggtgcctccgggggtcacaggcattgctgagacagccaggctggggaaggggatctggtgggagccagggaggagaataccaagccagagggcataagagccagggggcctcagagccagggggcctcagcctactccctccttcaacagagaaggctactgaggtccaaagaacaagcaagggccaggtgcagtggctcatacctgtaatcccagcactttggaggccgaggcaggtggatcacgtgagcctgggagttcaagacccgcctgggcaacatggaaagcatccgcctctacaaaaaattttaaaaattagggggacgtgatgctacccaactgtagtcccagctactcgggaggttgaggtgggaggatcccttgagctcaggaggtcaaggctgcagtgagccatgatgatgccactgcgctccagcctgggtgacagagcaagaccttgtctcacacacacacaaacagcaagagagacttttccacggtcattcagcccatccctggcagagccaggacgaggcgtcctgggagaggaaaaggaagtatgccaaatatggaggtccttttggctgctgggcactgtcccaggcacagggacacagaggcacatgccacaaacatgctccctgccattgtggcgctcacagtctaagagaggacacaggcagaagcaagcagaatgagggctgcaaagggcctgtgtggcctggggcctagaacccaggagcctcacttaggctgtgagggcctggcaggcctcccaggagaggtggcatttgaggtgggatttgaaggctgagtagacattacagatgaaggccgggtacggtggctcacacctgtaatccgagcactttgggaggcagaggcaggtggatcacctgaggtcgcgagttcgagaccagcctgaccagcatggagaaaccctgtctctactagaaatacaaaattagctgggcatggtggcgcatgcctgtaatcccagctgctcaggaggctgaggcaggagaatttcttgaacctgggaggcggagcttgcggtgagccaagatggtgccattgcactccagcctgggcaacaagagcaaaactccatctcaaaaataaaataaaataaataaaataaaataaagtgttctcgctgggctcggggactcatgcctgtaatcccagcactttgggaggccaaggagggcagatcacttgaggtcaggagttcaagaccagcctggccaacatggtgaaaccctgtctctactaaaaatacaaaaattagccgggcgtggtggcagatgcctgtaatcccagctactgaggaggctgaggcaagagaattgcttaagtctgggaggcagaggttgcagtgagccgagatcgcaccactgcactccagcctgggcaacacagtgagactccatctcaaaaaaaaaaaaagtgttctcacattttcttggggccaaagtgctcagtgaattctttgctcgttcaaattttgtctttgtacaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcastggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgaygcckcatgatatgtcagggcgtgggacatctagtaggtgcttgacataatttcactgaattaatgacagagccagtgggaagatacagaaaaagaggggckgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccagttttgtggtggttttgtgctggtgcaatattgcagccctactcaagtgaacatttctggctgggctctgtggctcacaactgtattctcagcactttggaaacccaaggcaggaggatcctttgaggccaggagtttgagaccaacctgggcaacatagcaaaccctgtctctacaaaaaattaaaatataaaaacttatttgagcctggttgcacgtacctgtagtcccagctactcaggaggctgagacagaaggatcacgtgagcacaggaggtcaaggctgcagtgagcgatggtcgcatcactgcaatccagcctgggccacagagcaagatactgccttcaaaattaaaaaaaaagaaaaacaggccaggcgcagtggctcacacctctaatcccagcactctgggaggctgaggcaggcagatcacgtgaggtcaggagttcgagaccagcctggccaacatggtgaaaattagccaggtgtggtgtcgggcgcctgtaatcccagatacttgggaggctgaggcaggagaatcacttgaacccaggaggcagaggttgcggtgagtcgagaccacaccattgcactccagcctgggtgacagcgtaagactccgtctcaaaaaaaagaaaaaaaaaaaaagaaacaaatagcacttccagccaggtgcggtggcctgctgcaacacagcaagacccgctttctaacagcagcaacagcaaagcacttcccggataaggccctaggctactactggtgtctcccacttcccagggcgctgtgcacgcacacattttaaggacaagtctcgtttaccacataaagtttttattgaactcaaactcaggggctccaaagcctgaggaagaagagggaggctggggtttgcacgcagaggcccaggccccaccccggggccccactccccaccccacctaccttttacccgctcctgactcaacgagagtttcagcagctaccaatctaagctaacccactctaattaggtaatcccctgccctcccccctccctgctctagcagttgccaagccaggcacccaccaaggagccgcggctgaggccagccctccgctgacctctctccatttctcccagggcctcccgctgccggcctggcctccctccaacccacttcccacaagtctccagggcatgtcacttcctccaccctggttctcttcttccagcatcctcagctcctccattctcctgcggcttctccactatcctccctaaaggttcctctagctccctggccccttatcttctgcccacacctcccacccctgctggggccccaggtcagcgccggcccgccgcgtgggtccgctggtggcggatgaggtcggagctctgggagaaggcctttccgcagtcatcgcacttgtaaggccgctcgccactgtggacccggtgatgctgcagaagcgtggaggagcggcagaagcccttgccgcacacggmgcacctgtagggccgctcgcccgtgtgggagcgctggtgctggatgagagtggaggagcgattgaaggtcttgccgcagtcggggcagctgtaggtgcggcctggcaggtgggtgcgggcgtggatggccagcaccgagctctggccaaagcgcttgccgcactcagggcacttgaagggcttctcccgggcgtggctgcgggcatgggggataagggccgaccgctgggagaagctcttgccgcagatgccacagctgaagggcctctgaccggtgtgcaccctctgatggctgcgcagggacgagttctggctatagcacttgccgcactcggtgcagctgtagggccgctcgtggctgtgggtgcgctggtgtcgcaggaggtaggagctgtcgccgaaggccttgccacaatgtgggcacttgtagggcttctggccagagtgagtgcgctggtggcgaagcaggtaagagctgtcggcgaaggccttgccgcaacggggacatttgtagggccgctcgccagtgtgggtgcgctggtgtttgatgaggtcagagctctgggagaaggccttgctgcagacctcacatttgtagggcttctcaccggtgtggatgcgctggtgctggatcagggtggagccccgcccgaagctcttcccgcagatgccrcagatgttaggccgagggccctgcccacccctggcccggccaccccgccgacctggacctcgaagggctcctgtgagacccaggggattctgaagcatctcaaactgcggtgtagacagcagggcccctgtgggcatctcaaaaggtggccctatgggcaggtcccctgtgggctgctccccaaacccctgagtgaaggagtccagggggtgaactcctacggagatattcaaaggactcttttcctcggggttcagaagcatctccgcaccttcctggaatytggaactttgagcttcaaattctgggctttgggttttgagctcagtgttctgggattcatatctagagctctcagattcatagccagggctccggggttcatacccggggctccgaggttcatagccagggctttggggttcatacctagggctctgggattcaaactcagggctctgagaatctgattcagggcttctgggtgcaaactcagggcttgggggcacaagcccagggcttcgggactcaaaccccgggytttcaggctcaaatctggggctttggggttcaaactctgggctttgtggctcaaacccagggctctggggttcaagcccaaatggtatctcttcgacttcatagtccccactgccttcttgctgagaaatttcctcttcctcattctcactcatgttgcctgcaggatgagagaatccagatcgtgtgagacctggaaggtcatttggtccattagcaaccacacacctcccacctcacatgcagggtcgctggcccctagacaagtgctgaaattcccacgcccccctcagctgacccaagacaccccagtccccgccggcccctccttcgagtcccaggtgtcccagccccgggccctcgctccctccctggagccacagccccttctcctgcgcgcaagtccactcctcggacgggcgctccctcctcacctctgaggtacccttcggggctcctcatttcgtcagaactctgcacatcctggggctcgaggccccacggcaacgcctcccgctccatccccgcgggctcccagtgcagcggcggcggcgatggcggccgatcccgcgacccggcctcggttgccccgagccgcgggcccccgcctcccgcccgctcagcgccgcccaggggactcggcggcccagcccgggcccccgaggccggacgtcttgaccccgcgcctctccagcgcgccgggcccctcccctgcccgcggccccgccccctcccaaggtctcggcctccccgtggccctcactggcccccgcgcgtcgcggcctcggggatgaggggcttcgcgactaccccggcggcccccggcccccgctcccgcccgagcccccaccttctggaccccggccccgggctgggctgcactgtccaacggccgcccagcacccccccaccctcccccgcacaggaagtgtccgtccgcggccaggtccccccgccggctcgcgccgcggcctctctaggagccgctggaggtggaaactcgttggcattaaccctgggctggaggggcccggccacggggtgggygaggaccggacgccccggagcccgcggggctaccggggcagtgtgtgtgcctatgttctaggtctccgtccctccagaggcccgtctgtccatctcccgggccccgcgtcgtcggtgcgtgtggccaagggcgaggcgacaagcgagaccaaggtcagcgagaaggagcgacgcttcccggcgccagcgggggcggtgtctcgctccctcccctcccgggcctccgggtcagctccggcagcgcctcgggaaccgggacggactccccttggcctcgccgaggtccttgagcctgggaccccctccaggaactccgctccccggcacctgcgcgcgcccgctcccgttcctccggcccccacccagctcggctcccctgatcctcctcctccctcctccctcctcgagggctaggatagttgccaaggagacagccccgccccggctcccagaggcacagcttctccgccccaggaagcccggcggttggccgatggggctcgtgctctagccgccccgcctcctccaaccccgcggacggctgggcgttaatggtcgccagggaacgccaggcgccttcctgattggccgggagtgctgtggtcgggtccgcctcccctgtcggccagaagcgccttcaggaggtagtgggagggaggtgccaggcatctcccctccagcccggcctgtgccatcaaaacttttcccgcccccacttagcctccattatgttttatgaaagccagaagatctgaggacagacacccttcctcctcgtcagcctcacaccccttgcctctcccctccaccttccccagcgcctgagtttaactcaatccctggcagccttagtccctgttgttagatttcctcacagggaggcaggattccttccaggtgagggtgatacaaaggagaattggactgagagaaccatctggccttcgaggcatctaacaactctccagtcttgtctgactcgaatggagtcttgcagaggaagggaacctgagaaacactgcctcgggcgcagctttgaattgaggaagtgagcctggacagacaacttaatatcatccagttcttgtcttttttttctacgcttcgtgctgaaacaagtttggcagcgttcttgacagttaacgagcccgatgcccctgtgtgagcaggagccatggatcgtgttttcttgtcgcctacccagacaaatgaagggaagagaatgtttgggaggaaggatggcctctccttcctgaaaagaggtgagaacaagaacttgaagaatgccaagtggtaaaaagtggagagaaactatctaaataaaggcttacaggtggggcgcactggctcatgtctgtaatcccagcacttttgggaggccaaggcaggtggatcacgaggtcaggagttcaagaccagcctggccaagatggtgaaaccccgtctctactaaaaaaatacaaaaattagccaggcacggtggtgggcacctgtaatcccagctacttgggaggctgaggcaggagaatcacttgaacccgggaggcggaggttgcagtaagccgagatctcgccactgcactctagtctgggtgacagagcaagactccgtctcaaataataataataaaggcttacaaataaaatcacaagagcttatgccacgaatgaagcggggaaaactttctgccctccagagaaacagcttccagccccatagctctctcccatcccaatgtatgtttgtcttgaaacctttgctaagaatggcttacatggtccagcactagagcccacagtcaaacagcctacaagaggaccagttttgggaagagctggacatggggtaccctctggtcatccccaaagcactcacacaggtaggaaacaagtctccttcacaagacacttttctctgacatccaacttgctgatccaccaaaattcacacaggagagcagccacaccctaaaaatgggtggcgagacctccagccacagctctgacaccgtacactgcctgcactcttatcatgagccacaagtcccaggtgtagcagaagctgggccaagacttcatgctgcccaggcacccgcatttccaagtgcaaattcagcctcactggcacctggagtaagagtggctcacttccagccagcctcctctaggaccagggtgccatctatgcacagggacttcacaaggaagccagcctccacctgacacacagccacagcagtgagagg

SEQ ID NO: 17631 - DNA, 21608 bp, Homo sapiens
atcattatcaatctgtctttcaagaagacataggtagtgagaataaaagtgagaactcccactaatgagtgagattctcaaagggggtgaataagtgaggcgaccacccctcatattgtcttatgcccaatttctgcctccaaagaaagaaaaagtaaaagctaaaaggcagaaatgaaatccacaggcagacagcctggtgttgcaccctgggtctggttaaagattgacccccgacctaaccggttatgttatctatagattccagacattgtgtggaaaaacactgtgaaaatccctgttctgttctgattactggtgcatgcagctgccagtcacatacccccacttgctcagtcgatcatgaccctctcacacagacccccttagagttgcaagcccttaaaagggacaggaattgctcactcagggagctcggtttttggagatgtgagtcttgccaaagctcccagctgaataaagcccttccttctttaactcagtgtctgaggggttttgtctgtagcttgtcctgctacaaaaataagtgttaaacatgagttttatattacctcataggtggaagaagacaggccaaaaaagctgttttaacaacaacaaaatgcacaaatatttatactaacaagacagatatccattgcagtatgacacgagaaacaaataaatgagacaagcagtcaattcagacattttaggaagtgatttttacagaacatagtgacaattgctgagatctggtagccttgcaagattcctttgttataataaaaataacattggcaaagaccattttatgatgcagacttctgcttttttaaagtttggggggaaggggaaacatttttattctataatgctgaaatttcatttttcttttctcttttttaagaccaagtcttgctctctcaccaaggctagagtgcagtggcgtgatctcagttcactgcaacctccacctcccgggttcaagcaattctcctgcctcagcctcctgagtagctgggactacaggcaccatgcccggctaggataacattttttgtttttagtagagatggggtttcaccatgttggccagagtagtctagaactcctgacctcaagtgatctgcccgcctcatcctcccgaagtgctgagattacaggtgtgaggtacagcatctggcctcatgctgagatttctttcattaccagttcaaacacctttcacttttcaaggcacaaggagaggaattccatgtgttgacactgggaggaagggtacagacctacttaaaagattcaaaacttctatgacagtaaaagaaatgtatatcaagttccttagggctgccgtaacaaagtactatcaactgggtggcttagaacaaaagaaatttattctctcacagttacgtaggccagttgagatcaaggtattatcagggccaagatccctctgtagcctctggggaaggattctttcttgcctgtttccacttctagcagcttcctgtgtttggtttgtggcagcataactccaatctctgcctccatctctacctggccatcatccctctgtgtctgtgaggaccccagtcattggttggaggactcaccctattccactataatctcttcttaaccagtgaactcaccgtattccagataaggtcaggttcacagctactgagggttaggacagagtatcttttggggagatgcaattcatcccataagtgggtggaaaaggatgattaacaagtggtatgtggggatgtattgttttgcatctacgtagctctcaccccatttctttccacaacacacatttgtcactctattctttattaggtttacagagaaaagtagatcttcaaccactttcctgggatgtggatacagctctttttttggagacagggtctcattctgtcacctagactggtgtgcagtagcactatcatggctgactacagcctcaatgtcccaggcttaagtgatcttcccaacctcctgagtggctgggaccacaagtgtgtgccaccacacctgactaattttatttttyaattgttttgtgaagacagcatctccctatgtttcccaggctggtcttgaattcctgggctcaagccatcctcctgcctcggcctcccaaagtgctgggattacaggcaagagcctccatgcctggccttcaactcttgaccttatgaacacagccctataccagttcccttcatgcatgtgcctataagctaaaccctttcccaagtgtacatgaaaatctgaaccccaacaaatatggcctaattctaaatctgactttcccaggagtaatttttgtcatttccagcttaccagcctttgtgagtgttgaatttcagcatttctgtttgcttgcagcagaaggtggagccaggatagggtggctcaagattagagtttcttccttaacagttcagtcaactttttaatcttggatttatagcttcctacctgctctcttaaaggtgaaatgatctattcaccttcagaccatttgccctcggggtctcactgagcaatctatggcttaagtcttctaagtctcttaatggccaaatacaatggacaattttcaggtatatctgacaccatttctctgcagcctttggcacctataaccactccatggcttccacaatgtgattggtcatttcttttttgtttatatgacaagtttttattcttcttctgcctgttaaatgcgcctgacccccagtgttctgattttcactatttttcttaaaaaaaaaagtttaaatgaaaaaagtttcttatgaaaatattaaaacatatacaaaaatagaatagacattgataatagatcctaaaattcctagggaaattcagcagactgagaatagctaatatagtcttccaaaaaaagatcaaatttgaagttgagaaacttcttgaattcaatttactaaaaagctatagtaatcaagacagtgtagtcctgacataaagataggattatagtctgggtgtggtggctcatgcctgtaatcccagcactttgggaggctgaggtgggcagatcacctgaggtcaggagttccagaccagcctgaccaacatggtgaaaccccgtctctactaaaaatacaaaaattaaccaggcatggtggcaggtacctgtaatcccagctgcttgggaggctgaggcaggagaattgcttgaacctgggaggaggagccagtggccgggattgggccactgcactccaacctgggcaatagagtgaggctctgtcaaaaaaaaaaaaagataggattatagattatagcataatgggataaaattgagactccagaaataaactctcacatttatggtagattgatttttgataagggtgccaaaacacttcaatgaaaaaagagtcttctcaacaagtgatggtggaacaactgaataaccacatttttgttctatctggggccctgattcaaaaacccaggcaaagatggagagaaatcagaactctcatacactgctgataggaggataaaatgcttactttggaaaagaatgtggcaattcctcaaaaggttaaacagtgttaccatatgacccagcaaacccacttctagatatataaccaaaagaaatcaaaacataagtctacaaaaaaacttgtacataaatgtttataacagcactattcccaatagccataaagtagaaacaaaccaatgtccatcggctgatgaatgaataaataaaatatgttgtggtatgtccttataatagatattattggtccatgaaaaacatacataaaaacattatgctaaatgaaagaagccagtcacggcaaagcaatatattatatgcctctatgtatactaaatgttccaaatagaaagaaagtagattaaagattgtctagggctgggaggggaggaggaggagaatggaggaatctgggaggcgatgaattaagggtactgaattaggggaacatggtttctttttggggagatagaaatgtaaaattttggtaatggttgcacatctctgtaaatatactaaaatccattaatttttgcattttattttatttattttatttttgagacggagtttcgctcttgttgcccaggctggagtgcaatggcatgatctcggctcaccacaacctccgcctcccaggttcaagcgattctcctgtctcagcttcccgagtagctggaattacaggtgcatgccaccacacccagctaattttttttttttgagatgaagtcttgctcttgtctcccatgctggagtgtgatggcacgatcttagctcactgcaacctacgcctcccgggttcaagcgattctcctgcctcagcctctaatgtagctgggattacagttgcctgctatcacgcccggctaatttttgtatttttagtaaagacggggtttcaccatgttggccaggctggtctcgaacccctgatctcaggtgatctgccttcctcggccgcccaaagtgctgggattacaagcgtgagccactgagcygggccaatttttgcattttacatagatgaattatatggtatgctaattatatcttaccaaaaattgaaaaaaaggaatagtactatcagccccaatgtgcccatcatcaatattctacatgtttccaatgttattgtatctgtttgcctacagtcgaggccctgatatcctgtttgattttcttgaattgccaaaatttgcatacatgcttacaaaaataatgcctgttgaatttgctagatatgtaaaggtttggagcaaatcaggtgtattaaatttattaatattgtttgaaatgtctaaggcaataattcccaaacttcgttgagggagaaggaaagcttttaaaatcccattgcccaggtggcatcccatactgttactgggaattatgcattgggatggatcctttaaccgaggagattattatagccggagctctgaaccagcaatctcagttcttgtgatagtgagcaaagaactacaaactaacaccaaaatgcaagcttaaagcaaagtttattgaagcacaataatacactctgagggacagcgggcttatttctgcgaagtgaactcagcacttctttacagagctcaaggtgcttttatggggtttgtggggaggagttgaggtttgggctgtatctgagtgacaggatgatgttatttgattgaagtgtatagctatacaatctaaaattaaactgtgcatggtcttacctataatttgttaagaaaagcctcccagggatgggggggcaaaactgtatgtaaattctattataatgatggcatgatgaacttggggtgaacttgaagacaggcttttgtgttgttgggcatgtgccaccttagggaatttccacctgtaccctcctttctctttctccaggatattttggccacagactttatcataaactccatcccttagggtggcattagggtagtcttgggcctgaatttaggtgggccagtggctgtcttagtgacagcctttccgctctcttctgtcatcccctcccaactgctaatgtctaactacctaacaattacccattaaatcagtgtgtctggggttaggagcaggcctcaatatgtttaatcattctccagataatcccaatactgtaaagtttgtgaaacacttgtcagataattcaattatgaaggctgtggaaggtgtttcagtaggatctaattggttaatgttatgacttaattaatttgaatcaaaaaacaaaatgaaaaagctttatatttctaagtcaaataagacataagttggtctaaggttgagataaaatttttaaatgtatgattgaattttgaaaatcataaatatttaaatatctaaagttcagatcagaacattgcgaagctactttccccaatcaacaacaccccttcaggatttaaaaaccaagggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgtgagtccgagggctgcgggcgaactaggggcgcggcgggggtggaaaaatcgaaactagctttttctttgcgcttgggagtttgctaactttggaggacctgctcaacccwatccgcaagcccctctccctactttctgcgtccagaccccgtgagggagtgcctaccactgaactgcagataggggtccctcgccccaggacctgccccctcccccggctgtcccggctctgcggagtgacttttggaaccgcccactcccttcccccaactagaatgcttttaaataaatctcgtagttcctcacttgagctgagctaagcctggggctccttgaacctggaactcgggtttatttccaatgtcagctgtgcagttttttccccagtcatctccaaacaggaagttcttccctgagtgcttgccgagaaggctgagcaaacccacagcaggatccgcacggggtttccacctcagaacgaatgcgttgggcggtgggggcgcgaaagagtggcgttggggatctgaattcttcaccattccwcccacttttggtgagacctggggtggaggtctctagggtgggaggctcctgagagaggcctacctcgggcctttccccactcttggcaattgttcttttgcctggaaaattaagtatrtgttagttttgaacgtttgaactgaacaattctcttttcggctaggctttattgatttgcaatgtgctgtgtaattaagaggcctctctacaaagtactgataatgaacatgtaagcaatgcactcacttctaagttacattcatatctgatcttatttgattttcactaggcatagggaggtaggagctaataatacgtttattttactagaagttaactggaattcagattatataactcttttcaggttacaaagaacataaataatctggttttctgatgttatttcaagtactacagctgcttctaatcttagttgacagtgattttgccctgtagtgtagcacagtgttctgtgggtcacacgccggcctcagcacagcactttgagttttggtactacgtgtatccacattttacacatgacaagaatgaggcatggcacggcctgcttcctggcaaatttattcaatggtacackgggctttggtggcagagctcatgtctccacttcatagctatgattcttaaacatcacactgcattagaggttgaataataaaatttcatgttgagcagaaatattcattgtttacaagtgtaaatgagtcccagccatgtgttgcactgttcaagccccaagggagagagcagggaaacaagtctttaccctttgatattttgcattctagtgggagagatgacaataagcaaatgagcagaaagatatacaacatcaggaaatcatgggtgttgtgagaagcagagaagtcagggcaagtcactctggggctgacacttgagcagagacatgaaggaaataagaatgatattgactgggagcagtatttcccaggcaaactgagtgggcctggcaagttggattaaaaagcgggttttctcagcactactcatgtgtgtgtgtkkggsggggggggcggcgtgggggtgggaagggggactaccatctgcatgtaggatgtctagcagtatcctgtcctccctactcactaggtgctaggagcactcccccagtcttgacaaccaaaaatgtctctaaactttgccacatgtcacctagtagacaaactcctggttaagaagctcgggttgaaaaaaataaacaagtagtgctggggagtagaggccaagaagtaggtaatgggctcagaagaggagccacaaacaaggttgtgcaggcgcctgtaggctgtggtgtgaattctagccaaggagtaacagtgatctgtcacaggcttttaaaagattgctctggctgctatgtggaaagcagaatgaagggagcaacagtaaaagcagggagcccagccaggaagctgttacacagtccaggcaagaggtagtggagtgggctgggtgggaacagaaaagggagtgacaaaccattgtctcctgaatatattctgaaggaagttgctgaaggattctatgttgtgtgagagaaagagaagaattggctgggtgtagtagctcatgccaaggaggaggccaaggagagcagattcctgagctcaggagttcaagaccagcctgggcaacacagcaaaaccccttctctacaaaaaatacaaaaattagctgggtgtggtggcatgcacctgtgatcctagctactcgggaggctgaggtggagggtattgcttgagcccaggaagttgaggctgcagtgagccatgactgtgccactgtacttcagcctaggtgacagagcaagaccctgtctcccctgaccccctgaaaaagagaagagttaaagttgactttgttctttattttaattttattggcctgagcagtggggtaattggcaatgccatttctgagatggtgaaggcagakgaaagagcagtttggggtaaatcaaggatctgcatttggacatgttaagtttgagattccagtcaggcttccaagtggtgaggccacataggcagttcagtgtaagaattcaggaccaaggcwgggcacggtggctcacttctgtaatcccagcactttggtggctgaggcaggtagatcayttgaggtcaggagtttgagacaagcttggccaacatggtgaaaccccatgtctactaaaaatacaaaaattagcctggtgtggtggcgcacgcctatagtcccaggttttcaggaggcttaggtaggagaatcccttgaacccaggaggtgcaggttgcagtgagctgagattgtgccactgcactccagcctgggtgatagagtgagactctgtctcaaaaaaaaaaaaaaaaaaaaaaaaaaaaactgaaggaattattcctcaggatttgggtctaatttgccctgagcaccaactcctgagttcaactaccatggctagacacaccttaacattttctagaatccaccagctttagtggagtctgtctaatcatgagtattggaataggatctgggggcagtgagggggtggcagccacgtgtggcagagaaaagcacacaaggaaagagcacccaggactgtcatatggaagaaagacaggactgcaactcacccttcacaaaatgaggaccagacacagctgatggtatgagttgatgcaggtgygtggagcctcaacatcctgctcccctcctactacacatggttaaggcctgttgctctgtctccaggttcacactctctgcactacctcttcaygggtgcctcagagcaggaccttggtctttccttgtttgaagctttgggctacrtggatgaccagctgttcrtgttctatgatsaygagwgtcgccgtgtggagcccygaactccatgggtttccagtagaatttcaagccagatgtggctgcagctgagtcagagtctgaaasggtgggatcacatgttcactgttgacttctggactattatggaaaatcacaaccacagcaagggtaygtggagagggggcctcaccttcctgaggttgtcagagcttttcatcttttcatgcatcttgaaggaaacagctggaagtctgaggtcttgtgggagcagggaagagggaaggaatttgcttcctgagatcatttggtccttggggatggtggaaatagggacctattcctttggttgcagttaacaaggctggggatttttccagagtcccacaccctgcaggtcatcctgggctgtgaaatgcamgaagacaacagtaccgagggctactggaagtacgggtatgatgggcaggaccaccttgaattctgccctgacacactggattggagagcagcagaacccagggcctggcccaccaagctgkagtrggaaaggcacaagattcgggccaggcagaacagggcctacctggagagggactgccctgcacagctgcagcagttgctggagctggggagaggtgttttggaccaacaaggtatggtggaaacacacttctgcccctataytctagtggcagagtggaggaggttgcagggcacggaatccctggttggagtttcagaggtggctgaggctgtgtgcctctccaaattctgggaagggactttctcaatcctagagtctctaccttataattgagatgtatgagacagccacaagtcatgggtttaatttcttttctccatgcatatggctcaaagggaagtgtctatggcccttgctttttatttaaccaataatcttttgtatatttatacctgttaaaaattcagaaatgtcaaggccgggcacggtggctcacccytgtaatcccagcactttgggagkccgaggcgggtggtcacaaggtcaggagtttgagaccagcctgaccaacatggtgaaacccgtctctaaaaaaatacaaaaattagctggtcacagtcatgcgcacctgtagtcccagctaattggaaggctgaggcaggagcatcgcttgaacctgggaagcggaagttgcactgagccaagatcgcgccactgcactccagcctaggcagcagagtgagactccatcttaaaaaaaaaaaaaaaaaaaaaagagaattcagagatctcagctatcatatgaataccaggacaaaatatcaagtgaggccacttatcagagtagaagaatcctttaggttaaaagtttctttcatagaacatagcaataatcactgaagctacctatcttacaagtccgcttcttataacaatgcctcctaggttgacccaggtgaaactgaccatctgtattcaatcattttcaatgcacataaagggcaattttatctatcagaacaaagaacatgggtaacagatatgtatatttacatgtgaggagaacaagctgatctgactgctctccaagtgacactgtgttagagtccaatcttaggacacaaaatggtgtctctcctgtagcttgttttyttctgaaaagggtatttccttcctccaacctatagaaggaagtgaaagttccagtcttcctggsaagggtaaacagatcccctctcctcatccttcctctttcctgtcaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatataygtvccaggtggagcacccaggcctggatcagcccctcattgtgatctggggtatgtgactgatgagagccaggagctgagaaaatctattgggggttragaggagtgcctgaggaggtaattatggcagtgagatgaggatctgctctttgttaggggrtgggcygagggtggcaatcaaaggctttaacttgctttttctgttttagagccctcaccgtctggcaccctagtcattggagtcatcagtggaattgctgtttttgtcgtcatcttgttcattggaattttgttcataatattaakgaagaggcagggttcaagtgagtaggaacaagggggaagtctcttagtacctctgccccagggcacagtgggaagaggggcagaggggatctggcatccatgggaagcatttttctcatttatattctttggggacaccagcagctccctgggagacagaaaataatggttctccccagaatgaaagtctctaattcaacaaacatcttcagagcacctactattttgcaagagctgtttaaggtagtacaggggctttgaggttgagaagtcactgtggctattctcagaacccaaatctggtagggaatgaaattgatagcaagtaaatgtagttaaagaagaccccatgaggtcctaaagcaggcaggaagcaaatgcttagggtgtcaaaggaaagaatgatcacattcagctggggatcaagatagccttctggatcttgaaggagaagctggattccattaggtgaggttgaagatgatgggaggtctacacagacggagcaaccatgccaagtaggagagtataaggcatactgggagattagaaataattactgtaccttaaccctgagtttgcktagctatcactcaccaattatgcatttctaccccctgaacatctgtggtgtagggaaaagagaatcagaaagaagccagctcatacagagtccaagggtctttygggatattgggttatgatcactggggtgtcattgaaggatcctaagaaaggaggaccacgatctcccttatatggtgaatgtgttgttaagaagttagatgagaggtgaggagaccagttagaaagccaataagcatttccagatgagagataatggttcttgaaatccaatagtgcccaggtctaaattgagatgggtgaatgaggaaaataaggaagagagaagaggcaagatgrtgcctaggtttgtgatgcctctttcctgggtctcttgtctccacaggaggagccatggggcactaygtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcacyaagccttggggattcttccatctgattgtgatgtgagttgcacagctatgaaggctgtrcactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcactttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccargaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgartgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtcttttttttttttttgagactctattgcccaggctggagtgcaatggcatgatctcggctcactgtaacctctgcctcccaggttcaagcgattctcctgtctcagcctcccaagtagctgggattacaggcgtgcaccaccatgcccggctaatttttgtatttttagtagagacagggtttcaccatgttggccaggctggtctcgaactctcctgacctcgtgatccgcctgcctcggcctcccaaagtgctgagattacaggtgtgagccaccctgcccagccgtcaaaagagtcttaatatatatatccagatggcatgtgtttactttatgttactacatgcacttggctgcataaatgtggtacaascattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtayattgtattgtatactgcatgattttattgaagttcttgttcatcttgtgtatatacttaatcgctttgtcattttggagacatttattttgcttctaatttctttacattttgtcttacggaatattttcattcaactgtggtagccgaattaatcgtgtttcttcactctagggacattgtcgtctaagttgtaagacattggttattttaccagcaaaccattctgaaagcatatgacaaattatttctctcttaatatcttactatactgaaagcagactgctataaggcttcacttactcttctacctcataaggaatatgttacaattaatttattaggtaagcatttgttttatattggttttatttcacctgggctgagatttcaagaaacaccccagtcttcacagtaacacatttcactaacacatttactaaacatcagcaactgtggcctgttaatttttttaatagaaattttaagtcctcattttctttcggtgttttttaagcttaatttttctggctttattcataaattcttaaggtcaactacatttgaaaaatcaaagacctgcattttaaattcttattcacctctggcaaaaccattcacaaaccatggtagtaaagagaagggtgacacctggtggccataggtaaatgtaccacggtggtccggtgaccagagatgcagcgctgagggttttcctgaaggtaaaggaataaagaatgggtggaggggcgtgcactggaaatcacttgtagagaaaagcccctgaaaatttgagaaaacaaacaagaaactacttaccagctatttgaattgctggaatcacaggccattgctgagctgcctgaactgggaacacaacagaaggaaaacaaaccactctgataatcattgagtcaagtacagcaggtgattgaggactgctgagaggtacaggccaaaattcttatgttgtattataataatgtcatcttataatactgtcagtattttataaaacattcttcacaaactcacacacatttaaaaacaaaacactgtctctaaaatccccaaatttttcataaactcagttttaaactaactttttttcaaaccacaatctgatttaacaatgactatcatttaaatatttctgactttcaaattaaagattttcacatgcaggctgatatttgtaattgtgattctctctgtaggctttgggtataatgtgttcttttccttttttgcatcagcgattaacttctacactctaacatgtagaatgttactacaatattaaagtattttgtatgacaattttatttgaaagcctaggatgcgttgacatcctgcatgcatttattacttgatatgcatgcattctggtatctcaagcattctatttctgagtaattgtttaaggtgtagaagagatagatatggtggatttggagttgatacttatatattttctatttcttggatggatgaatttgtacattaaaagttttccatggcagaaatcttttcaaaaactttttttttccgggatggattgaaggccctgatttcaccacaatgcaatatattaatgtagcaaaattgtacttgtaccccatgaatatatataatcttaagaaaatttttttagccaattattattacttactagatattaggctgtgttctgaatcttaatttaattcctccaaagaatcttatgaggtaggtaggagctattgctgctattctgttatgcttatgttgctgttatgaaaccaaggcacagagaggttagttaacttgctgaagaaaatgatgtgctggatttttattctagctattctggaataacaactacacaaccttatgtctgagccaaggaaacatacggtgtggcaacagttaccatgtttttaggaacagcagcactcctaatgtttgctgcagggaaaaaggaatctcagaatttgcctgatccctataatttttttcctaaatattttgaaatatctttcagatgtattttaaaatttaaggatattttgttcagttcatacagaatttttttttttttctcgagatggagtctcactctatcacccaggctggaatgcagtggcatgatctcggctcactgcaacctctgcctcctgggttcaagcaattttcctgcctcagcctcccaagtggctgagactacaggcgcatgccaccatgcacggctaagtttttttgtatttttagtagagatggagtttcaccatgttggccaggctggtctcgaactcctgacctcaaatgatccgccctttttggcctcccaaagtgctgggattacaggcgtgagctaccgcgcccagccaaatttctaacttgttttgttgttgttgagacagggtctcagtctgacaccaaggctggtgtgcagtactgcgatcacggctcactgcagtctcgacctcctgagctcaagtgatcctcccacctcagcctactgagtagctgggaccaccacgcctggctcatttttttctattatttattgaaacgggttctggctatgttgcccaggttggtcttgaactccggagctcatgcgatccacccacctcagcgtccgaaaggattatcaggagtgagccaccgtgcccggccaaatttctaacttttgaattgacatattcatttattctctttatcattcagggagaaatttggggatggatagccttgaagcatcatccaccaagttattttatacaccagatttagatacaaagtatttttttattatttaaaaaaatcaaattctagcttttactctgaagattctaaaaagaattttggagtctttaattcatacttcaggggcaggggaataagtaccaatattcgtataactttcagtgcaagtcacgttagctaactgtagtctattgagttaaatatccttgatttattccttaaaactragtcactatgacggcacttttttgtttttttttttcgagacggagctcgccctgtctcccaggctggagtgcggtggtgcgatctcggctcactgcaatctccgcctcccaggttcaagcgattctcctgccccagcctcctgagtagctgggactacaggcacacaccaccacgcccagctaatgtttgtatttttagtagagacagggtttcatcattttggtcaggctggtcttgaactcctgacctcgtgatcagcctgcctcgacctcccaaagtgctgggattacagtcatgagccactgcacccggctgaatggcactttcataaaacagtaaataaccaacttcactactgcccccaagagttttactatgtatatgagggcatctgttttaagtatgggtataatgttacgggtttttctttgtgtaagtttgggttcacaatttcatcattaaaacaaatgtaaaatactttgtgctttctgtgtgctattaagaaagtattcaagggaattttgaaaatcaaatttaattactctcatgtttgtaaaatttttgaaacaaatgtttaagagaggataatgttagaaattatctttccagccagacctggtggctcacgccagtaatcctagcattttgggaggacaaggtgggcagatcacttaagcccaggaattcaagaccagcctggacaacacagggaaagcccatctctacaaaatatacaaaattagtggccgagcgtggtggctcacgcctgtaatcccagcactttgggaggccgaggcgggcagatcacctgaggtcaggagttccagaccagcctcaacatggagaaaccccgtctctactaaaaatacaaaattagctgggcgtggtgatgcatgcctgtaatcccagctactcgggaggctgaggcaggagaattgcttgaacctgggaggtagaggttgcggtgagccgagatcccgccattgcactccagcctgggcaacaagagcgaaactccatctcaaaaaacaaaacaaacaaataaacaaaattagtcaggtgtggttgtgcacacctgtagtcccagctacttgggaggctgaggtgggaggatcacttgagcccggggaagtgtaggctaccatgagccatcatggtgccactgtactccagtctaggaaaaaaataaacattaaaaattttaaaatcttaaaaaaagaaaagaaattttctgtccagatatctttatttttaacaaatcgaagtgtattaatagtgtttatgggagcgtgcccacacaaggacagcaagcctaggaagtgcaagtcaagaaaactttttgtgaaataatttaaactgaaaagaaaaagcagagatttttttctagaaaagtaaggagtggaggtaaaaaaaaaacacagcagagacacaggtatgctacggaaccaaaggtgtgccaatggtactgacagtttaattcagaaaaaaatgaatcagaaaatggatatttttaaataagttaggttgctgaaaaagagaaatgcagtgaagccttagatgggagtgagataaatcagccattggctagaggagtttcttgcccaagaccagtggtgatgtccccaaatgcctggaaacaactgttgtgacattataaagcccccatagtctaagttgggtgagactatacttatgcattttctcacctgtaatatagcttaaaagtatttctactctgggatttctttacattttactaaagcgcaattatatacttaaaactgatagtgtatgctgggctgctagtcattctcaaccctggccaattatcagaattgtttgttgaatatataggtgccatatataggtgcatacacacacacacacacacacatacacacacacacacacacacacacaccatatttcattcctcatatcgaatattctgagagagttagtttgtggagggtagttctggacaatttatattttcataacacctctggttatttttttttaagtagagatgaagacttgctatgttgcccaaaatggtcttgaactcctgagctcaagcgattctcccaactcagcctcctgaagtgctgggattacagccgtgagccactgcattaacctctgattaatatcatagattaacctctgattaatatcatagatttatttgtttgaatgcttcatgtatcctctcaaccacaacttgtttgcagagttttaatctgaagggcttaggtctcttgttcaatgaatgagtttgatctgatgggtgagaggaaggtgaaatggaaagcgaacgagaagccatacagattaggcgagtgagcctaatctctccctaaccataagattgagtatgcctgaattcttcccagagtggaagaatccattttaaatatatatatctacatgtacagatcctttaaatatttgttctgacattcattgtttttgagtcactgtcattgagaaaagtttagaaaggagatattaggagcaggaaatagaaagtaaataaaatatcaaaataaaaatggggttttataaatgatataataggcaaaataaaggaaaggcatcctagacctctggttaaaatgaagatggcacttggcgagatgtgttccagggtagttcacatgatgtatgttttcagagaattgtcatattgcatatgctgctatattttttattttcatgaattaaaaggcatgttgagatttcagagttttacttatgatctcagactctgcattttttctctgtaatgtttgacatttcttcctagctaagtctctagttataaggtctgtgttgtggcatgtggacagtgagtggaagaacctaagaactcaatttggggcagaagaatgtaatcaattatttcagaagtgatacaaacaatatgacatgtagagcattctggcctttcctgggtcttttttctccattcctggatttcttctcttcatgtgagcaagtctgaggttactatataatgtctctcacaggc

SEQ ID NO: 17632 - DNA, 53328 bp, Homo sapiens
acatgggacaattgataaaaagctaaattgtaaacagtccttgccccagaggacccatggtcttagggcagatgtttacatatatgacagtaatgtaatgtagaatgtgaagagtaccatgacagagttttggagaacaatgtgctgtagaaattcagaaaagggacagctcatttctagttggtgaaagccttcatgaaagtggcaaagttgaacctgagaggcatatttagagggcaaagattgaggtgagggcattctagccagaagtgctagggaactttaattgagcacatactctgtgccaagaactgtaccaagaactttacacatacatgactcatttaatcttcataactctgtaaggtaggtactgtcatcccgatttaccagtgtggaaaatgaggctctagagcagtgcccggtagacttttcacaacgatggaaatgctcaaatatctgcactgtccaatacagttgtgactagccacttgtggccactgagtgctgaaatgtggctaatgtgactgaggaactaaatttttgattttatttaattaattagaatttaaatttaaatagccatacctggctaatggttaccccactggatagcaggctgtagagagcttaggtagcttgtcctagtcacacagtggtaggttcaaacccaggcctgttggacctcaaaacttgaggtcttaacctcagtgttctacagtatggtaaaggcctagaggaggcttcagttctgttcctcgtatcaggcaaaacatgactgcaaaaccatagagggagtaacataacttaagcaaagattgaagatgggaagttgctggcaagaagatacagtttgaaggggagtggaaaatgtgtagaacagagtatctgatgctggtgtctgtgatttgcagctgttttttctcccctagttaaaaatgggctttgagtgagccttgaacctgtcttggactaattcagaaagcctccaagagattgcccccttagataagtccagtaaatgtagttgtctacatttttcaaaaagataaatgggaacaagtgtgctacgagattcagacatctgacgtgatgttttcgttgttgcctcagcaacagatgcggttatgaacattgacaacataagcacacgattgcagatacacataggcgtataaagcacacaaaaagaagattctctgaatggttttgtgcttatgatgtattttcaatattgagtaattatcaagatactaatttatagttatatagcattttatagttaacaaaatatttgaaatggcatatttttttcagctgtacaagaaaggtagttctattttccttttatatttgaaataggctcaaagtttgcccagggagcttaggttctttgacttatagagaattcatgatttgtttctaactcttctatttactgtaacttcaaagtggaaaatgaaccatataaatgtgtaatagaattatttctaatatatcaaaataagtaaaaataaaaatataaagcaatggcgattagaaggcagcttgtgtgtgagtgtgtctgtatgtagttattctttagtcctaagagccaagatagttgttttgttgacattgggcttgtgctgctgttacgtgggcctgagtcccctagaaggagaggcagaggaattttaaatcagagtgggtatgactaggctcctgactctgcaaactcatgtctagttgaggtgacaaaactacagtttaaggcaggttgtaatcacagctaatatggcactttgactgtgttatctctgtacctcacaaaaaccctgtatggtgggtgttcttatttgcatttcataggtgaggaaatcaagactcagagatgaaatcatctgtctagatcatagatagcaagtggcaaagctggaaatgggatccagtctctgatctttctcacaccagggcctgccctttttctatgtggtgttgcttctctaagtaccaataatatagttccaagttttttaagagagggagaagcaagtggggtttgaaggatcaggaaatatatagtacctgagctggtcatttaaaacgggtatgattttgatcaatagtatggcagagatggcactcagggcaggagagcaaagtcagagaaatttgcatacctcctttgggtgatgttgaggagagctcaggctgatagtttccattttgacttctttgtgctatttctgcagggaggtcctggccagtgaagccatccttaatgttcctgataagtctgactggaggcagtgtcagatcagcaaggaagacgaggagaccctggctcrccgcttccrgaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagcctcatgagtagctgggaccacaggcgcatgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcacttgtaatcccagctactcaggaggctgaggcaggagaattgcttgagcctgggaggtggaggttgcagtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttgagaagtgtcttgtgttcatgttgcctgtgaccgttgaaatgaagtagtatgtgtaatagcaggggctagagctttaggcccagctgttactccaaaatcacacagggcagtttctccctgaacaacccaaagtggaaaagggatccaaggcttttgctatttttctcttaaagcattcatcttattcatagataagagcccatttagtccttcggatatttaactcctatgtgccaggcatttttctaagctccaggaccatagtcatgtcccaatatggtccctgttgtcccagagattacagtttaatggggaatagaagggacagatttaagaaaaaaaagataattctcctttggatattgttttaggtgcttgatatatctaatatgtgtctgttgtgctgctgggcagttctaaactcatcagtacctgggttggttacagggctttggggatcatcagggtataggccataggtgaaattaagatagggtaaatacagtcctgagctgaagatgattacctgagaaatatcagtatttaaggagtgcttgaaaatagtgatctaacatttacatagagaaggagcaaagagaatgctacatattaggcgcaaaaagaaaaatatttttacctttatattgggcacttatggtccagacactgtttcatttaatcttcacaaaatctctgtgaggtaggtattacctctattttactcatgaaaaaaaaactgagactcggaaaattgaagattgtggagcctggggtcaacaggcttaggctttttaaaaaacaggccaggtggctcatgcctgtgattgcagcactttgggaggctgaggcaggcagatgacctgagatcaggagtttgagaccagcctagccaacacggtgaaaccccgtctctactaaaaatgcaaaaaattagctgggcgtggttgcatgcgcctgtaatgccagctactcgggaggctgaggcagtagaattgcttgaaccctggaggtggaggttgcagtgagctgagatcacaccattgcactccagcctgggtgacaagagtgaaactccatctcaaacaataacaacaacaacaacaaaaaacaactcaaattactcatggccctgggaatgggggcatttaaaaagttaaccaagggaaccaacctggtttccacaaagatggccacttctgggtcagcccaatcatcagtatccctgggtcctcagcatcccttcctacctcttttgactgggaattacgagattacagccccacctacggaaattgagcacattagcactggccatgctgtacatacagcaaatgagagggcttcatactgttacaacaatctgtaccacaattctctgtgcggtctgcccagctctaaatgacatgtcctcagaggcatcatcatctccaagtccatggaaaccatgcacttacagaaaccagaacctcccataccacatgttactaatgacctacaacatcgacttcgtctgtatcatgcagtgctcaacattctggttgcagcatcacatttatcaataatttgattccatgctgattcctttacttggagtattgagatcccccaggtacagtgaaggtatgaccctcttaaatggaagaccaggagttgtttcccctatgctatggcaatccgccacccggaagcacttgctgcaccaacagcattcccaaagcttgcctctgcagccctgtagcacccattagaaacacttctcacaatgaactactgtgctggcaaacccataactggactgccggacagcaagctctgtgaggcatctaggaaaaaagctcgcgaaatcccgagaaacactcttcactccggaatagcgtcacattcttgagtcatttgggatgacaggggatatcctggagcaggtgtattgggaagtcagtgaacaagaaggctaattcattagtgggcctgctagcgtagtattttaacgatttcgcagcctttaaatcattggtggtctttagcgtgccggatcagctggtggtggagttggaggatagatggcagggatctgaagaaaggtgaagtgtagataggagtagagacaatatgaagtttagaaaagactaattgctggacgcggtggctcatgtctataatcccagcactctgggatgccaaggtgggaggactacttgagaccaggagttcgggaccagcctgggcaacgtagcaagaccatgtctctacaaaaaataaaaaattagccaagcgaggtggtgcgcgcctgcaatcccagctactcgggaggtgagaagatcgcttaattccgggaggtcgaggctgcagtgagccgtgatcgtgccattgcactccagcctgggcaacggagcgagaccccatcttaattaaaaagaaaaaaatacaggagagactgggctgctttgaaaagtggatttgacgggaatgtggggtttggagagatcttatgttttccaagactagaaaaacattgtggttccgttcagccctcccggaaaatacgtaggggacttaaagagcggaccgagtacctgtttgtttccccatcccttagccggcagggctctggcagcgccctgggagaacttagggaagggccttctcgcagcggttaccggaagtgacgcattcattctcgcgagaacaaagacgcgcgagcatcggcggcccggaaccggccttggaacaactgtggaacctgaggccgcttgccctcccgccccatggagcggcccccggggctgcggccgggcgcgggcgggccctgggagatgcgggagcggctgggcaccggcggcttcgggaacgtctgtctgtaccagcatcgggtgaggcggggcrtgagagggagcggcggtgggttggagcggcggtgggtttgagcgtctgtggaacacagggctgacagtgtgggatagatggttggtgggaccttgggcagtatttgggggccagtgggcttgtgtgtgtgtattagagagaaagatactatgcctgygtgtccaaagttgtatttgaggtactgggcatagatagagctgttgcggggaacttgggtatgactgtcaggctgtgaccaggtgtttagtgagtgtgacagtgcgtgtgtgtctctgtgaatgtggagtgtcagggtgtgtgaggcagatgcacgtcacagtgtgtatgtaggagcacgaatgtgtgagaagagggctgaaggggactgcctttgggaatgtgtgcgtccgtgtgtgtgtgtgtgtgtgtgtgtgtgtgtgtgygcgcgcgcgcgcgcgcttggaggccatatgatatcagtggggactggagtagacaaggaaggcttcatgatgggtccagagttaagcctttggaagcatggatgggctttggaattggggatgtattccaggtcgggacagtatgagggtgagttggtgcagagcatggcttcaaacgaaaggctatattagtagatggagatggggggcgctctagtaggtggaggacagttaacatcagactcaagaattttactttgatttaatagagaatgtttaaccattgtagtagcagttaaaaaatcatatttgggtcttgtttgtttgtttttgtttttgagacggagtctcactctgtcgcccaggctggaatgcagggcgcgatctcggctcactgcagcctcctcctcccgagttcaagcgattctcctgccacagcctcctgagtagctgggattacaggcgcccgccaccgtgcctggctaatttttttgtatttttagtagagacggggtttcaccatgttggccaggctggtctcgaactcctgacctcaggcgatccacctgtctcaggctcccaaagtgcagagattataggcgtgagccacggcaccaggcctgggacatgtattttttgatataccgataaaagctgtgaaccctttccccagaaaaatgcacagatgcacattcacacaaccatgcattgccatttgagaggttcgtgccttcctaaaggacattttaggtaaatagaccctggactaataattcctgtaatataggctttgttttgttgcctgtaaagtaagtatagtataataattacatgcatcatggatttgagagttaaataaaatagtaatgtgtgtaaagctaaatacggtacctgacccatgaaagccctcaactgttagcacctgctgctactttgttgttgttgctgctatgatcataatgctcctcattaattggccttaaggaaatgtcaagataaaaagtgttgttctaggaaaatggttttgtaaaggataaatttgagtggaacaacatatgggacaagatgaacaggtaagatcttactaaaatgcctgggcttggcttgtgaatagagaagttaattcaagaggaaaagtaataatttgttatctaaaggaacatgggtgtagtgagaaagctcgtaatttggggtgggagaaaggggagataggagtctaccttgggaaaataggcatatttagggtaattagaatgacaactgaaactgttagaactgaggaagttttgtgaaccaggtttctagatagggcataggagaaaatcttggagaaagagaatggaaggtgaaggactaaggcattaagtcctgtgatagcaggataagtagtaaatttaataattctcaccatcagagggaacataacacactaaaaaaaaaaaaaagtgggagccaagtgcttccagtggcatgttgcctgtgttacctaagcctgcctatccgcctggtcataaggaaaaaggatgcatgctggcagcttttgtgacttcttttcttggtccctgggtggggatggatgaattaatcactttttgttttattatggtaaagtatacatmacacaacatttatcactttatttttaagtgtacagttaggtggcattaagtacattgacgttgttgtacagccatmaccctatctccagaatattccgacttttttgttgttgttgtacatctataaacttcccatagaatattctttgtgaaaaggtagaatttcacagagttgatgaaatataaattaaggagttgaaggatcttacaaagtgggatttttgaaatagataacttattgctccattaacatgagcattcagggctcagtgttgttcatggttgtgcctgattctcatttccatggtggtaaaggcctgcatgggacatagatataactggtcacctgctcataacaaaaggaagattgaagggagtgagaactgtgggtaggctagcatgcagtctatcctagtttccttcttctctatgcaccaggtatcatcttatctctagcttcttttttcctctcaccctccaattcacactaccctatccaagctatgtcttgcttccccacctataatatattttttctgtcctggcccctgggctcttctctctgtattcatacacagcctttattacaactctggtttgtgtcagagattacatatgttggaaattcttttgaactctccttgtgatatcagaaacatagtgtagcctgtttagccctgactgctatttctgagctgcattattaatgttgccagaatatgatggggtctggctatttcctgtaatatgcatcagaatgggtttaatttcagtcagaattggctaaattactagtcacaggcaagagatgttaggttcattatgtagctatggaagcagaagtacactcattggtaggattttttttcttcatgtcatttgaaatgcatacattaggattggagttttttgctttaggcttggttatattaaaactttctcttgctgtttggagtccaggaagccctgaattaccttcttcattttagttatgctagaagctggggcacatattagttgtcttgattaagctctgaaaggggtttgctgaggagacaggatctttttttttctaacattatatatgagagagagttctgaaaagacctgttataaaatcagtttcaggcacttttcccttgtatgctgttgtgtgtttgaaggtcagttttaaagcatkggtgtaatagtctcatggtttatctttttaaaaagcattgcctcaagagagctgtggataaatatatttaattagtaaagctaaaaagttttgttgtcttaagttatttctttggtagcaaataaatcttcacaagaacctaattttttttttctgttgattttctattttggcaggaacttgatctcaaaatagcaattaagtcttgtcgcctagagctaagtaccaaaaacagagaacgatggtgccatgaaatccagattatgaagaagtaagtgtattccttgacttacatttccctggttctacagcccaaccagatgtcatcatggggaaagaggccaggaatccactcttctcaggatctttttgggaacatatatttttttctctcattaaatatattctatttcaaataataatatcacattaagattaagaaggtttagttaaaatcagctaggacacttacacactgttggtgggaatgtaaaattgtgcaactgttacggaaaacagtacggtgattcctaaaaaattaaaaatagaattaccatatgatccagcaattccatttctgggtatatacaaaaatgaattgaaagcagggacttaaagagtaatttgtacactcatattcataacattattattcacaatagctgaaaggtaaaagcaacccagtatctaccagcagagacatgtataaacaaaatgtggtatattcatgaaacggaatatcatgcagccttaaaaaggaatgaaactctgacacatgccacagcatggatgaatcttgtggacattatgctaaatgaaataagccagtcacaaaaagacaaatactgtgtcattccacttatgtgtggtacctagagtagtcaaactcacagtgaaagaaagtagaatggtgtttgccagagggtgaagggaccagcaaatagagaataatttttaataggtgcggagtttcagctttgcagaattaaacagttttgtgcagtatagtgatagtagcaaaacattgtgaaagtatttgatgccaggctgggcatgttggctcacactgtaattccaacactttgagaggctgaggtgggtggattgcttgagctcaggagttcgagaccagcctgggcaacatggcaaaaccccatctctacaaaaaatataaaaactagctatgtgtggtggtgcatgcccgtagtcccagttacttgggaggctgaggtgggaagattgcttgagcccaggaggtcaaggctacagtgagctgagatcataccactgtactccagcctgggtgacaagagcaagaccctgtctgaaaaaaaaggaaagcatcttgatgccactaaactgtacacttaaaaatggttaaggtggtaaattttatgctatgtgtrttttaccacaatcaaaaaactatttcatttcagttaacaaaagtcagctagggccgggcgtggtggctcacacctataatcccagcactttgggaggccaaggcggatggattacctgaggtcaggagtttgagaccagcccggtcaacatggcaaaaccccatctctactaaaaatacaaaaattagccaggtgtggtggcgggtgcctgtaatcccagctacttgggaggccgarggaggagaattgcttgaacccgggaggcggaggttgcggtaagctgagatcataccactgcactccagcctgggcgactccgtctctaaataaataaataaataataaaaaataaattaccccaacatttagtggcttaaaatagcaaacatttagtatcttatagtttctgtgacttaggaatttgggagtggcttagctgggtgattctagcttagagtctttcctgagacatctcaggatattggtcggagctgcagtaatccaaaggcttgactggggctggagtatctgcttccatgctcacttatatgaatgttggccaaaagcatcagttcttcgccatgtgggcctcttcatggggaagcttgaatgttttcatgacatggaagctagctttccccagaaagatcttttcctcagaaagagtgagtgatctragagagagagagagagagagagagtgaacgagcgagcaagatgaaaaccgaygtatcttttatgatctttacttggaagtgagactccatccttttccaccacattctgtttgttacagtgagtcactaagtacagcctacattcaaggggaggagagttaagctcttaaaaagagaagtagacatattttaaaacttccacaggtagtgtgctaagtactttacagatcattcttccagttatcacagcaatcttatatttaggtattattttgcaaatgaggaagttgaagcttatagaatcacatagctggtggttggtraagtgtggatttgaaataaatactttctgactctaatatctgtgcttaattccattttgattctcaaacttggttatgtggcagaatcaccaggaaagcttaatagtataaattatcaggtcctacatgtacatggaaattctgtttgcttctttttctttttttctttttttttttaaaagagatgtggtcttgctatgttacccaggcttgacttgaactcctgggctcaagcagtcctcccacctcagcctctggagtagctgggactataggcatgcgccaccacacccggctaatttttaattttttgtagagatgaggtctcactgtgttacccatgctgatctcgaactcctggcctcaagcaatcctcccacctcagcctcccaaattgttgggattacagttacaactacacccagcctagaacgccagatttgacttactcactgtgtgatcttgttacttagccaatttgtgcttcaattttctcctgtgtggtgaaagtattaataaatctacctataataggattattgtgacaagtaactgagttaatatatttaaaatgtttactgcttggcacttagaaatgtaatagtagtaatagtgatggtatttttatgtgtgttttcttttaaaaaattactaatttttaattatacaaatcagaaattagaatattataaataatactgatctttccccctctgttcatccacccacaattaagtagcatttcaaatccagtccctttttattggaaataattttttttattgtaatgtttttctttcttattaggttgaaccatgccaatgttgtaaaggcctgtgatgttcctgaagaattgaatattttgattcatgatgtgcctcttctagcaatggaatactgttctggaggagatctccgaaaggtagtgtggatgttttgagatgagagagagtamatcacaaactttagcaatgtttgaatcatgttaaatataataaactagaataagaatcggaaaaactatggtctgcttcctgttttgtaaatmaagttttattggaacacagccacattcatttctttacacattgtctatggctgctttcttatggctgcagaagtgagtagttttaacagagactatgtgacttgcaaaacctaaagtatttaccatatggttccttacagaaaatgttgactcctgatttagaaaatgcatttttgttgttgctgtttgatgggactatagcaatggtgttagatgaaaatttcagtggttaaggtgcttataaaaagttgttttctgtattgcaatcttttttttctacctaattttaaatgtgcccatatgaccatttttatatatatccatgagatttgtcagccttttccagtttcaaatgctttttgcctctttttacttttatgagccttatcatgaaatttacatgccctcagtatggatttggwaattttattcccttgtattttattatgacttattttctcatttgaatattcttttagagtatartaattaatgtgtggtcactattgcagcccagcaatttgcagaacagatttttagatttctttctttttttagctgctcaacaaaccagaaaattgttgtggacttaaagaaagccagatactttctttactaagtgatataggtacgtatcagtattaaaataccattgtaatgtaatgtccctttggcccataaaagatctttttgggaattcaggagaattgttgatacactatacaaagtctatagaatttcaacatctataagaagttataaaaatctattactattgatgctaaattaaaactaggatattttggctaggtgcggtggctcacgcctgtaatcccagcactttgggaggccaaggtaggcggatcacaaggtcaggagttcaagaccagcctggccaacatagtgaaaccccatctctactaaaaatacaaaaattagctgggcacaatgccgcatgcctgtagtcccagctactcgggaggctgaggcaggagaatcgcttgaacccaggagatagaggttgcagtgagccgagattgcaccactgcactccagcttggacaacagagtgagactttgtcacacacacacaaaaagaaactaggatattttattatttatttgtggctaagagtcctttttttgtctaatagatgttccaatagctgacaaaaaaatcatgtgaaatgaccttactcaatttctctccccccctaccattgacatagtaattttgtttacagtggaattacatctccttgagggatgggtcctcaagtcaactcttttttgtttgtttgttttgagacggagtctagctctgttgcccaggctggagtgcagtggtgcgatctcagcttactgtaacctctgcctcccaggttcaagcgattctcctgcctcagcctcccgagtagctgggattacaggtgcccgccatcacacctggctaatttttgtatttttaacagagacggggtttcactgtgttggccaggctggtctcaaactcctgacctcgtgatctgcccgcctcggcctcccaaagtgctgggattacaagcgtgagccaccgcacccagccaagtcaactcttcagggtgaaaaatctctgcttaatcagaatgactccagaaaaattcctaaaataaccagtacctaaccttttggaggaacctcaaaaaccaaaaatttgtttccccatagattttggttttgcctcttttccaaggtcatgagggctaaagtccaattgaaatgagtgatttaggtgggagaaagaggcttataagagtttcagggattttcccaattgcttgttgcatttctatttggtgttaattctaatgagttaaatgaacatatagtataattttgtagtatttgtttaatgttacttttttttctgtgaagaaaacctggacactgtagtattagttgtgtagttacgatgatccatataaacttgagcatcagagtagatttgtacaaaatgtgaggtgaatttttcttttaactcaatgatttctgttacttyaaagtatattttaaactttatttaggrtctgggattcgatatttgcatgaaaacaaaattatacatcgagatctaaaacctgaaaacatagttcttcaggatgttggtggaaaggtaggtgaaacctgaagtaatgtttcatgcctattgaatatagtctctctgatatagttagtccttgagctttggtgtctttgctgtatgcccataacagtcttactttttccatttcagacctcaccacactgaactgtagttttgtgtttagtttttttgtcccttctgctaaacagtggttccatcagagaaggaacagcacctgctttttttttctttttcttttttttcatttttcatacttaacccagctcctagacttcacctgtcttgttcaagtctgtttttccatcatagtatctagcaaagatacaggctgtgaatacataatatgttaacacttattattttattcttatgaagcacatccaaaacacatacatgcacatcctgggtccactttaagaaaaaaaagaaagtatatatatttttaaaacttattttccttcccccaatttaaatgagtcatctggagaagaaccagaaattgtgaattgactcttaaaatgttcatttcattggtaacttaagcagttttcttgtttccagcatccaaatttcattccaataaagacttaaaggccaagagtctgaaccttgtgttgagttgtgtgtgccgtctctttagttagtgaaaatagttgttggcctcttggaggtgttggaaccttggtgatgcctcttctcttaggaacctttcacgtatgcttggcaccaaatatctctgctttttttttttttaatccaaagacttcaggacattcctgaagttagatctaagtatttactcacatttaatctactataaggaggtatgatgcttcttcaagtttggaagtcacccttgcctttactttccrgtttaatggattgagcttattttgaatatagtaaaataaaaattaatagcccacctgtattcaatttttaccatgtaccaagcactgtgttaccttctttactttcgttatttcattggatcctaataacaattctgtgaagcagggactgttagtcatccaattagattactgagagaggttaaataacttggtagatcacatgcctagttaagtggtggcactcagacttgaaatatttttgtgttattacagagcccaaggtcctcaccactaccctgtctacagcctcgtaaggatattgttgtctttcctttttaaatttctctaccatttaatacttaatctgtcttattattttgcagataatacataaaataattgatctgggatatgccaaagatgttgatcaaggaagtctgtgtacatcttttgtgggaacactgcagtatctggtgagacctgttttgtttctttgaatttaagtgtgtataggattctcttatttctgaagatcatgaatatagtaggtcaaaaataaagtagcttttcccatacagtgttggtgtttaaagcattttctcttttgaaggccccagagctctttgagaataagccttacacagccactgttgattattggagctttgggaccatggtatttgaatgtattgctggatataggccttttttgcatcatctgcagccatttacctggtaagaaatggatgagaacttgggcatgcttaatgggaatggaaattttttcatttgtctttttttttctttctttaaktgtttaattgcctttgaaatatacaattaaatataattaaatggcaagaaatcttaatttgtgagaatcactttgtcaactgaggtagcttttgattttataggcatgagaagattaagaagaaggatccaaagtgtatatttgcatgtgaagagatgtcaggagaagttcggtttagtagccatttacctcaaccaaatagcctttgtaggtaagtatattttagttaaggaagtttgcctcagtttctccagagttgtaaaggagcaggagagtagttgtctgtttcaagttgcattatccagtagaactttytgtgatgatgtagaaaccttctatatttctgttggccacatgaggttattgactacttgacatgtagctagtttggctagagaacgaattttgaataaatagtaaatataaatagccacttgggactagtggctaccattttggacagcacaggtctggtggaaacaagaactgccatttaactgtttgacatatgtcctaagaaggctcttaggataatgaagtaaatgggttatttgcagaatggatttggactcatccrtcagarttgtcagtaactaacatatgtggagttttgagtagtttttgatggaaaaaagtttgtcccctgtcatttcatgaatttgaaagtaatttatgaaatggtacagacaagtgatgtgggaaagaaaatggacaacctgcaaaattacctttctaacagtataaagggaaattggaacataatgatttgattttcaccctattttgtatgttttctagtttartagtagaacccatggaaaactggctacasttgatgttgaattgggaccctcagcagagaggaggacctgttgaccttactttgaagcagccaagatgttttgtattaatggatcacattttgaatttgaaggttagtcttaatgggtctactgcataagaccagcattgaaagtaacaagtttatttggaaaattagcataaatacagtttaataatcttttcctgttgcttatttatttatttattttgagacagggtctcactctgtcacctaggctggagtgcagtggcatgtttttggctcactgcmacctgcgcctcccaggttcaagcgattctcttgcctcagcctcccgagtagttgggactaaaggtgtgcaccaccatgcccagctaatttttgtatttttagtagaggtagggtttcgctatgttgtccaggctggtctcgcactcctgacctcaggtgatctgcccgcctccacctcccaaagtgggattacaggcgtgagccattgcrtccagccctgatgcttatttgaaaaagaaaattatattcttagagctgattttttaaaaagtttatttagcaagctgtctcagtttgcttctctgtggtctttgttaattactcctttgaagcaacttttttatttaccttttcccatgttgttgccattatcctcgattcatttatgtctagtcatactggatttgatttggtaaggaaggttcctatctgcctttcatggctctgcacttactccttaacctatagttcattcaatatgtactacctatctcatcttctgaaaatgcttttttattcttctgcccaagaaactaacatagttctttttttttttttttttaacaagtcaagtgtaaactgatctgcttggttttttgggggggctttccctaaccaagttttgccttgtacctgcttctcttaacctttacctcatacaagaccagcttgtcactgctccttatgcctcaaacccgttatctacctttgtgctttgacagatgctatccttctgcctggdtatccatttctgtgtatcttctcacctacactggcatatctttaagagcttttctttaaatggtctctgccacaaaatttgtcatttaaaggctatattctctttctcgtcttccattcatgcatcttcatatagactgttgtcttcttcaatgttgggattgttttacttcttttattaacaatcacccaccctacccttcctaaccatggcattctgtacagagcagggcatgtatcaggttcttagtaaattatttattgatatgaatgagagctatagatagttctattatgcagtgtacccagaaacaactctcatcaatagtstttacatttgtattgattgtttgtagtatacaggtttctaaaattgaaatgagaaattataatcatgtaatgttggagtacatggcgagatagctcactttagtctgcaacccctgagctcaagtgattctcctgcttcagcctccagagtaaatgggactacaggtgtgcgccacctctcctgcctaatttttaaatttttggtagaaatggggtctcactgtgttgagcaggttggttttgaactcctggcctcaagtaatcctcctacctcgacttcccaaagtgctgagattacagatgtgggctactgtgcccgaccttggcatactttattaaatagaaacttgaggccatgtggatgtcattcttggctaacactgaaaagatacctggcttcttcttgatttggtttccttctaatgtgccaaagaataaattatccctcagtgtgttaggaaagcagggctttagttctgtgttgcctctgaaacatttcagctgtgaatgaaccacatctcgcatttgtttcatacttgtcataggaatcatagcatagtttctgctctgaagggcatctgtgagcctcttgttatagggcacggggaaagagtmcacattatggagtttatagtttacagactttaattcagtttgcagcaccactatttacctatctgtgaacctgagcaaatgtctctctatctcaaggacagtaatatcttcctcaaagcatcaatattattatgaggttatgcagaataaggtatgtataaggtactagttatagtagttcaagaagcttcaaggatgcttgttagacatgataataggactgaattttgaagaatgagagtttttagggaaagggtgagggcgggagagatttataggcagcagagcatcatgagcaaaagtacagaagcatgaactgcaaaacagcttggtgttactgtaggacattttcccaaaatgtttatatatattgtacaagaaaggaatgatgtctgtttgattttcacttaaaaaaggaagcaacaaaacagttactgaaatatttcccttttgaaaaaatagcttagcaagtctgattgtatgcatattttccaactgtttattatgaayatctttagatatgtagaagagttgaaagaagtgtactgaacctaccactaaaaataatgatgaaacagtagcatttaattattatttttttttgcctcctctttcacgcccctaaatgtaactatattctgagtctcttcttggttctctctttttccattacatttcctttcttttattaggcagcctcttcaactgtatagctttacttataaactacatatggctaactcctaaagttatttatctctgtagctgtgactcttctgccaaggacttataactgctgtataactgtataactacctggctgttccactggcacttacaacttaatttattaaaaactgaacatatttgttctatccattaaatctacttcttttttttttttttttttttttgatatggagcctcactctgtctcacgatctcaactcactgcaacctacacctcctgggttcaagtgattctcgtgcctcagcctcccgagtagctgggattacaggtgcctgccaccgtgtccagctaatttttatatttttggtagaaatggggtttcaccatgttggccaggctggtcttgacaccctgacctcaggtgatctgctcacctcggccttccaaagtgctgggattacaggcatgagccactgcacctggcccattaaatctacctctatagatttcctacacttcttatttgcactgtcacctttccagttacccaggtgggaaactttggatgtgttgactcttcctttctcttcaatcgatatatccaattattttatcaaatttatcttttgaatatcttaacaattttgagcttgccaggttctcaatttagaaaggcttgcatagttttctttcacttattgaataaagtccagascctttcattggtactcaaaacctatcttggtttcatatcaacttacactcctggacttatctcttactaatgccctgagaggccatcattttaggtacatttgaactggattaattgtattctctgattatgcccatccctttctacttttctgcttctgctcaccttgttttctgcctaaaggaactcttttcagtcttttcccatttcagtctttcatttcaaagtttagctcaagtagtgcctcctttatgaagtgcctgcttcctactgccaagtgtatgatactttacactgattataacacctatcacattttgcctggtaccttagttctcttagtatatcttaatatcttctgtttgactataactgtatggaaggcaaggatcataaggtactcagtttgtatacccactactaccaccacaacacacttaatagtatgtaccaatagtatgtacctaccaatagtaggtactcattaaatattatagtgagcaaaaagataaatttaggttgtatttcctcttctttcttttgcttccttctggcctggagctttggtagtgagatgccatgatgacatactctaatatcctgtgtaaaagtagatgtccattataggattttctattgctataagtggcagctgtcatagtgtgaaatctgcctaaattgggaaggcatggaaagtctcargtagtataattgtattgcaaatccgtatcagttttgaagatttccctactccccttttaaacataaagatttatattaaagaaaagtctcttaataagagaaatactggcaattgtgttatgacatttggaattcacatgaaaaggatcagcttcaggttataaaaacagtttggtatttcttttttaaaattttgttgatacaggtgtggtggctcatgcctgtaatcccagcactttgggaggtggaggcaggcagatcacttgaggtctggagttcgagaccagcctggccaacatggtgaaaccccatctctactaagaatacaaaaattagccagggatggtggtgcatgcctgtagtcccagctacacgggaggctgaggcagaagagttgcttgaacctgggaggtggaggctgcattgaaccaagatcgcaccactgcactccagcctgggtgacagagagagactctgtctcaaaaacaaacaaacaaaattgttaatacgcttttaatttttttttttttttttgagataagagtcttgttctatcacccaggctagagtaccatggtgcaatctccactcactgcaactttcacctcccagactcaagtgattctctcgtgcctcagcctcccgcgtagttggaattacaggtgtgcgccatcatggccaactaattttttgtgtgtttttagtagagacagggttttgccatgttggccaggatgttctcaaactcctgtcctcaagtgatctacctgtcttggcctcccaaagggctgggattacaggtgtgagccaccgcgcccagcctaattttttaaattgacaaataattatacaaattaatggggtaaatagtgatgtttcaatacatgcactgtgtagtgatcagattagggtaattagcatatccatcagctaaaacataatttctctgtgttgggaatattcagtatccctttcttttttctttttttttctttttcttctttctttttttttttttttgagacaaagtctcactctgtcgcctggagtgcagtggcgcgatcttggctcactgcagccttgatctcccaggttcaggcgattctcctgcctcagccttctgagtagctgggattataggcgttgtgccaccaagcccagctaatttttgtgtttttagtagagacaaggtttcaccatgttggccaggctggtcttgaactcctgaccttaagtgatctacttgtcttgtaatcccaaagtgctgggattacaggcgtgagccaccacgcccagcctcagtttagtatttctgtagcaccacttatttgggcatctgtgttaggatttgtaagtggaaataatagtgggccttcaaactaaaaagtgtacagtagaaaaaataatcaacaaaacgaaaaagcaacccaacccatggattgggaaaagatatttgcataccatacatccaataagaaattaatatcctaaatttataagaaactcatgcaactcaataccaaaaatgtaaataacccaatttaaaaatgtgcaaaggacctgaattagacacttctcaaaagaagaaattcagatggtcaacaaacatatgaaaaggtgctcaacaactcttagcatcagggcgatgcaaatcaaaaccacactaagatatcaccccccacctgttgggatggctattatccaaaagaaaaaagataagcgttagtgaggatgtgggagaaaagaaatcccttgtacactgttggtgggaatgtaaattattacagctattgtgggaaacagtacaaaggttcctcaaaattaaaaatagaactactggccgggcatggtggctcatgcctgtaatcccagcactttgggaggttgagacaggtggatcacatgaggccaggagttcgagaccagactgggcaacatgcagaaaccccatctcaactaaaattacaaaaattagctgggcatggtggtgcacatctgtaatcccagctactccgtaggctgaggcaggataattgcttgaattcaggaggtggaagttgtagtgagctgagagatcatgccactgcacatcagcctgcgtgacacagcaagactctgtctcaaaagaaaaaaaaaaaaaatagaactgtaagattcaacaatgtcatttcttggtatatatccaaaggattttaaagcaggcttgtgaagagatatttgcactcccatgttcattgcagcattattcacaatagtcaagatctggaaatagcctaaatgtcctttgacagatgaatggatagggaaaaagtggtatatatacacagtggaatagtattcaaccttaagaaaaagaaggaaattctgccatttaggacaatgtggatgaacctggaggacatgttaagtaaaataagcaagtcacagaaagagaaatactgcgtgatctcacttacatgtggaatctataatagttaaatttaatagaagcagaccatagcatcatagttgccaggggctgcagggatgcgggtgcgggggtgtatgtagagatgtttatcaaaaggtccaaaaattacggcagcaaaagaaaaaaaaggtacaaaaatgacaactatgaagaggtgacagatatattaattagctgaaatgtgataatttcacaacgtatatcaaaacatcaagttgtataactcaaatatataacatttttatatgtcaaattaaattgtcacaaaataaaatatgtaaaagataaagcaataaatcaggagagggggctatgatagatgaaacaagataggctctatgtaaatgatggttgaaactaggtgaggcattcacagggttgggagggggcttattgtactgttgtctatagttttgtgtctttgaaaacatcaattcagatttgtgttttaaagggaaaaaaataatagtggacttggattaatgccttacctttgtagtaaggattttcagcagagagaattttaatcatttgcatatactagtcaatgtaaggcatggagaatgtaggcattaatttcgtatggcttttctaaggatactggaaggaagagaatttaaaatcatgttcttttcaaaagactgaagtccaactctgtggctgtccgcgctgacaggtggggacagagccccacctgactcagcctcacactcacttggcatgtatcaggctacttttactggggctttaggtgagagtgataaaacggttcttacttgatttggggcccttaagcaggttgctgctctgggattaggttgtcttataaaaaggtaactcaccacscataacaatgctttttcctgtttaaagagagacctagttcttctatcagatgatttcttaaggcagcatgaagtagccagacacaaaaagagttaagatccaagctctaccagttattagctgtgtgatccctaacaagttatttaacttagaactctggtttctttctctgtttaaaatggagattaaaagatctaattattggggatgttatgtgaaagtggtttatgcctgtggttgtcttctgttaggcacttcatgaattggaatgtttccttttcggtctatgataatgtttttttcaaaataaataacttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaataaataaataaataaataaataaataaataaataacttgttcttttaaattgggatttttcttaattttgaaaatttcttaactttgaaattttattgttggaactaacatctattgtagaaaaggaaattgttcagttttcagaatgtcattttataattataaaaggagatctcactttggagaatgagtgagccttgtttaatgtagaaataatgccttttgcccatattcaccttttagtatctggcagcgaatcttttatgtaacaaataatcaataactttacctttttttcttatttatacagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttgtaagaaaattaattataatatccctagagtatgtgaaatctagagggattgcgtgccctgcaatttttatgcatacttggaattccttgggaggccgcacattttgttttggttttgtccttctcccaactcttatcattgctttgcaaggtgaacaggatagaaatgaaacatttgttgttttgaactttgcaagactttttctttggtgccagttttctgctcctgttcccagaccaaactgagggtcaggctgcttactctcgcggcccaataacgagatgcagatgaattgggagagatgggagtttttatttctgtaaccagttacaggtagaaggcctggaaattaccgccagaccaactcaaaattacaaagtttttccgtagtttrtttatcttctaagctatatgtctatgtgtaagtttgcattcatctaaagacataagtgattaacttcttttaatctgtagctgaggtctgagtcttgaagacattcctctggagcctcagtaaatttacttactctaaatgggtccaggtgctggggtgattacccttatcttgtctcctattaaatcacagaggtttaaggagttccttcagacccccaataaacttgtttgtggaggcctggggtttcttcagacccccaataaaacttatttaattctgaacgggtcctgttaagaattcctttgttattttgcttttaggcctgggaaaggcctgggcagaactcttggtaggctttggctacatttcagcctttgtgtaagggcactggctcttccagttttttttttttttagacagtcttgctctgttgcccaggctgaagtgcaatggcacaatctcagctcactgcaacctccgcctcctgggttcaagtgattctccctgccacagcctcccaagtagctgggattataggtgcccaccaccatgcctagctaattttttgtatctttagtagagacggggttttgccactcctgaccgacctcaggcgatctgcctacctcggcctcctgaagtgttgggattacaggcgtgagccactgcacccggccactctttcagcttttaatatttaacttcaccactcagtcgtgctgaaacagttgttatttaggcctgcattagtgagacctggcctgccacactcccagttaatattccttcttggcttggtgcagtggcccatgcctgtaatcccgggactttgggaacccaaggtgggtggattgctgagttcaagagttcgagacctgcctgagcaacatgttgaagccctgtctctacaaaaactacaaaaattagcggggtttggtggtgcacccctgtagtcctagctacttgggagattgaggtgggagaatcacttgagcccagggaggttgaggctgcaatgagccatgatcacgccgctgcactccagcatgggtgacagagcaagaccctgtctcaaaaaaaaaaatttctttttgtatttgaagcccagtactctgaaactactgtgagaacagcagtctcataggtcctgccaaaggataaatgggtggtaaaatatgactgtggtcatgactttttcccccatttttctttttatgactttattgaggcatattatcatgttagttcccatttaaggtgtacaatatagtgattttttatttcttttttattaacttgtcactgacttgatgctcaattacagtgatttttttttaaagtaaatttaccaaattttgcagctgtcaccataaatcagcttaaaaacatttccattaacagtccattaactgttaatctccattctgtccaccccaggaaaccaggaatctattttttatctccacaagtttgccttttctgaacattccatataaatggaattatgtaatatatagtcttgtgtctgactttttttacttgcyttgtatttttgaagcccgtgcatgttgtagcatgtatcagtacttcattcgttttgattaccgattagttttttcactgtatatatctttttgcatttgttctttgggttttggtgattgttcactttagcccatacaaaagtttgggtcttttttcctcaacaaaagtttggactctgttatctgtaagagatatgstaatacacattgattttgttcatttgcatttcaaagtaggaaatctggtgcataagtatttagaaaacctaggattttcaaagatccttgaacaggattttaactgtttgtttctttttcagagaggctgtgatagctatatggtttatttgtttgataaaagtaaaactgtatatgaagggccatttgcttccagaagtttatctgattgtgtaaattatattggtaagtccagtccatttagtggctgagctttaaacatgaattaatataactttgactctcagtatgattagtagaaatggacttttggtgttgtgttctgtatctcatacttgaagtttctatatggagttatatgagaactctgaaaaatggatttatatartttggaaggtgaaaaggtagatattaaatctccatgagatcattcaagagaagatttactttcttgaggatagggctctcacaggagaatgaaacttcactattagttgaacctgctttttaattgtctcttcatagtctaagcatgttcaagtatttatttcatttttcctgtgaatactgcttgatgttcaaatgttttaatttatcctgtgaaaattattcttttcttttgaacaagttaagtgtttgatcactgtatatctgtccaaataaagtaaagcacaaaattgtaaaatcaagaacaaaattgagcagaggggctaaaatgtatgtaatcttacttttttaaaagtctttttattagttttcttttgaatttttcttttaaattgaggcagtttacatagagtgaaattcacagatcatatagtttgataacttttgacaaatttagatacttgtgtaatccacaccacagtcatcatgtagaacatttctttcaccttagaaagttccctcatgtctcttttcagtcaactccccttgccccagactttattactattttactaatggactttttttttttaagaatggttttagatttgccaaaaaattgggcagatagtacagagttctcatataactcccctcactcacgcatgtagtttttcctattgttaacattttacctgggaggcggaggttgcagtgagccaatgtcacaccactgcacttcagcctgggcaacagagtgagacctttctcaaaaaaataaataaaaaacataaaatatttaaaaatattaaaaagtaaaaaaaaatctattttacattagtatgatgtatttgttacatttaatgaacccatttattattaattgaagcccatactttattcacatttccttcatttttacctaatatcctttttctgttctaagatctcatcttagaacacattacatttggttgtcatgtctctttagctcctctttgctgtgacattttgtcagacttcaaatagtccttgtttttgatgaccttgacaatgacctgaggaatactagtcaagtattttgtaagatgtccctctgctgaaatttgtctttttgtttttgtttttgttttgtttttgagatggagtttcactcttgtcgcccaggctggagtgcaatggcacaatcttggctcactgcaacccccacctcccgggtacaagcgattctcctgtctcagtctcccgagtagctgggattataggygcacaccaccacgcccagctaatttttgcatttttagtagagacagggtttcaccgtgttggccaggctgctcttgaactcctgacctcaagggatctgcccgccttggcttcccaaagtgctgggattacaggcgtgagccatcacacctggctcttgtgtgtattcttaaacctggattgttggtccagaatatgaaatttattattcagaggtaggaaagactcagaggagatgggacttgatttagaacttgaaagaaataatttggattagcagagagaaaaagagtattccaggttgcagaaaagcaagcaaaaaagacagatacaggaataatctcaagctctgtgagtgtagcgattgtgtcatttttatttccccccttgtatgtggagcggggcttaagtattgcaggtgctctgtaaatgtatattgaactgaattaaatggaaacaagtggttcttttagcatcagtttctagcatctatgggaatcctgtttgtgtggacaggaaatcacaaagaatgataaatcaactctaaaatcctcaaaagtaactaacctcccttgccctttttctcatcttcttgtatatagtacaggacagcaaaatacagcttccaattatacagctgcgtaaagtgtgggctgaagcagtgcactatgtgtctggactaaaagaagactatagcaggctctttcagggrcaaagggcagcaatgtaagtggattctgttgtttataagcacaatgcaatgtgcatcatatactcaagaattaatcttgccggttttcactaatcaatattgcatgtaatagtaacatactgggccaatttgaagtgtaatgttctgataaacttgtagaattcttactaatggactgagaccattctattgtaatggcttgagggtaataattcccatacggtcctagtataaaaagattgtttatcacaaaatattataggcaggaagtctttagagatcagattctagagctcagttatttctcatagattgataatagaaacttaggctttggccttgtggcagtttatgtttttacattattgttcaatgtttctgaatgctgataatatcttttttctttttcttttttttcttgctgtggtttaggttaagtcttcttagatataatgctaacttaacaaaaatgaagaacactttgatctcagcatcacaacaactgaaagctaaattggagttttttcacaaaagyattcagcttgacttggagagatacagcgagcagatgacgtatggratatgtaagtgtctgtgtaatgtatttgaaaggagcatctggtttcttgaagccatctgttattttgccttcttaactcagccagttgttttacttaccttcacattagaacaagagacaggacaacttaaattaacataaaccatgtttgttttgaatgttacctctttttttaaatttgcttagttgagcaatttagcttcacaattgggctaaaattatttagctctaaaaaaatacaggtgcgatttaataatcttgaatttcaaacctgattttaaaataaatacaaaatctggacttcttagccagtgctgtggactgaatgtatcccccccaaaatacatatgttgaaattctgaccctgaaggtgaaggtgttggtaggtggagcctttgggaagtgattaggtcatgagagtagagccttcctgtttgggattaatgctcttacaaaagagacctgaatgagatccctcatcccttctgcatgtgaggacagagcaagaagatggtcatctaggaaccagaaagcaggccctcaaatctrccttgttcttggacttcccagcctccagaactataagaaataaatttctgttgtttttatggcacttagtctatggtattttgttatagtagtccaaatggactaagacaaccaggggagtcttaaactgcttacttttctgtaaataatgacacaaatattctaaggctatgtttttttcaaaccatctactgtggagtcctactattttttagtgtacacagtctccaaattttccatatttgactccaagcttatctccttcagatgtactaaggaagtgtaaaaaaacagagttaaaatatgagtaaattgaaggagtcatactaccagcatttctgttttcttttataaaacaaatcctttttaggaaacaaatacttgtttcctaaaaacatatacttgtcctgagcaaactmtgtgtatctcagagtaaacaatcaatagtgtccagttgggtgaatgaatttactctccagaactggttttattaatattattgatattttatttctatttatatattattgatattttatttctatttgtatattattgacattctggtgagtgataaaacattataattatttcattaaaatatcttagacttgtcaaaggcttattatacaattgttaaagaaaaatgaggtagatctatatgtgcttttattaaaagatcacctaagtctttagttgacagttttaaattgtgggaaaaaataaagagtatacagatgttttcacttgtgagggagcaggctatgtgtctatgtaacagataatcatagtaaggtcccttgaggtggatggtagaggggtagaagagagagtcttttctgtttatatccttttatagtatttaatttttaaaaatcatattcaagtattaaatttcttttctggccaggtggtgactcacgcctgtaatcccaacactttgggaggccaaagcaggtggatcccttgagctcaggaattcaagactaacctgggcaacatggggtagaacgccatctctacaaaaaatgtaaaaattagccgggcatggtggtgcacacctcagctattcaggaggctaaggtgggaggatcgcttgagccctggagatagaggttgcggtgagctgagatcatgccactgcactccagcctgggtgacagagtgagactctacctcaaaaaaaaawtttttttgttgttttttcctttatccacccatctgcacactggtataaatatatatatttttaagaaaaaagtcatctgtattcatttcctaagggttccataacaaaatcccataaactgagtggcttaagcaatggaaacttactgtctcacagccctggaggctaaaagtccaaaattgaggtgttggcagggccatgttttctctgaaatctgtagagaagaatctttccttgtttctctctagcttcttatggtctgctagccatcattggcattccttggcttacagctgcagcacctcaatctgtctccattgtcacagagcattctcccctgtgtatctgtatcctgtgtctcttctaagtacactggtcgtactggactaagggcccagaccattccagtatgagtattaatttatctgattacttctgtaatgaccttatttccaaataggtcacattctgaggtattaggggttaggaattccacatatcttttgggggaccacaattcaactcataacacatctttgatgttgatatggcaaggaggcaggcagccagtaattaaagatatggctatttctgagataaccaatttagacttttcttttagcttcagaaaaaatgctaaaagcatggaaagaaatggaagaaaaggccatccactatgctgaggtaaaatcattgacgtcattctgtatacttattaattcttgatgtctccattagaaactatctttggttttgatatataaagagcatttttcatgtcattcctgaaattcagacaaaattctagtagatgctttgtatataaagagggatgtatcatagtgattaaaaacaagggctttgggaaaattacctagtgcctcactgagcttcagtttcctttatttatttattttttgaaacagggtctcactctgttgcccaggttggagtgtagtggcatgatcaaagctcactgcagcctcgacttcccaggctcaagcagtcctcccatcttagcctcctgtgtagctgggacaagaggtgcaccaccatgcctggctaacttttacattttttgtagagacggggtctcactatgttgtccaggcttgtatcaaactcctgggcttaagcaatcctcccacctcagcctcccatagagctgggattataggcatgagccaccacatccagctagtttccatattatagggacaatttcttttctagtagggttatgaagattaaatgggagtcagtaatggtagttgtcactattatttttgtgactggtttagataggatggctgcacatcctggtttacctgggactgtcccagtttatacttaatgtcttgccataattatcagtagtagtccctttcactctcaaaattatgccggtttggacaataaattatatggtgtccctaggtatagctcattctctaggtggcagattttttccccttatcctgtacatttgtccacggtcctaagttattacactccttaatgtcagtacttaccctgaggatgtgggtggggatacccatggtrtcctggggtgggaaatccaagttctttatctttttgtgtccctattcaaggtagtggggaccagggggcagtcaaaatcatagagccaagatacaagtaataccaatggttttggtggtcctttttctttcttgttagttgatacctgttgtagctttttgcttctccggaggtaaaagcaaatactagtagtttactgttgtcaggagagaaaagagagaagactaagactaagtatgttcttatgtgaaagattaagtgtcagaatctgaagaatagaaaggctttaacaaaatcagtgtttcgtattatattatttagttctctaatgaagcagcaagtcattctgtatccttaagatctgaattttgtttcctatgatgtagtggtaagcctttcatttcctttgtattttcatcatattttaggttggtgtcattggatacctggaggatcagattatgtctttgcatgctgaaatcatggagctacagaagagcccctatggaagacgtcagggagacttgatggaatctctgtaaggatgcacttgtgttgttggtcttgacatctgtaatattttgtattctttctgcttacatctggcaaattaaacctctagtggttcttttctatagttttcctttccccaaatatattggcattatatttaaaatggaagctttttctcagtcacaggaaacttcggaaataattctttgggttggccttttttggtttttaataaaagcatttatttcataggagtgttaagaattttccaagtataactaagttacaaactatttccctactcattatayctctggtccaaggtattgactcttaaatgccctaaaacttgaaattttttctgaattaaagttctggattaaaaacttcagatattttctcgaattataggtcataatttttgtctttttaagtgtctgtggtgcagagatgtccccatgatagatcagaatagatatgaactatattaaactttgcattttaagaacttgtatagttcttattactcaatacaatgctctgtgaaatacttgttggcaatatgaacttgctttaaaatgggttcattattcaaataaaatattgtttcaagttgtagattaytgaagtcattaaattaccttcacttatcagagcgtgttttctcttttatagggaacagcgtgccattgatctatataagcagttaaaacacagaccttcaggtaagacacttctaccacagtgcttgaaggcattttaggtaactatcactagcctaacaaatgtgggggatctaatatttttaagttaaaaattttcttaaagctgcagaataaattccagttttggtattgccattgagacatggtataataagctttaagattgtgagaatttaggagatgataaagagaaagtaacagagaacgtgaggtagaaaaattttagaaggggacgtgaaaagaaagaatggaagacagaaaaaaggaactcagagaggaaaaagcagcaagaaaatgtttagaaagatggaaaaaataagtgttgcttaagattagagaggttgggccagttgtggtggctcatgcctgtaatcccagcactttgggaggccaaggtgggtggatcacctgaggtcaggagttcaaaaccagcttggccaacatggtgaaaccccatctctactaaaaatagaaaagttagctgggcatgttggcatgtgcctgtaatcccagctacttgggaggatgaggcaggagaatcgcttgaacctgggaagaggaggttgcagtgagccaagatcacaccactgcactccagcctgggtgacagagcgagattctgtctcaaaacaaaacaaaaaaatattatagaggttggaaagaatttgaggcagtgggttcaggtatggaatggttagagggaaggcctgtgctgttctaggccaaagcagattgctttgaaaataatgccttcatctgcactggtcactgatgacttgttttgttggcaaaataattccagttgaacatctgctaaatactgagcaaggtctgctggaaagagtactggatggggaatcagaggcttgaattctagattgagtaatttactgaccgttacctcaggcaaatctgcgtttcccatttcctycttctgcaaaatggggttgaaacctarctttcctactcagtgagtatattgtgacagtgtatttaagaggatgtttgtgaaaatgctttgaaaactataaactattatgtacttgcaagatattatcatttagttaaaaatttgttttgaagggtaacagaagaaataaagtctgtgccctaatgtgcattatacttaaatgcatgttaaaaaaagatatacttttacactttaaaatttgtagacacatagcaacacatgcaaattaatayacatgtgaaattgtatttcatatactattttcacatttaaaaaataacattatctcctcttatactgcttttattttactgaaatgtattcagtttagtctgaccagcagttctcaaaatgtggcatatggacctgtgagaatccttgaaactttgtcagagagtctgtgaggttagaaccattttcataataagatgttatttgcatttttcaccatgttgacattttcattgatggtgcaacataaaatggctttcaccttagtatgaatcaaggcactagcgccaaactrtgctagtagccgttatattttttaccaccatgcagtcacagtttttaaaaaatgacagtttcacttacaaatgtccttgataaagcagtaaaaatattattttatttaaatctcaacgcttgagtatgggtttttaatattttgtgtgatgaaatgggaagtactcataaagtgtttcttctatacagtgaagtatgatggttgtcttaaggaaaaccacttcagtaattgtttacgttgctagttgtctggcctctttcagggaagataccatttttacttggaagagcaactgtcaggcaaactatgattattcagatttgcatacgtgagataatttctaagaaattaaatgaaaataaaaagtatagcacacttattactttaagggaaaaaagcagtatttgttgtcaatgataaaattccatgtttcaagcaaaaagaattttagaaaacttgtatttaccagctggaatgacagcttctcagtacttaaaaacttttctgatgagattagtggtgatatcagaaaggtttgcaaaaatgtaaaacagtgcaagtgttctcactcaaatttttttgttttagaaaatatcgttttttggtttttgtttttagaggtgggctcttgctatgttgaccaggctggccttggactccctgggttcaagtgatccttccacttcaggcttccaagtatctcaagtagcagtaaccagtgaaaggaggtggctctcgtagatatgagtatactgtgtagacacatgtatgtatagcacttagcatgtctgaggaaatgcagtatgactggagtgtagagtttcaggagagagaaaacctaaatataggagagagagaaaacstaaatataggtttttttgtttgtttttaataaaaacatgttaatgggcaataggtttgttatttttaaatgaattaagacacgagtatttttaaatttctgtttaattcctgaaaaaccctttggggttctcaagaattttctagtgtaaaggkgtcctgagaccaaaaagtttgagaactgcttatctagactattctcagaagcttggctgctcaggaaagaagagaggtgggtgagtagctaaaagttgatgtagagtcaagggaggtcacttctcagaaggaagacttaaacatgaggtgccacatgatgatgttttggttaacaacaaattgtgtatactatggtagtcccataagattatactactrtatttttactatgtattttctatgtttacatgcacaaatacttaccattgtgttacagttgcctacagtattcagtacagtcacttgctgaacaggtatgtagcctattgtcaaaaggctataccatacagcttaagtgtatagcaggctgtaccatcagggtttgtataagtattcacacagtgacgaaagtgcccaatgatgcacttctcagaacatatgctcagggccaaaaaagcctgtggagagggaggtccctgaacaagttgagagattggctccaaagaacagtaggagggattagccttgatactattgatattggaaagagaatgagtgtggatacagatacttttttgggagtagaggttggaagatcagggtcttactgccttatggcctcttatcctgcagtggtaagtgaggttaactgaaatggaagaggtgacgacctcatagatttgaatagagtgctaaagacttctaaaagccactgtgtgcagtggaagatgttgttgacccaaaacattcattaagaatccaggccaggtggctcatacctgtgatactagcgctttgggaggctgagacaggaggatcgtttgaggccaacagtttgagaccagtctgggcaacatagtgagaccctgtctctacaaaaaaataaatcaataaaatttttaaaaagctgggtgtggtagtgtatgcctgtagtcccagctactcaggaggctgaagtagcaggatcgcttgaggcccaggaggtcgaggctgcagtgagccaagattacactactgcacttcagcctgggttgacagagcaagactttcttaaaaaaaaaaaaaaaaaaaacccagagcagaaatgaaaaacctgtgaattagcagtgacaaatagtgaacagtaatattaattttttgttgataatttagtagcttggatacaggaactgatagagcagatggttggattaatccaaggttaggattttgctgatggaataagaggataaaaaggttgaagatgttaacaaatagtgatttaagtgatagaagttgtagctagagtaaaatattaaaatctaagatttcaaatrgagcaagtccaattctttttctttaatcaatatttctgggccaggcgtcgtggcacatgcctgtaatcccagccactttggaggctgaggcaggagaattgcttgaaccagggaggcagaggttgcagtgaaccaagactgtgccactgcactctagcctgggtgacagagctagactccatttcaaaaaaaaaattctgactcccagttttctggctaatgaatcagataccacagatacacagtgatagcatttgtttaggttatattttttaaaactttgaggyagccctgtcaacataccatgaagctcagaaataaactgctacccaggtagcttctttgagtgtcaccttgagtgacaaactgtaacaagattgtgtctgtcattggggcctattatataatcacacttgatttgtggcctctattgtcttttctagcttagagttgacttgaatctcttgttcatctgaaatggttaaaaccagctttcttcattatcctggagaaggctaaagttctgagggctttcactgtcttaaggagctagttatatgagaaagctcttggcttggtccatggtatttaggaaggaatgctgtttggagaagaacctttttggagccttgcatttgattgttggtgaggaggagacaacagagatgtgtggggaataaagttgggctatgggggaagtatttggagtgatagataacaaaggacacaacgttttttaaacctcctttgatgctcatcatttcctttttggtaaaatgggggtaacaaaagtagtcttctcacatgactgctgtgaggattaaatgggaaaattataagcagagagtagcaaatattattattattgcatttaggcttaattattgtccaaagaawataccagcatgatgcataagcaactttcaactcctttagccattttctgaaatataacaattaatgatttttttttaaaatcgaggtcacattttaaactgtagaacccattgtgaccaacagccatcccatttgagggtatctggctgctgccagttggctttaagatgtcatactgccctcaaatggaactttcaggatgtctacaggtccctttactagttggtttcaatgagcttttttcaaagtttttctgggttgtaaacagacggataaacatgaaattccaagcaacctagttcaagggcctccttcctttaggtaatgaaagtttgatgaattgtcctactgtttctaaatatgtggttartcatccaagaaaaattgttcccttggccagaggctgcatttgtgtctagggcttgggttagtatgggttaaagatagccaagactattgttctcaagcacaggcaactaaggtctcttactgataaatttatatatacattatacacctgcaaactttattttttatatataactagattttatttataggtaatctttatatcttttatcttaacccaatttttaatttaaatggagatgtttattaattaaaattagtttcagagtttcagggatttttgagraattttttgttyggaggctgatatgttacagaagaaaggttatatccactgactgatgtcttttatagatcactcctacagtgacagcacagagatggtgaaaatcattgtgcacactgtgcagagtcaggaccgtgtgctcaaggagctgtttggtcatttgaggtaggaaaattgcttcatttcctactgaaaaaccaggatacgtttatcttgttcctctcaaagtacaaaagccctctttggtaaagtatacttacccaggaagaattctgaaggtaccttgggtagcttggccatagctatctgcatttatgtgtccttttgtatgcattactttggagataagtcattaaatctgatgctgattgtggttcatttcctcmgctgggttttgggaatatggtgtacagtcttggggcatgtgaaagtgtctgacactgatttaatctctccagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtgtaagtaattattaatgaattatttaatgtgacatkgagttgctattattccttgcaaaggggatttttatcagcatgaggtgggccctcttgaagacatgtatattttgcattgggatgacatccatgttccttgcttggtgtccagactagcaattgagatgcaggacttattatcatctctcctttccaatttctctgttgttatactcctcttagcccttgactactgtggtattccaacctaacttggggatagatgtacctgcctagataatgaaattgaccatctattcaactgggttttttttttctttcttcaactaaaatggtataagatgagtggatatatttggttttagtcaatgaagaaagggtccaaggacaggttactaatggtgtgtaaaggtgggaayagttttgtactgaaatactctggttgtgcatataagtagtaacrgaaatgtaagtcttaggaatatgataagaaattgtgtgaatcaacagagatgcttgcctgtaatcttttgatgtttttttcttttccttcagacacagagttctgcccggtcccttgtaggatccagtctagaaggtgcagtaacccctcagacatcagcatggctgcccccgacttcagcagaacatgatcattctctgtcatgtgtggtaactcctcaagatgggtgggtttactttgtaacaatagatagctgtgttttcatagcagtggtataggaatgaggcagtagttgttaaggtagtcttctgtgccttcagaccagggttgagtcctgactatccctttgtaataatcttaggcaacttacttgacttttttgatgttcatatttcctcacctgtaaaacaggaatgtctcatagaactgctgtggaaatttgattagacaatgtatataaagtgcttgggaaataaatgttcagcaaatgttgcgtattattagctcaaatgttgcttattattagctaagtccaagttctaagtcctttcttttattggcttattactttcttttactcaaaccttactccttcattaacagtttatgagaaattatgctatcattttgcatttatcattttggggatccttgattacccttctaataaatttttgagatctattttataactttgtatttctaagattagacttttttcagtgttttaaatcagttttgcaagaactcagattccaagccctrtattttattaattcctactcttttgctaaaagctgaatgactatccatttctgttattttctcagcttaagatgtgccgtatccaaagccagtggctctttgctagcttgtgtattgtcgcttttctcacaactcatggagacctctacagcaccagcatttcctggaagctctgcccataattagttttgcagaagtgcagccatgttacatcactgctcaggaggtcatgcagttgcacattctgtactctacttttatgagagaaaagcacatggcaggaaggcaagctgatatcaggtattttatttttttaaagaaagcaagttccagggtatatatcttggggtcattatacatgtggcccaatgcagtacacctacaactgtagcacaggctataattaaatatatagactttacaaaatactccagtaatcagagttgaaggaagtaaaatttaatactttacttacttttttgcctttattaaaggcatttaagttttttagcggatgttaatgtttacaratgtcaccacaatacaggtaatttccaatttgaagtgtagttgcttgcaaaagtatatctgacagacattttcaatgtattttctagaaggaacacattatattttgttttgagacggagtctcattctgtcgcccaggctggagtgcagtggcacagtcttggctcattgcaacctccgcctcccagattcaagcagttctcctgcttcagcttcccgagtagctgggatttcaggtgcgtgccaccatacctggctaatttttgtattttagtaaagacggagtttcaccatgttggccaggctggtctcgaactcctgacctcaagtaatccacctgcctcggcctccaaaagtgctggaattacaggcatgagccaccatgtccagccagaatacattgtataagaaaattgatttcaattataatgtacctgtggtacttaactaccaaggattgggaaccgtttgaccataatttttccatctgttggataagagctgaatcagaatgtcattctaagctaatagtggctatcatccatgacctaaaacggactcttgttaggggactgaagattggcaaagggagaagctagaggccatatagaagaggaaagcatgaaggtagaaaccacaatcaggactgccttcaaatatgaacttccagggatacttcttggttctgggtagctcccccaccacactgttttcttttgctgtcctcaggaatcagcttgcttgtttcgtttcattgctatcatctgtagtttctaatgagtttttcactttctgtgatctctacagaacagattttacttttctctcttctcccctacatttgtgtctgtgaagtatgcatgctggtgtttttactacttttaaggaaagagaagtatttagaaacaaaaacgtatttcatctgtctttgccacaaggattttttcctccctagttacattttcacgggaaaaacaagttgtacataagtgcatcttacatttcagaggaaagtcagactggagttatagtggacttcttatcattagttaggtagaggtagaggcagcagcctggtcttaacaggactctgcctctgtagggagggatgaggaaactaaagactacaggagtcaactgcactggggtactgggttacaggaaggctagtgatcttgctaacctagaagactagaaagtagaggaaattcatatgcccttttcctgagtttgaaaaggctttgttctttcatctcacagggagacttcagcacaaatgatagaagaaaatttgaactgccttggccatttaagcactattattcatgaggcaaatgaggaacagggcaatagtatgatggtaagttttgtgtggatatgggtgcctgctttggctatgttgggtgcaaaaggtttaactttccatgctagccttatctggcatttgggatgcatatgggaaatagaagaactcaagaggaaagagcatttggggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaactactgatttgttaaaacttgaggaaattaccataaaatgtctactgaatcaatttttcctgcatttagtcttaatgtcaattctgtayatttcctctttcattaagaaaaatagcagtggccaggcatggtggctcacgcctgtaatcctagcactttgggaggccaaggcaggtggattgcttgagcccaggagtttgagactagcctggccaacatgggaaaccctgtctttataaaaaatataaaaattggccaggtgtggtggcacacacctgtggtcccagctacttgggaggctgaggcaggaagatcgcttgagttcaagagtttcaggctgcagtgagccgtaatcctgccattgcactccagcctgtgacagagtgagactttgtctcggggaaaaaaaaaaaaaaaaaggataatggtggccagccatatgacatgtacctgtagtccgagttactagggaggctgaggcagaaggattgcatgagcccaggagttcaaggctgcagtgcattatgattggacttgtgaatagccactgtactccagcttggcaacatagcaagatcctgctctcttaagaaaaaaaaaaaaaaagaaaagaaaaggaaagaataattgtttacttcaaatatttatgaaaaaaactctgaaatttttttaaatcaggaaataaggtaaatgaaatgatttttcaacttttgattatgaaatgtccaaacagaaaacttgcaaaaatgaacacccatatacttataacttatagtcaacatctaattgtaactttttcatgcctggttttagaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatmttagttggctttcataaatcatgttgktgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacakactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattactttcttgatctctattcattataaaaatcagattataataaaacagttgaatatggcttaggaaaatatgaaggttccatgaagtggaattaagagcatagaataactgtactttccttaggaataataggacttatggtaaaggtagtattgggcaacttctttaagagtgttttcctctgaaatgtcctatcaccactatctacatctaaaaaacatgctcgattcttgccctataaactgatgtcacagccccaccatccccatttttgctagtggtatcattttcctagtcaaccaaattttttagtcatcacatatcactgttcgtcatctattataataggcagtctctctcttgtttccctggttttagaagattttagtaataaacatttattgggtacctgttacttggagggtattaagctagatggcaagatctgaaacaacataggcagtatagtaaaagtgcttatctgggagtctgaacattacaagccatccaagcattgcaattattgttaaggattattttcaatggtcatgcattttctaatattttaataattggttaaagatttgttatagcgtgggggccgctgctggtgtgtggctggggttatgtcagggcagcctgatctatataatttgggcagatggtgtgagtcagaacagactattatagtgggatccccaaacttgcttttgatgcatgagttggaccactattttttggtgggtaacaacttttcagaggggaatggcagttgtgaattgtatacatttcattctttaagcaatattatgaaaaacttcagagaatgtctacagaaaacagggtatggagcaagttattttccattctttttgctttttggaagttaaaatagctaagctctgcaaatatcatttatttggaacagataaggtcccagacattcctagataataaaaatcaaatgaatgatacaggtaagtgtatttattgaagggtgtgggtagagtggtctgggaagtcttgctttaatgaagacggattgattctatttacctcttcttacttccactactaagtaaccctgggcctgcagtttcctaaccacttgacttccttgccaacagtctgtctccactttcagccgttttatagattcattggccctaaagcactgctttcccatacttccctacccaagagggcaggggtccccaagccctgggccgcggaccggaaccagacagtggcctgttaggaaccaagccggatagcaggaggtgagcggcgggcgagtgagcattatcgccttgagctctgcctgctgtcagattagcgagtggcatcagattctcataggcacgcgaaccctattgtgaactgcacatgtgaggtttgccggctccctgtgagaatctaatgcctgatgatctgaagtggaacagtttcatccccaacccacacacacccccaccccgtccgctgggttagaggactttacaaccctagtccaccttgtccagttatagttccacctctagcctttcaaggcttaaaccattaatgtccttaatttctcttgtattcatctatctcccaactatacctttttccttcccttttttatttttggcaatatgtgcccatggttttttaatttaaaacgaacagaatatgtagtgacgcctaccatagcactccttcccatcacacaagccttcaaggaaactgaagtacttactttggtctccctggaggattccctccgcctcccgccccatgtgcttagcaattctgttcctgtagtctggatggccttcataaagccctcactggaccagcattctggcacataataggaacacttaaaaaacgagagaatgatgccgttatatctaatatcttcctcttctgaactttcacagcactttatttgcaacaagtttagttgctcctgaagggcaggatctctgccggaagcaagtgcgtgccacacagtggggctccgcatacactgcaaaaggacaaataaaccgaacagctaccgtttgagagtgagcgagtgggttctctgcacaagaacaaaccaaccagtcccttgtccgaaagggcgtctccttttctctgcttcgctgctcactccagactgcgggctgtcctcttccgaagcagttaaccagcagtgtacagaaagcgacttgcctccaaaggagcctgcgcggcccgcggctaggagaattttgtcccatgcgctccccgtctcactagccgcgggccggggctacgccgtgtgcgtccccgcgcagccgcagtgctgggcgagtgggcggggccggctgttggcggcggttggctcggcgcgggagtcggctgcacgtgcgggcgggggcgatgcgtcactgatcggtgaggcgcggccgaggggtcggctttcctcgcgagcctgcggctgggcttcttctcagttagtgccttccacccgggagcgacccttgggagagggagtttcaggaagctcaccgagcaggggcggcccactggcctccgggggcggaggagttggcaaggggtcagcgggctcagccagaagggaagaatgaggggacaggggtactggactccccggctcagcctgcgagagagcgccaagtttccggagggagagggtagaaactggagggggtggacctgtcactcacgggactgagggtccttttctcccgctcccaggaggaacgagaatgaatatgactcaagcccgggttctggtggctgcagtggtggggttggtggctgtcctgctctacgcctccatccacaagattgaggagggccatctggctgtgtactacaggtgagcggcatgtgcagtcagttagggctctagagcagattaaaagggtactccagagtggagtctgggaagttgttccctctgcaacgttcgggggcgcatgtcccatctctagggagagcacgggggtcgaagcgggcttttgcggagcaccctccagatgttggacagttttagtgctatgttcgttttgttgcagagattaagtctccctacggttattcctatacacagcaaactcaattatttgtagaaaaatgaagaaggaagaaaggaagtagtcactctacctctaactgaagagatggataaattatagttcgttcaactgtacaggctttagtttgccgctgtagatgctgtatgtttatggttgtttcttagactttttcatttaaaagcttccagtgtctggttacgtcttgtaacaccatgatgactgtgatggtgcttatgtccctggacctccagggacataagcacaacactgatgggccatgctcctccctccttactgttgctgttcaagttggggacaggagtggtgtgggagctgttgctctcttgttgagctcgcttagcttttccttcagcctaattaccacaagttccttttgatacagactagtaagagaggccagtttgtggagaaattgggataatggtgtattcaaaaagagcgtcaactttttgcttgtttccactatccctcaaaactgatatttctactttcaaatccatcctgaatcctagaaaaagagcaattttaatggtatatcttagcagatggagctctacataagaaattacagattagtccagatttccttccagtttaaaagcattgtctttctgacagtaaaaccagagaaaggacatttcaaggaatgactcaaagaattagtaatgaacctcaaacagttcatctttccttgttattatgaccttgcaaatgtgtttatattttcaagaccggtagctaagttctatgaatttacaaggtgcaaaataggactttgttttctttgctccccaaatgcctcctttttataatttccagggcttgctttcatagttttcacattccaggatttggttaacaagcccttatgctatttatttgtatagtcttgtcacccttcatcttttcatgctaattttttgtttttatatagaaattttatgttcccagtattttaattaccttgtagatagatcgaaagaattataagcctcagaaattttctctttacttcaaagtttgcattgtctttttttcaacctggtgattaaatgtattatatattttgatttggctcttgttatgtactattaatgtacctctactgaaagccattagaattttttaaacaaatatttctcagaaggttaaagaccgaggagaatcctttgaaccttagagcagtgctggagacccagaggtacggttggttgagcttatgaaacaaggtgtaacattggcagtttaatttgatctttttccctttttaggtgtggaggtattttaagcagttgttcattatgagcaattcatattagtgaggctttagtaggtcagcagcatgagcaagagtgagtatttattatagcattttagatttggaaagataatttttctttttataattttgtcaaattgaaacatctttttgcaggggaggagctttactaactagccccagtggaccaggctatcatatcatgttgcctttcattactacgttcagatctgtgcaggtgagtgattcctaggggaagcctccataccagatagacaggcatgacaggagttaccacacttgtgggtggagatagatttccttattgcttaagcagatggtggtatttacttaaatgcagaagttaacgttcagagtacagttgttacaacacaagttatgatgttaaaccacctcacttacttgaaatgaattaaaggtatgaaccaggaagcttggaaggactgacttctaccatctatatcgtggtatatagcaaattttctgttgctgctgtcacaataaaagtaagaattagaaacacaactagacatacaaaccagtgattatgtggtttagaacagtgtttagtttccatagaggcaggctcctgggctactgttaacatggaggatcaaaatttttatacacagcctttctgcctcatgtttttttgcctggtatattaagcacaattttatgtggaaccttagtgaatgttatattttgatggcatcccgggatatttgaaataagtgtctaatcctcgaaaagtgtcttggccatgggagacaataaaataagtatctttcaatgtaacaagatgacaaaaccaggattaggctgtgaccactttcgcaagcccagtgtgatcataaatctttggattcagaagtttgtctgccatctgctgctaatttttcaggactcaggaaaattctgtgttatttaatcttgtaatcttatgtctaggcttcctgctaagtgagagtttaattataaattcttaaatcccctaggttttcttcctgtccccttttagatggcttagggaaagaattgtgtctactgaagtgaaatgtattcttcccctaatcagactgatttccatatgttgttccatatttattttacccattctttccttagttcatgccatcacttctttatctgccatctcactctccattccttctctcctgtctaaatcttgccaggcttttaaaggctcatcccagattcttcctcttctgatctatagctcttaaagtctatattgtaaattttggccctttgtcttattttctttaatattgttgtcttgcattgtttgctaagtttttttatgtgttttctttccagaaaggctccagttttcttaaaggcaggagttgtaacacatttatatttctggctttctatttatggtggaagttgttaaattgagctgatttctcaggaagcaatgtggtgtaatgaacatggggacccagcgttaccgccagttggtggcatgactttggaaaaattgcttaactgtcatagacttcagttagtcttctgtgaaaggaggaattttaattacataacctcatcaacagccgaaacaatctataataatgttagcaatggcagcattagacccttaaaaatcaagactctaaggcccggcgcagtggctcatgcctgtaatccgagcact

SEQ ID NO: 17633 - DNA, 86081 bp, Homo sapiens
gtgaagttcctgccaccttgggggcccctgtgtgagaagctggcaggcctcccgagtggcacgggcagcacaagcatgccagaggaggctgtggccacctcccttccggcccggcgcccctctcagactgccaggggattaaaggccttttggcctttgtgtcgggctctgagcccctggcagtttgtacaacaaagtgctgccccgacagattccttcctgtgtgctgtctgtcgcctgtggacagggcactgggtggcctgggggtggggcagggcaccttgatcctgtgtctggggcctgggttgcagccgagtaggggaagcacttgttttggggttacctaggagcctgcatcctggcagagggggatggggaccttgtctgggttcatgtccctccccagagatttggggaccatgggtcacattgtctgctggttccttggcagtgggcaggggaaggggcactgaggcagagcctgtggtgaccgtggcagggaggcaggtgggcaggcaggagctcttttgtccccccgcccctgcactgtctctggattttgatggggtgagctcactccatccccacatgcctggagcctggccctgggcagctgcagccgccctggggactgtgcagtgctcagaccttcctgcctagctgcgggggcagtcgggggctcagtcccaggcttgggctacaaggagggtggggtggactggctgctgaaggcatgtgaacaatgtgtctggagaagcccaaagccctgggttggtcccagagtcagcctctgagcaggcagacaactttgagccataggacccaattctattgcccaccccttgctagggtcctgcccactcagccaggctcctcccttcatcccagatctggaggcgaccccaggcctgagcccacacctcacactccgcatgcatcacccctcaaccacacctacccctcacccctaccatgcaccctctgcatgatactaatcctaatgcttattaagcacttactgtataagtaattctagtgcttattaagcacttactgtataagtaaacgcctcactaagtgccttacctgcttgatcccatttacccagccgattctctctgagcctcagtttcttcatccagaaaacggaaataataataacacaagctcacagtttcttgaccgaaagcctcagagtcagatgtgttctggaattcagaatttttcaagtttgagaaggtgacatagagcatgtgcccagccggcatgtgacatccccattggagtctgggggtcacaccccatgatcaaacaacggtaatattgctacagtgaaacacaggactcttccctctgagtggagtgaacacactctgaatagcttcatgtcggttcagttcagggcttggcacccaatgagcttgctataaacttttttttttaacagagtcttgctctgtcgcccaggctggagtacagtggtgcaatctcggttcactgcaacctccgcctcctgggttcaagcaattctcctacctcagcctcccgagtagttgggactataggcatgcaccaccgcgctgggctaatttttgtatttttagtagagatggggtttcaccctgtaggccaggctggtctcgaacttctggcctcaagtgatctgtacctgctctccgtatctgtacctctccctccttctctccattctgtgccccactcctgtrgttttctcctccgttcttagtcctttcctaggcagccttgtctgcctctttatcctcacccaggccaggagaggaggatccagcctgcattcattgtccctaatgacacaacttggacctggagttccatgtgaccctcgttctcaccaggagggcctggacatagcccacctctgggattgggtgcctcccagaagccctcgcccacagtcctgccagtgttcaaggaatgcctgcccactgggggtcaccctgcctgcatcccagccccaagcaattgttctcagcctgttagaacaattctctggcctgggcccggttgagtcagctgcctgcacaccgccaaaccaggaactgcagggtctggaaaatccccctctctgcttagctccttcctctctggccgaggtctgacccctagacccctcctctccagctgcccgtctggctccaacacatgcctgaagtgctgggttcctctgggaggaagccgggctccctcrccgccggagaygggctggagggcaggaaacctgggttctatttctgaccttggagctgctaatggccctccttgggacctgaggcacatgctgcacagtcccaggccactgccagctcaggcatcccatggggccattctgagagctggtcaggttggggacagggactggccaaccctgggctccctggtattgctctctgcttaggcctcatggccagcccagaggtccagccctgcctcatttcctggtgagcagaaggcttggggtgggatgccagctcctcacctgtggtctgggcagacacgtctcccggggctcactggggaaggggagcattcatacctcctcagcctcctccaagggtcactgtcaactcaggtgatactaggctgaggaaatgcattgcaaagtggcatgcagtgtggctgagaggctttgcaagagtgactcccagtgatctcatatctgcttcattgcatacccctggtcacagaggtgatatagcacagtggtagctgcttaggtattggagcccgaccaccagggttcaaatctcagccctgccacatgccagtttccacgggtaacctgactttctctgctctctttgccccctttctcagtggagccccataagacctataacctggtttaggagtgcctggtgcatagtaagtgctcaataaatgttagctgttattattcttcaagcagatcctggtctttccctttctgggtccaaggtccttctatggtcaagtcccaagttccttttggctctttctgggagcctctttcctgtctggttccatctgctctcccagatgtgaaatacagagctgctggaaccttttgatcttcagctttttacaaatgaagtctctgctcttgctgacttattccttgctatgggcccttatctgaccctggatcctcagaccctagggtgggggctgcaagcaacagcagactggcagatggagggacccgtgctctggagtcctctggtggagtgtggggcacttctgtccaagtcccgacgtgctctggcctctctttcccctctccctgcagatgtgtgttcctggctttctttccatgttgaatctcactttgctatttcctgtctggtcccaaggccacccccgccgccacccgctgaccagctccctgctccctgggaaaagctctggaccttgctcatcattcaccgctaggttttcctttccagacggcagtgtctaggagatgctgggagtcgcagtgctccaggcatgccctccataaccttggttgcaatgagagggggattggcattgacagagccccccaccaggttgaggggacccctcaaatctcctctaaccagagtcagtgcccctgcaccagccccagcctcatacccacgttgggtcagtcaggcctgctccagccagtgggaacactgccctttaccccacccagggaaggaggcagagcgcctggtaggggctggtcttacggttctaaccagggactgtgggaatcccctggacatgcacaactaagaccaccctcctgggatggaaaaacctgactcactgtctctgagaaggagcccaggaatctgcatttctcaccagctcctggacgttctaaagcacactcctgaatgcgcatcccacgggcacagcctagaagtccacaggccagcactcaggaggacagggagagggcagggagaggagaaggaacaggaggcaacatttgccgctggattgttgggggtaagggctttaggccaaagcaggaataagatgtggacaactcagaccttccccaaggtctgagagcaccgcaaacacaaagatgaacaaatggcacccagccactcccccatccagggagctcacagcctaggacaggagatgcttatagattgcacagaggtaggtagtgcctccccaaagcaagtcatcttcacagagtgactggaattcataggtgatgaattccgtttttgtccgttcatttattcattcattcaagtatttattgagcacagggtgcagaaaaggtggagatgaattcatcacagcccttgccttcaaggtgcttccattccaacggaggtacagacaataaccttgtgagcccagaaccagactggggttgaggtcactgtgaacagcaaggagtcgggacaaagagagtttctttctagtcatccttatttaggcataaatacacacaacaaaatatacccattttcagggtacagtcagtaatgagatatgtatgcccagggaaccatcaccccagaagtgtctcttgtgcccccttcccagtcacccccagcctgcccttggtcccaagtgactactgatctttctgtcactatggattagactttcacccctaagggttcatataaatggaatcgtatagtttgtagtcttgtgtgtctggcttctttcagatccacacctatcaatcagtggtttgatcctccttattcctgagtaggtggaggaggtggtatttaagttgattttggaggatgcattggagttcgcctgagaaacaaagagaggaagggcattccagcagagggcccggcgtgagagatatggactgtgggagcagtaggggtggggagggaagggggcctggctggctctttgtttttttctcctccttggcctttgctctggcttggacctcactaccttgtctagcccttgtgggtttggttttcaaaagcgagaccatttccttctggcttaaggccagggcagggcctgaggccctcatgccaggccattgccagtctgtgcatacttgtgcttgtggaatctggggtccagccatcgtgaatctgcacacttgagggccacggggttcccttgggctcccctgggtttgttttcctctaagttatttggtaaaactgctttggaatcatccggatcttgtctagggggaagaggcactcattgcccggacccacacctgagaaggcaggtgttatggctgctggggcccttctgctccggcccacatagtttgcaggccccaaggtggagcttatcctgggctcggcagcagcctgaggtcacgtggagttgacaccacgcctgtccccattcagcccagatactgagctctgcctccgcgctgctgggcccagggatgagcctgtcagtgtggctgcatgtgccaaagctaattctccaacacagtggaatgtgttccctgcagcctggagacgggcaggccagagtgaggcaggaagaggagccaaatggcctggggaggagctgcctggggaggcaacggctttgagcagctcgcccttgacttctgcctgtgtccccacccatgctgaccctggccagccttccacctgcctgtgccccccatctgcgctgcccgaggccacccctttacccgcccgcatccccccatccactcactcatgtcctgggtgtcccttgccttctccaaaggaaaaggagtctttacttaccaaagtgatttacattttattgtctgctttatttgaggattcattcggaaatagcagggttgggctctgaagcctccaggggctaatgggacttggggaaactgaatcaaaagggttcagccccagcctggctcactgagccatactaagtcaaatttaaccactaaggggcctgaaggtgggattctgggtccccctggaagtgaggggaaggaccgtggggctcagtgggagctggagagagtgactcaatcagctctcgtttgcttacaggtgacccatgggctgagggcatacgatggcttgtctctgcctgaggacatagagaccgtcacagcaagccaaatgcgctggacacattcgtacctttctgatgatgaggacatgctggctgacagcatctcaggaggtgagccaaggatccaaggctgggagcagaggggtggggggtgagactgtgcttcttcccactggcatgggggaggagggtgaccgaccattccgagctttctcaaccctgtcccactgtatactaggtgcccagaacagtgcctgacacccagtaggtactcaacaaatacttgttgttgctgattacatctcttttttgcttatagacgamctgggcagtggggacctgggcagcggggacttccagatgggtaagttgctgcaggcctcctgcaggtctccctcctgtcccccagggaagccccagagccagtctcctgggctgagggctccttgggcctgccctggggtacaaagcaagaagaagtgggtgtgatctcttaacctgctgagtgacagttgtgcagactgattggcaggtccctgcaaggctggtgtggccaggtcctgtgcttgcccatgccacaggcacaggtatcagggcactgggcaggtaaagcccagttctgctggggactgacagccagtcagctgtttcacattcaaagcaaagttctcacctcccagggcagctcagctgttgagtccttccccagagccctcctgggggcacagagctggggatcccaggcaaagacaagtggaacagaggggctctgtggaatcgggcattcaggcaggcagcagggcatgcagagcacagatcgagcctgacgctaggcttgggagagaaccttgccttaaggtgggtcatcrgctgggaagcaagggttcctagcttagggaggcaaggctaggctcttggagggaggagagtcagcccccaccctggtcagactggcccagcactgggatggggacttatagtccctgcttccttccactctgggatactgggtggagaaggacctaccccaggacaaggccctgtggctctttatggttcctactgccctctctgggaggcagctcctgggacaatctgtgaccagggccaaggatggagcaggtgctcaggtcagaccaactactgggccatcccgtggcatccagggctgccttcaccctaggcaggccttggccaaatctggcctgggcctacttcaggggtggagtcacctccctttagctgacatatccggggccttcaaatgccagtgggtagcatcctaactgggtcagtgtagacaggagggtaggtcactgggtaacctggtcctgactgtgacctcccrgagcctggacttggggctctgcctgaaggttttccatttccatgtgtaggtctccacgaggctgcaggatgcctgsgagctgggtggggcttgggagagggagtgtcaggtgggccccaggcacacatggcacgtcccgtcctggaatggcctatgctaatgtgtccctggagctgcctctggccaagccaggcttgcctctgagatcaccctgtccattcatgaaccatctccagcccctccccgggggctgcccactgcagcagctctgccccagctgggcagtcctggccagcccacctgcccttcctgagaagcagctgtgagggcagacgaggccagagggggaagaggtggggaacagggcacagcagctgtagggggcccaagaccagggtaggtgcctttcctcgcaagtgggaacaggtggggcctcagaccctccaggccaaaccctggctcctgccagctgcccttggggcaggtccaggcagctgggctgaatgccagtcagggaggcagcaggtgtgcctccctgatcctggggtcccagggtgcccactcagacttgaccaagggcagtgcccccactgcgcccatgagccagagccatcctgcctgtcatggggccatgcctagcctctggcccagtcccagaccctggactccagcccctgagatggctcttcccctcctccccctgggcatggctgtggctccctggctcagctccagccccctgtgtgtcaagacccgtccctgatagcctcccctccctaggaccccttcccacgtctcctcccccagtttctttccatgtwctgacctgtctctttctgtcttcccccatgcccgtgtgtcctgctctgacccttgtcggcatgtctgtgtgtgtcccctgtcctccctgccctgggccctcttccccactccttgagtgtctgtctctgcgcctcctccctctgcctcatcctgttcttctccctctctctggctcaccatctctgcttctgtcgccctctgtctttccctctctcccctctgcctgttcttttttttttttctttttccctctgcctttttcttcacctttgtcttaccttttctctctcattctcccccgccccactttctttatctctgtctctgtctttctgtctctttgtgtctccctctctcttgcaatgtctctgcctctctctctgcttctctccatctcgtctccctcgctgtcaatgtcccttcttgcctccttctctgtctctactctgcaggctcagggcagcccctgggccgcccgcccgtggctggcatgatggtctcggagcctgatgaggagtcccctctcagtaagtgacccaggccctggccaggtgggagcgctgctctccctctgcctccctccccatcctctctccccactcttccttttctctcctttctccctgttctcttcctccccaacctgcactttgctgcgagtcacacaagaggctcagaggcacctccctgcagagtccaggggctaggccagccactgcccctgcccaggacacagccaggcccaccctgggcccacagatctaaacacagtgggctggaaccctggcgggcgttctyccccatggggtgttgacgggcagagatgggtgcagcagccctgcagggaccaggccctgcattccagaggccacttgtgtccaccccagcacaggccaatcctgggcccacccgagggacccacagggacccagggctggagttcgggggcctgggtgtgttgcagagagttctgttgagcagggatgggaatcaggagttggtgagtagcctgctccggggccagggctagtcaggtgtgcagcccccacttctaccctgagtgcagggcagctgtctccctctcccggcctctggctccaagggaactcaccagatagggtgagaggagggagaggactggccagagagcacccctattccaaggcagcctcgcccctgctggctgcaccagtgtccttggctctggaggctggttcttttttccttttcttttctttttttttttttttttttgagatggagtctcactctgtcacccaggctggaaggcagtacagtggcacaatctcggctcactgcaacctctgcctccctgattcaagcaatcctcctgcctcagcctcccgagtagctgggattacaggcatgcactaccacgcctggttaatttttgtattttcaccatgttggccagcctggtcttgaactcctgacctcaagtgatctgccggcctcggcctcccaaagtgctgggattacaggcgtgagccactgcrcccagcccgggggctggttcttgaaatagaggtggcctcaccttctgccccagtgctcaggcaccagctgcagggtgggaratgggaggtgttcacccagacctgcccttggtctcgaagaacgaagcggggtggggtcaggctgaagggcctgtgcccttcccaggccctagtagaaaggggctttgtggagctccagtccccttccccaggagcgggcacattcctgggcagaggcccggcctcctcgcccgcgctgggccgtggggctgaggccaggggcttgggtggggggactctcaatgggcctctgtgctggctcacaaggggcctctgtggctgagccatggcccccacactccagcccacagagccccgcccacccggcacccaggagcctagcccagcggttcagggcaggcagcgccagggctttcttcacctgagccacagagcaagaatgtcctgtgcacctgcgggcctgatggacagagtaaagcgggaggaggatgggcctggcagtagcacagacagtgccactccctgctctgccacctacacaccggatttcagatttttggattagggatgcttggcttgtatatgactcatttgtcactcttattcattcatatctatcacatacatgaattcacaaatattgtgaaacgtaatgagcataaaatgtctcatatatagtcggtgcttaagaaacgatagatgtactttgggaggccaaagtgagaggattgcttgagcccaggagtttgagaccagcctgggcaacatagcaagaccccatctctatcaaaagtcaaaamattagctgggcatggtggcatgcacctgtaatcccagctactcaggaggctgcagtgggaggatagcttgagccttagagtttgaggctgcagtgagctgtgattttgctaccgcactccagcgtgggtgacagagcaagaccctgcctaaaaaaaaaagaaacaacagatgcatgtgtatgttcacaccagtctgagatgaatttattcagccatcactttcaaggaacccgctgtgtaccaggcacgcggcaggcactggggatgcgggcgtgaatgaaatcccaggttcccctccatcaagcctagagtctggtggtggagagaggaccacagcagcttcgattcttgggcggtttgctgtgtgccagktgatgcatctgagtacaagggcctggtgcatgtgagcacaatgtcatgcactcctcgcagcaacccaggtggtacatgcagtcaatatccccattaggaaacagaaactcagagccgaggtcagtgcctgaggcatggctgaccttagaactcacaattgttactgtgatgtgaaacctggcagaatctatgcagtacacggtggaaggtgctctgctagggaaagcagggcactgtgggagcccaggggagcggtctctaccccagccagggcagatcaggaagatcaggagacaatggctgagccaagtcctgaggaatgagtaggaactgrccgaggaaggctggcagagcctttcccagtcacacgcaggtaatccctgtgccaggccaactccctctgggagccaccccttcttgtccagccttcctctgaactgtgggggtctcctcttttgcactagcacttggtttctggatcaggccatttcccctgttagttaaagcccctcagtcaagttggggccttggcattgacccctgagcatgtatacctacaggcagtcctgggtgtagcagtgggcacacaggtgtcagcctcgagggaggcctctgggggccatccccccaactctgcctgaatggtccaactgcctaaggccactagatgccaggctggggctctcaaaatgatcctccttcgattttccagtttatttccgagccctggtgaatttcactcgctccatcgagtacagccctcagctggaggatgcaggctccagagagttycgagaggtgtccgaggctgtggtagacacggtgaggtgaagggggtttgggaagctcgcgggtgtggcggggcaggaccgaggatggggtgaaggcctctggggctgatggcactgtgtccctccccagctggagtcggagtacttgaaaattcccggagaccaggttgtcagtgtggtgttcatcaagtgagaaggggctccctgggggctgctgggggacttgagcgggtaacctggagggggctgatgaggatgggaaggaagcctggcaccgcggaaaggcctatgggatgagtcgctgtgggtggaaattcaggaattggtcgggggatcattgggacctttagttgcccttctttgggtacaggctgtcccggaacagggcctgagcgtcggggcgggagcctcatggaggagctgagaacacaggtgtctcgctgaccctcctctcctgcctgtctccatccccagggagctggatggctgggtttttgtggagctsgatgtgggctcggaagggaatgcggatggkgctcagattcaggagatgctgctcagggtcatctccagcggctctgtggcctcctacgtcacctctccccagggattccagttccgacgcctgggcacaggtgagcctatcctggtgtctgggatcgcctcytccagactcgtggggtcccctttcagtgtctctgccataggctcccaacttgggcttgcacaccactagaaacagggagctcactactcctgagtctgccccatcgatctttacacaatcttggcttggtagagcacagactgtttcctctagcacatacccrttagacccgagttctgctccttccttctagacctctgcacattgacaataggtaatcaggcctttatttatcctgtacttccaagtccaaaacacattagtacttaataataatgagcaactgtttactgagcactgactgcctttatttccagcctccgggtcagtcttcacagcaattcctatgaaggagatgttattcctcctgtttcagagacsagggaactgaggcccagaaaggaaaatctaaatttgtccagaatcagatgggcagatagtgaawaggcgaggatttcaaacaaactcggtgtctgtgacagtcttgccagaacctgtgatgacagaagcaggagaaactgaggcacagagagactaggaaactggtccaaagccacacagcggttaggtgcagaatcctggcctttgtactctgggtcagcccagatttccttctactgtgcctttggtctcctgttttaacctcctgagtctcttttttttctctagaccgaacagccctagttcatccttcacaggtgtggttctyggccctgtctccatctcagttccctgtctctgggaagaccctgactcagtggaactcagaatggaacaaactccatcccctactatggtgtagcccaattaggaaaagacagtgaaaccatcacctcccttgttccgcacctcaattaaagccaagcgtggtggtgcgcgcctgtagtcctagctactcaggaggctgaggcaggaggatcaccggagcccaggagtttgargctgcagtgagctaggatcatgccactgcactccagcctgggcgacagagcaaaaccctgcctctaaaacaagacaaacaarcaaaaacccttaattattgcacccagagatcaagcttgctcttctgcatcatcaggcccaggtctaaagactgctgggggtccagccctcctctctcacttttcaataagtcctcctggctagggatggtggaatgtggcccagccctgcagccctcagctcccggctcccaggtggaacagccactgatcacatcttcctttccagcacagacccccccacccccgccggccgctgtggcggtcgcagtgacaccaggtgagagtgtaagccaggccgaggcccagccaggttcctagagaagttaaggttggagaggaggccgggtgcrggggctcacgcctgtaaccccagcactttgggaggccaagacgggaggattgcttgaggcaaagagttcgagaccagcttgggcaacgtagcaagaccctgtctctaaaaaaataaaaaagaagagagaaaaaaattttttaaaggatggagaggaaagaagggtgtgggcaagatggctggctgggcacagcccaagacagctgggcactcccttctcccctccttctttgtcctcactgggccaggctgtggcctgcatgtgtgtggtgtggtggttgcatgcgtgtggcatgtcaactgtgtgtggggtctgttttagagatgggggaggccactgccgcatgtsccatgccccacgtgtgctgtggatgtgtctagtgtgtgctgcttgccctckttgtgcctgccagaaaccgagctgcctgacacagggccctggakcccactccagccacacagcacctacagcttcccgcacctgcctcctgccgcctctgactccagtctgcttcctttccacctgcagtgccccagttcccaagagcctgcacggaggccgagtttgcctgccacagctacaatgagtgtgtggccctggagtatcgctgtgaccggcggcccgactgcagggacatgtctgatgagctcaattgtggtgaggggatgtccggggccaygagtggtttgggtgccargggagggccagggtcctacacctgggtcttggagcccatcaaggactatgagggtttggtgcaggcagaggatgggggcataggaagggtgatgacagagccaggcagggggtggcagggagtggtgttggggagtacagggtgggcctggggagggttggggacaaggagcaggtgaggagccatctgcttctgccaaatgccaagcggaatctatccacagaggagccagtcctgggtatcagccccacattctctctcctygtggagacgacatctttaccgccccggccagagacaaccatcatgcgacagccaccagtcacccacgctcctcagcccctrcttcccggttccgtcaggcccctgccctgtgggcccmrggaggccgcatgccgcaatgggcactgcatccccagagactacctctgcgacggacaggaggactgcgaggacggcagcgatgagctagactgtggtgcgcaccggcaggggtgcaggtgggtgcggggagcaggaagctggcccgggaggatgctgctgacccctgcccggtctcctaggccccccgccaccctgtgagcccaacgagttcccctgcgggaatggacattgtgccctcaagctgtggcgctgcgatggtgactttgactgtgaggaccgaactgatgaagccaactgccgtgagtatccgagggtccagctgaggcccccttgccctgcccaggccgcttgctcctgccccgccttccactcctgccccgcccctaccctgcccctccgctttcccccctccccagtcccccaagcctgtttgtttgctctccctggctgagtgcggaaggccctggagacacaccccaaggtttatctctaaccagagccgtaaggccccttggccctgagctggcctttggtgaagctgtgtggttagcctgcctgtggttcgtgtctcgtcatttctttcctttatttttgttaccatgaagcttctctttgttttgtatgtgggtcggatgaatggctaggagggttctatgtgccaaggtcccttggtgatgggtccttggtgtatgtatgcaagtcagagccttacccacccatctgtccaactccccagccacccatgcacccacctatacacccattatccatccacccagcccttcatccatctatccacccatccatctgtcgtccttcttccctcccatccatccttccagcctcccacttccccacccttgtggtatccatcttttccagtcatggacattacgggcatcctgacagttaaataggagggggaggctggagaggcagcgaccacatcaggtggtatcctgtatgtcctgtcccgcaagaagcctgatgcttgwtagtgcaagattaaggataatcttcaggctcttctctgtggtcctgggtggtgtgtctgggcgcgtgtccatgttcctgctgtgagcttgtccagcttctccttgccttccttcccctgcccactccacagcaagccccggggagaggctgcaccatgccacagactggcagagtttgcgaacgcctttctgtggctctaagcttgcctgatagcaccagccccttgggagagataaagtaattgggggctttagttggaaggcccttctcaggggcctctcctggggaagtcaaaggaaggacaggtccttgtggacagcacagaaacagagaacatgaaagctgaatggcctcgtgggctcctgagagtgtggggaacagaagcgcctgagctgcgcccacggctacctcctggtctcctctcgcacctgctctgtggatgcgcggcttccgctcctgcatggctgtgacttctctgtccctgtctgtgtctctctcaagctccatctccctgaggaagaacaytggtcaccagccactagagaggcctagcagggcccagcccttgtcccgggccacttccagcctctggccactccatagagggcctgtcagtgggagcacagaccgtcgagcccctcaggggaccacactgtgccaggcrttctggtagagaagggtgggcggggcattgctggcgcccagagatgccagccccactggtggtgcctttgacatgggtcttgtccatgtgagcaagatagcrcttctgtgcctctgagcgtggctgggtgaygctgtggttgtgacagtgatgtgccagccataactggcatggggaatgcaggtggagtgaggggtgggggccgggtaatgtgatgagtkgttcgatgacagctggtggccgcatcatgctggctgtgagttggacagtgttgtgcagcaggggctaggcatggcgagggccgctgtgggttatgtgggcaagatgagagagtggccctggggatgcccagggaggatggacggggtgggctattgggaaccacctggctttgtccccagccaccaagcgtcctgaggaagtgtgcgggcccacacagttccgatgcgtctctaccaacatgtgcatcccagccagcttccactgtgacgaggagagcgactgtcctgaccggagcgacgagtttggctgcagtgagcagggagctggggtcgagatgcgggccctgggctgggttctaggggttctgtccacagcctcagcctccacccttctccctcctagcccctcggagccctccttccgctcctccttcctttgcccccgacccctcactcctgccctggtctcctcagtgcccccccaggtggtgacacctccccgggagtccatccaggcttcccggggccagacagtgaccttcacctgcgtggccattggcgtccccacccccatcatcaattggaggctcaactggggccacatcccctctcatcccaggtgcggctctgggcccaggtggtggggtgggaatgaggggcagctggtccagagccctaggccagatcctaccacttgtcttggggctcaccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggtactgccggagggcaggtgtcaccgggtgtgggggcrgagcygggctgcccaccacagccggctgcagcccccgcccatgccgcccagcaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgcgttggcgggcgggtgagcgctgcgggaggtgggaggtgggtacctctgtacccagggggcacagaggatagatgcggacagagggggccaggtttcgggaaggaatgtgagtcgctgaagaaacactgagccctgtcaaaaaagcatttcggggggaaaaccaagatgtttaggaagagccaaatccccccttgctacctacctgcttcaggttacggcgaggacgggccctggagccagcttccagcttcagatcctgacgtggacgctgtccacctgtgtcctgggtcaagttacccactatctcgtgtctgtttcgtcatctgtaaagtcggggggtgtggaataataactacctcctaggggttggtaaggacttagtggagtcacgtatgtaagcctctcagaattgtgctcagcgcattttcagcacccaggaggtatttgctaacgtcacagtcattgtcctcattctgagagacagaggtgccagtgtacccagattataggagcccaggctttggcatctccttggcctgagggtggcctccagctataccacttactgcygctgtgtctttgggcaagtctcttggcctccctggtcctattttcccaaagatagaggcaggcagatggactcagttctttctggcactgagaggcagaatggcaggatggctgagggcatgagcccaggcactgcctggactggggctcaggtcccagctctgtcgttttccacgtggcatcaagcagccctcaccctgctgagtctcacttcttcgttgcagaggattaaatgcatgtagagagttagctccaaagcactcaacacattttatgcccttttgttggttgaggaacctaaaaatgacttgtataaaacttagttacctggccaggcatggtggcttatgcctgtaatccaagtactttgggaggctggggagggaggattgcttgtggccakgagttcaagaccagcctgggtaacacagagagaccccatctctacaaataattaaaaacaaaaaatctagccaggcrtggtggcttgcacctgtagtcccagctacttgagaggctgaggcaggaggatctgttgagcctaggaggttgaggctgcagtgagcyatgatcacaccattgcactccagcctggacaacagagtgagaccccatccctraaaacaaaacaaaacttagttacttcccaaagttgtcccccagtatatttacaatgctaatggccgtggccaccatttggtgagcaggcagttggccctgtggcttgacgtgacagtcaacgaactgccaaaaacccttgcaaggtcagggctgatttcacagttttaagatgagagccccagggctctgagatgttgtggggcttccctgggttcacacagcagtttagagggggagctgaacccagggctgtctgattggaatctgggtggtccaggggagggagtggtgggaattccagggtgagcaggtggcctgtgtgtggatggtgaccaggagggaggaggcctgaagacatccccggaaggcagggaggaaagaggattgagtaacctagacccggggctgtgctcggtcattctgcgggtgaggagctggattcccctgtggttgcagggggttaattcaggatgagggggagaagctattggcagacagatgtggactctgtataaggaagaacttgctaagagtcaaagttgtccagagccgggagggacggcctttggaggttgtacgctctccatccatgacggctgcaccatccaatgtggcagtcactggccctgtgtggctctttaaattgaaatacaatgattcattcctgagcagcacaagacatgtctccagtgctcagtggccacatgttgctggtaccattacttttaatggcaaaaccaaaccagcaattactttttcaccaacctaacagctaccgtaatgaagagtgtaggtacaggatattttcactccaccgaaagttctctaggatggagctgtcctagagatctgggaggatgctgtcaagggaattcccatgtagggtgactgtgtgtgtgtgtgtgtgtgtgtgtgtgtgtgtgtgtgtgtgtacatagaagagggttggactagacgacccrtcataacaacagcaacaataagagctagccattttatatcaatgtgctcattttagcttatacctctaggaggcaggctactttaagcaccatcttacagataaggaaactgaggcccttgcccaggcttacaacacacctggacttggtctcctgttcctcagccctgtgtagmtctcctgcctgcagggttgttccagccctgaaagtctgtgggtctcttagcaagaaagaccctgagaagtctggctgcaaagaatccccttgtcctttctttaccctgtggttcccaaatggttcccagctatcattccatggcattgactttcccagagcatgctttgggaaatgctgctccagtatttgggaaggaggaaaaaactgcattttctttttcttttctttctttttttttttttttttttttgagacagagtcttgctctgtcacccaagctggagtacactggtgtgatctcagctcgctgcagcctccgcctcccgggttcaagtgattctgctgtctcagcctcctgagtagctgggactacaggcgtgcaccaccatgcctgtctagtttttttatttttagtagagacgaggtttcaccatgttgggaaggctggtcatgaactcctggcctcaagtgatctgcccgcctcagcctctcaaagtgctggcattataggcgtgagccaccacacccggcaaaaaactgcattttcttcactttggaagagagatcaaagttttctcgaaatcaaatttccactagaactttcccacctttctggattgctgcccctcaagatgggtgtatcaggcaggcccagrctgcagccctcagcctcccccttgccacccacaggtgtgaatgtgacaatgcctgcgcagcccggcacgccacccctctcctccacgcagctgcagatcgacccatccctgcacgagttccagctagtcgacctgtcccgccgcttcctcgtccaygactccttctgggctctgcctgaacagttcctgggcaacaaggtgaggggcctgggctgccaccctgggtggggaaagaattcctgtgggctctgctccttctgcagttggtggacaacaaggcagacttggagggaaaggtgttaccatgccccgatgcagccccctgtggcagcggctcatccattcagggcaggacctctcccctgcactgttggcttgggaagaagagctggcctcccctcctcccgggagccctccctgaccactcccccatgcctgggctgggttctgtgcctccgcactggcttccctgggtaccctgtgcactgcatgattccacaccctgccatggaccaaacaccctagagtcagggcctgagtctcgcccatctcggtttccctgtgcctagctcagtgcctggcacacagtaagtctcaggtaggcagagtgagggaggagctggaagactataggcacctyataggcacgaggtgtcaagtgtgcccacagctgcccgtgctgatccaccctgttgtgccaggtggactcctatggcggctccctgcgttacaacgtgcgctacgagttggcccgtggcatgctggagccagtgcagcggccggacgtggtcctcrtgggtgccgggtaccgcctcctctcccgaggccacacacccacccamcctggtgctctgaaccagcgccaggtccagttctctgaggtgggtggcgcctgagcccttagggctgggagcaaagggggatttaggctgggtaggcactgatgtgtgacccctgccaccttyacccatacccaggagcactgggtccatgagtctggccggccggtgcagcgcgcggagctgctgcaggtgctgcagagcctggaggccgtgctcatccagaccgtgtacaacaccaagatggcyagcgtgggacttagcgacatcgccatggataccaccgtcacccatgccaccagccatggccgtgcccacagtgtggaggagtgcaggtgcctgagccggcagggctgggaaccacagagaccctagcaaggatagaggagaaacggcagggcctcaccgtccttgcagcgactcttttggtcctgtccccacagatgccccattggctattctggcttgtcctgcgagagctgtgatgcccacttcactcgggtgcctggtgggccctacctgggcacctgctctggttgcarttgcaatggccatgccagctcctgtgaccctgtgtatggccactgcctggtgagtagtgccagcagacayttgaacactaaaataggagaagggacaatgtgtgagattccctgtgttcatgagctcagcacaagcctccagaatgactgtcatgactgccagatgaactatcatgacctctggatgcaataacagaaatataggtcaggcgcagtggctcatgcctgtaatcccagcactttgggaagcctagatgggtggatcacttgaggtcaggagtttgagaccagcctggccaacatggtgaaaccccatttctactaaaaatacaaaaattagccaggcgtggtggcgtacgcctgtaatcccagctactcaggaggctgaggcaggaaaatygcttgaacccgggaggtggaggttacagtaggccaagaccgtgcccctgcactccagcctgggcaacagagcaagactcagtctcagaaaaaaaaaacaacccagagatayagcatccagacaagggaggtgttggccctcctctccaccctcatcagactaatcctggagartgccaaatgaagaagcatggcctgcagagggcaactctagggggaagagcccttggggtgggaccttatttcttaggaatagtggcgagagctgggattgtggagctgacagaagaaaaggctcaagcagggcagcattgtcatctccaaatccctgcaaaggtgtcgggtagaagaaacagactctggagagcagaactggccagtgggtgcagattggaagagggtggcaggtttaggtcaataaaaagcaggcatttggaaccatctatgggacaggctgccgtgtaagatgatgagctccccatcatctataagtggttgcagttgatgctcccctgtctgcaaagctgtgcctccagcgtgatggggaggctgagctagacagcctccaaggtcccccgcagcatctggcccagttctgctctagaagttgagccataccctcctccttcttctagaattgccagcacaacacggaggggccacagtgcaacaagtgcaaggctggcttctttggggacgccatgaaggccacggccacttcctgccggccctgcccttgcccatacatcgatgcctcccgcaggtcagccccagctccgggtyrgggggggtttggctggggacagtgcaacaggccagagaatattctgggcagggaggcrggagacttggattcagatctctacctgatcactaagttatcccatgctcctggacctctctaggcctctgtttccttttctgtataatgggccccctgacttcctacagttgctgtgaggctgccgggcagggagatggcgtcatgcctcgtggcacactgtgtctgtgtagacagcagtcatttcccagggtgggaggagaaagcctgaccccagccctgccccatgccctgtccacttgatacctgcagattctcagacacttgcttcctggacacggatggccaagccacatgtgacgcctgtgccccaggctacactggccgccgctgtgagaggtgagggagagccttgkgggctgcaggaagggggctcctgggtggggtcatggaagtgctgatggcggccccctctctcccctagctgtgcccccggatacgagggcaaccccatccagcccrgcgggaagtgcaggcccgtcagtgagtatggctgccaccatcccctgacacccacctcccaacccaacctgggctgcacaccaggcaccctccctccctgccccagctcatgaaccttggggagccactgttcctctatctgcccggaccacgtatatcccattcccacctgccctgccaacactcgttttgtgtcccagaccaggagattgtgcgctgtgacgagcgtggcagcatggggacctccggggaggcctgccgctgtaaggtacgcgtgccatctgccacccacccaggggccttgggcccagcaccayagctgggaggaggaagaaggaagctccgtcctctccatagatccttggccagtgggtggtaacccagtcagaggctggtggacctggcccaccggccttccgtaccaggacaggtggcctggcrttgggaaggagcactggttagggagtcaggtgaccacagttcaagtcccagtcattctttatgcagcctttgtatctgcattgtacctttgcttttgccatactttgtccattgtcacattgatacaatgatatagatattagtgtccccaatttgtgaatgaggaaatggaggctcagagaagggaggtcacttgcgttaggaatgggagcatcggccgggcgcagtggctcacgcctgtaatcccagcactttgggaggctgaggtgggtggatcacttgaggtcaggagttcaagaccagcctggccaacatggtgaaaccccatctctactaaaaatrcaaaaattagccaggcgtggtggcgggcgcctataatcccagctactcaggaggctgaggcaggagaatcacttgaacctgggaagcagggttgcagtgagctgagaccgcaccactgtactccattgtaggcaacaagactgaaactccgtctcaaaaaaaaaaaaaaaaaagaatgtgagtatcaagtgtcggtgtaaaaaagaatggatggattctggagtcaggcactcctggtcttaaatcccagagtggatgggcaagctgagtaactttgtgcaagtcatttcacatccctgagcctctgtttcctcatgtgaaggatgaaggtatcacctacctctcaaggtccttaggggagttaaatgaggtgrtgtcgaatggaaagcagaacagtgcgtgaaacactccataaatagaagcagcaattatttcaatcaagtcgctgtatttcaagtctaaatttattggtgaaccccctggcagccaaagagaaaagggaaaaatgcttgcctaagtgcttgttaagtgggaattactattcagatggcaatgacgcctcatacatgtgctctttcttttcttttcttttctttttttttttttttttttgagatggagtctcgctcccatcgygtaggctggattgcagwggcgcgatctcggctcactgcaacctccacctcccggtttcaaacaattctccttcctcagcctcctgagtagctgggattacagctgtgtgccaccacgccaggctaatttttgtatttttaatagagacagggttttgccatgttggccaggctggtcttgaactcctgacctgaggtgatccacccgccttggcctcccaaagtgctgggattacaggcgtgagccaccgcgcccagccacatgtgctcyttcagtggctcccctgggtcttgggttcttatctggactgagggtggattcggccagagctccaggcagcctctcccatgggctstccttcagctccaactctgtgcctgcagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccaggtacctctgcaaggtgggcgggcaggaccgccaagccctgggccggatggaccaagcgccagtcccaggccacrgcccccatcccagccctttctcctcctcccagttgcatggggcctctgaggagcctggtcacttcagcctgaccmacgccgcaagcacccacaccaccaacgagggcatcttctcccccacgcccggggaactgggattctcctccttccacagactcttatctggaccctacttctggagcctcccttcacgcttcctgggggacaaggtgggtagtgggtggaaaggcaaaggaaactccaggcagcaggaacagcgcaggcaaaggcttggaggcgggagggtcgtggtgccttgggagaatagtgagatacactgcatggaaaaggtggctggagcagtgacagggcccgaattcaggcctccgcaagctcctgtctaaccctggtcccaggtgacctcctatggaggagagctgcgcttcacagtgacccagaggtcccagcygggctccacacccctgcacgggcagccgttggtggtgctgcaaggtaacaacatcatcctagagcaccatgtggcccaggagcccagccccggccagcccagcaccttcattgtgcctttccgggaggtgagcaatactgtcccctgggggtaggggtgcgggcaggcccttgctcctgcctctccggcattcaatactccaggacgtcaggggctgagcacatgtgtcctctccttggcagcaagcatggcagcggcccgatgggcagccagccacacgggagcacctgctgatggcactggcaggcatcgacaccctcctgatccgagcatcctacgcccagcagcccrctgagagcaggtgtctggagccrgggcaggaggaccagcatgggcttggggaggggctccatctaagcggtgcagtacagcacagccacttacagactgtgtgacccttttgtgcctcactttccctgtctgtaaaacggagagtcttaacaatrtctcccatacaggctggtctggggccaggctccctagaaagaagcctgagacggggattggggtgcatgtgatycacaagkagagggacgcaggagrggggaggggccatgcagggatatggtttcaggtcaagtctagccccagcctcagcccacagggagctctggagagtcattcgcsggagagtgatcgttctttcaggcccgtgggctcttgtagcctgtatcagcctgtcattggggaccccaggggaacgaggtggtataacctctccaggtgaggaagggtgatggtttggagtaagttgcaggtaacagctgtttgccacggtcctcgcagcctctggagatctggacagggccccagcagcactgtgacagggctgtcgggaggactaataagaccctgccagyggaggactccaggcgtgcctggcacagagccagcactcctattcacgctgggtcttgtcacgcccagggtctctggcatcagcatggacgtggctgtgccygaggaaaccggccaggaccccgcrctggaagtggaacagtgctcctgcccacccgggtaccgtgggccgtcctgccaggtgagtcmtgggccccacgccagcccagccagccccctccatggtgcttcccrctccttctccatgagccctccacacctccccagccctggccatccagtgcccctacctgaatgggccgtgttcggaagtccctcccactgccatctttctgcccccaggactgtgacacaggctacacacgcacgcccagtggcctctacctgggtacctgtgaacgctgcagctgccatggccactcagaggcctgcgagccagaaacaggtgcctgccaggtaagtcccgccctccttccgcccaccccagcaatctgtggcctctggaggcccagcctcaactcacatcctgctcctccagggctgccagcatcacacggagggccctcrgtgtgagcagtgccagccaggatactacggggacgcccagcgggggacaccacaggactgccagctgtgcccctgctacggagaccctgctgccggccagtgcgtccagtccctgcctgcacctgcccttccctgaaatgtctaccacccgctcccacacccscttcatccagggcccttctgagaggcagtggttaaatcctggccttactgcctgctcagtgtcacttggtgtgagatacacttcactttcagggcctcagctgcctcatctgtgaaatggggtagtccaccctcctcagccccttgtgtgagagttgaatgaggctatgcatgtggaactcttagcacagtgccaggcatgcagtggcactgaggacacatgagttcacatgcctgttcttcccctcccctctcccctggtcctgaaggaggatcgggggagaggaaggagccactgcgttcctgactagaaatctgcccccacactcagggctgcccacacttgttttctggacacagacggccaccccacctgtgatgcgtgctccccaggccacagtgggcgtcactgtgagaggtgaggcagggggtggagagggtggggggatgcgcacagggggtgtccctggaatcctcaggcagggcccagcgctcccaacccagaggaatcagggatgcctctcgctcttaacctygcacaggccccagaagacagtcagctcccctcctcgggagactcaacctctagcccagaattcaagaccctcagacacacatcctagcctgcggttcaccttcagccccctggccccctgccccagccaggccagagtcttcccacaaaacccctgcttctttctgaaactccygggttcctacctgccccaattcactggctgtgcggtccagggcrcrtccctgctcttcyctgcccagtttcccygtaacatgggcgagtcaggctcttcttttcttccagtgcatgaggccattgaattcaatatggggccctyagcccagccctggggttctgcttcccttcatccaaaattcatcagaggctttttctctctgcaggtgcgcccctggctactatggcaaccccagccagggccagccatgccagagtgagtaggattggggaggtcattggggtcgggttacccagagtccytagggcggagctaggacagaagcctttactcccctttggctttgcctgtcygagcctgtttcttcatctgtmaaatggggataggagaaggccccaccaccyccgagggctgtcrtgagagtgttgagtactcacatcagaaatcagagctcccgctcwgtggtgagcagagtggagggaagaggggtgctgggtggcgggtttggggctccagccatggctttcttccacctcaggagacagccaggtgccagggcccataggctgcaactgtgacccccaaggcagcrtcagcagccagtgtgatgctgctggtcagtgccagtgcaaggtcagtccgaatccctgtccctgcggggcctgctctgcccygctgcccagaccctgcggggaaatcaggcagcatctggtggaagccgagacctgggcatggggggcagggcatgggggacagggcaggggctgcccggggctgctggaagtggccagggaggctggcctcaggctgctgggggtgcaggagacccactgagtcccctgcctgcctccttccatccgtctacccaggcccaggtrgaaggcctcacttgcagccactgccggccccaccacttccacctgagtgccagcaacccagacggctgcctgccctgcttctgtatgggcatcacccagcagtgcgccagctctgcctacacacgccacctggtgagagcctgtgctgcccagccccaggcggwgttgccacctgctgcctgttactgtccatctgagcactgagcccagcgaccctcatccccgcctcagtaccctcacatgcccccattatttctctcrcagtcctgatctcaacaggaccccattcygcaccttaacaccctcccgtgccccatcccccaccaaggcaccccggtgctcaggctgacgccccctcctttttcccctgccagatctccacccactttgcccctggggacttccaaggctttgccctggtgaacccacagcgaaacagccgcctgacaggagaattcactgtggaacccgtgcccragggtgcccagctctcttttggcaactttgcccaactcggccaygagtccttctactggcagctgccggagacataccagggagacaaggtgggccccagccaagcaccagggtcagccgtgactcagacatgagttcacctctgcgccgtctctcagcaggcaggcacctgccacctgcatggccatatcgtggttaggcacgtggcttttgcagtcccatagacattggtytgaaccccagctctgccgcttgccagccagacaccatttgataaacctcaacttcatggtggctgaggggattggagatcgtgcctggcacataataagtgctcagctgttcatgacttttagctttcatgcagttattctacaaacagatctgggagaggccgggaaatataaagacaagtgagacacagtttcagtgtcattcacrtgcccgctccgacttcactcatccacactgctggctctgtgcttgtgttggacacagtaattctcatgataggtcatgtgtgttgagctctcactatgtgctaggcagcatcctttacaaatcacaaatcacaactrtgtgagacaggtcctgctactgccccatttcataaataaggcaagaggggcttggtaacttacccaaagccccgcagctgggaggtgggaatgccgggatccaaacccaggtcagaggctgcccttcaaatgctctgccaaaggccagagcccacacctgtaattccagcactttggaaggctgaggcgggaggaccacttgagctcaggagtttgagaccagcctgggcaatgtgacgaaaccccgtcyctacaaaaagtacaaaaaattagctgggcgtgttggtgcatgcctgtagtcccagctatttagggaggctgaggtgggaggatcgctggtacccaggatggggaggttgcagtgagccataattgcaccattgcactccagcctgggtgacagagtaagaccctgtctcaaaaaaaaaaaaaaaaaaacaaatactctgccagtcagaggtgaacctgtctttgctactccagaacagggtctggtggaaaggtggtgatgatggtggtggcgatggtgtgatggtgttgtsgggggcaggggctcaggggtgggctctgggacagcctgcccaaatgtgttcttgagcagcacgggcatccggtggcacccacgctctggggttggggttgccctatccctgttcgttggacacagccaggtactccaggcttctcccggggctggctgccttctggtcccttctcccctctcccttctggggttcgctatctcctggcctccctgctgccctgtcctgcaattctcagacctatctctgtctcctgtcctggcatttccctgcgccccacagggggaggcgtactttgcgcggatgcgccgrgctcaccaggtaggcccaggacgtgcgtggtgtgaagttggtgtggtggggcgtggtgccttctcgggtgctcccagccctgcgtggggagatgcgcagtgcccaaggcattgggggtctgcatgaatccaggcggtgtcccatgaccccagggttggagccaggagggtatgtgcctcaccttgcctcacctgctgtgtggtctggtcctggtgccaactgtctgaagtcagaatggcaactgaggtagcaaggagactaacccgatgctaatccacatgactgtatctagccccccgggttcccctggccttgcctctcaagcaaccaccatgaaccctctgtgtgcatgtgggcggcctggagttaacccttgggtgccagcctggagagggggggcatgcatctttcttcctaattagtgtgggcctttctgactaccatgtccgtgggtagaggaccctgcccatggctctagctccaggactttgggaggtcttagctcgcctgctccctccatttcatcagaaccgcacatccctctcagaggagcagttgcgggcagccgtgacagctgggaggatcccagagcccccagagggcagggactgggcacagcgggcatcacaggtaactgaggacctggctaggacaggttgtacctagggccacagcgaggagaccagagagctgagtccaggcaggcacctgagcgaagactccagctttcctgggccatttcccctatgccaggccaggccccagcctgatgcctggtctgctctggtgtctcccctgggaaacattccagaaccatgaatggcttgggctgttgccagggcacacaaagagagtcaggccgaggagcaacaaccccgtccagatgcccctggggctgcctccagcacttctgcccctcccttgctgggcaccctttgtagggcttctcccatcagtcacggcccataggcagccaaacccatcccgggatatccccgcctagctcaggaggaacaagagggcagtgggtacaagggccagagtgccaggtatcagcacttgtgagcagacagtgcagagcrggtggctggctgggcccgtggggaggtgaagcctcacggacgtcctttctgtccctctctgctcccttctgccgctcttcggctcctggtcccccaggtggacgaggctcagagacggatggatgctgagatctggcagctcctgtccagctttgctgcccaaccccaaccccctccccaggggctctctcctcatccccagcctgcagctgctctgcgagcagcacctcctccttcttcttcctcctcctcctcctcttcctcagcttctctgtctttctcaccaggctctcaggtatgtgccaaggtgcccatcaagggatccccacccaccatgctttctagacttcagtcatttctgaaccaacttcaccaatttctgtgaactacttggactattatttctttccaattttctcttaaatcaatcatgtaccaactcaggctggttactctctttcaaatacatatgaaaggagccatcccattgaaattgtttactgatgtgctgtgtaaacgttggtccacaaaagagacccaccagatgggaggagaagccgacccaggccacgcccagagagagcagctggggacctgggccgggattgggaagaaagtcgtccaaagagcaaggccaggacccgcactgtcgggtgggagtggggggctctgtctctctgccctgccaccaggcctccctcccatgacggtccacccctgccggaaccacctccgccctcccacccccacccctgctcccctcggctcttaccacctgcccttccctcctagttctctctctcctacgaaggcttctctctgcttcctggaagcctctattactggcagctgccccgggccttcctgggggacaaggtaacaaggatttggggggattataggggtgtcatagaatcccaaaatatcagagggccctttgtcaaggccctttatgacacaaatggggagaccgaggctcacggtgggtagagacttgcctggggtctcatgttcaggtcagagcacagctgagactgaactcagctctgcccctgtccttcagcgggccctgacccctgacccctggcccctgacccctgtcagaggagctgtctcgcctgggagggtttctctagtgccttttctctgggcttccttgaccttgtgtctagatgctggcctagtttttggtacttcactcagtcattcaagaagcattaattatttactgtgtgctkcgtcgtgtacaggccgagtgggccctggcctcccagagctccctgtccatcccattatcattcctgtcaccatcagtatcattattattatcatcatgagtgctggcattggccttagatgagtattcatattgcctctattttgttccaacaatttcaagtacctcttaagaatacacatagcaggctgggcgtggtggctcacacctgtaatcccaayactttgggagactggggcaggcgaacacctgaggtcaggagttcgagaccagcctggccaacatggtgaaaccctgtctctactaaaataacaaaaattagctgggcgtggtggcgggygcctgtaatctcagctacttaggagactgaggctgtagaattgcttgaacctgggaggcggaggttgcagtgagcctagatcatgccacttcactccagcctgggcaacagagcaagactccatctcaaagaaaaaaaaaaaattcagcttcctggctgggtgcggtggctcatgcctataatcgcagcactttgggagactggggcaggcagaacacctgaggacaggagtttgagaccagcctggccaacatggggaaaccctgtctctactaaaaatacaaaaactagccgggtgtgttggcaggcacctgtaatcctactgcttgggaggctgaagggggagaatcacttgaacccgggaggcagagattacagtgagctgagattgcagcactgtactccagctgggcaacaagagtgaaactccatctcaaaaaacaaacaaaaaaaagaataggcagtcacaaggtacattcagagaagtgagacagggaggttgaggggtgaggataagaagcaatctgctggagccgagggtggagctggagtactgcagggttatcaagygtgatatgcattctcaaactgtgtggagtacatcaccatttgtgtcctatattacttaatcctcatgatacccttcaaagtgggtattacttttacttccatttccatgtgaggaaagtagggctcagagaggtgaagcgacttgtccaaggctgtatagccagtagagctagagtttgaacccaggtcattcagactgtggagtctgccgttttaatcactatgctggatctgggtacaatggctcacacctataatcccagcactttgggagactgaggctgaaaaatcgcttcaggccaggagttgagaccagcttaagcaacatagcgaaatgctgtctctaaaaaaataaatcggccgggcatggtggctcattcctgtaatcccagcattttgggaggctgaggcaggacaatcgcttgagtccaggagtttgagaccagcctgagcaacatagggagaccccatctctatttaaaaaaaaaaaaaaaagtgcctgagcaacatagggcgaccccatctctatttaaaaaaaaaaaggtgaaaaaaaaaataaaaaatttttaaaaatcactgtgctgtacacacctgcaacttgccagaaagtcagtcccagaaatggctgtgaactttctggcattcaaagcaagcaggaaaccagttattttatggttatttggttccactccaaaattccttaccatgccttgagctcatggagaatatccctgtagccatgtagcccagggccgtgtgtgtaatcagcaggtgtttgataaatgctggttagctgagtgaacacacaaatgaacaaagaggtaggcttgatgcagtttggtattgagatgaatgtctgccctggtggcagrggagagaaagcaaagtcctgtgggacagagctgggkagcctcagctgtccacgtgaaggtcctctgcagcagaagtaaggactccccagtcatgagcaacacagtgcccaagtccagtgggcttgtctgcaacaaagaatctatcggctcatgcaactgcagagtctaagcatgtatggtgtcaggcatggccttatccaggggctcattagggctttatcttggttctccagcttctcatctgactgcagaagggactttctctggcctggtagaaagagcataagtgcacgggttacttgtctatccctgatggggtggcaaagggcagtggtaggttatgcagattggccaggcctggctcatgtctccactatagaggaggaggggatcagggccctcagaccacatggtctgcatgtgcggagacagttgttctttatagaaaaccacggtttagtttctagaaagcaggaactggatactgggcaaacaaaaaccacctgcctaggaggcaaggcctccgaggggctgccgtcagccccacccccatggctgagaacttttgaagcttccgcagcctccccatggtggtcattgtcattacacttgtctgccttatgggaaattcctgtaaatgaaagcagacctggagtttgttcgccggcaccgtcaggcaatggggaatagagaaccttgcagagcaaagaggctgctcagcatcatcaccaccatgtctggggctacagaggaactgagaaatgtcctgtttcccaggcaaccatgcaccctggcctcttggtttgggcagggaggggggtgggggagtgtggcacaggtgcaaaaaggccrccagatgctccatccctcacctatatggtccaacactcacaccccaaggtcagcctgtgacctctgggcttgcctctttgcaggtggcggcctacggtgggaagttgcgatacaccctctcctacacagcaggcccacagggcagcccactctctgaccccgatgtgcagatcacggtgagcatttggacaccatgctgggtgggcagaagggcaggatggaagccaggggcaccctcggcatttgtcctttgtcctttccatccagcactcagttttctggcacaggctgggggagttaggcccatgcccccacatccctgcctggttggacactacccaagcagaggatcctgctgctgggagaagggggcagtgggcatgtgcctgactcctttgggcgcatgagcttgggagagcagagaggtgggaggctgggggttacagagaatctaggactggtggaggacaccctggcaccccagggacccctcggctccccttccaatcctgctggtgtctttccagggcaacaacatcatgctagtggcctcccagccagcgctgcagggccctgagaggaggagctacgagatcatgttccgagaggtaaggggcacctggccatgctgtgtctaaccccaccccaccctccaccctgactcagagcctggctttgatacccaccctgtctctcgctccccaaccttcacctggcagccctcagtcagtgcctgtaaggcaggatttggggggtggtaactgtaggagcagcccacaaagcccactgcccccgcccacgttgccacccccaacccaggaattctggcgcyggcccgatgggcagccggccacacgcgagcacctcctgatggcactggccgacctggatgagctcctgatccgggccacgttctcctccgtgccgctggyggccagcatcagcgcagtcagcctggaggtcgcccagccggggccctcaaacagaccccgcgccctcgaggtggaggagtgccgctgcccgccaggctacatcggtctgtcctgccaggtgagtgtgtggccagctccaccacctctgcacaggcacagaggcatcagcaagcaaatcagccggcgtcgccgcagccttgattaccatcataactataatgacccctgcatctgggccctgcatgtattcctcccgacagccctgagttacatatcattatcccctttaacaggtaaaaaaatagaggtgctgaggggtgagtgtgtcccaagggcacacggctaatgtgtggcagaaactaatttgaacctgggtctgattgactccaaagcctagcatgtcctaaccactgggcagtgcakcctcacgtttgggccacactctccgggggttaaaacccagttcatgcccttgagggggcccaccagagacagggagccaattcagaaacacagattaytccggcccaaagcacagcatagagatgcctcccagaggtgaacagtgtggactgggagagggcygtgggtgggaggacagactgagcagaagtggggaaggaggggcgccggcctgtgatgttccagggtcacccctgggaggacactggagggaggggttctgggtctgctggctgtgggtggggcacgttgggaacagaggccaaccttcctctctgcccctaggactgtgcccccggctacacgcgcaccgggagtgggctctacctcggccactgcgagctatgtgaatgcaatggccactcagacctgtgccacccagagactggggcctgctcggtgagctgcaagcgaggccaggacagggggtcagctcagctgggcctgggtgggggaccagggctggacaaggcaggcatcaatccaggggatcaggatcatggggcatggcctgtggttcaaagcacctgggtcagcaggccaggtcaccggggatggtggggtggccagagctatggaataacatccttctgtgtaaagaaaactttggttctttactatttttttctttttcttaaaaaaattttttttatctaatacagatggggtctcactttgttgctcagaaggtcttaaactcctgagctcaagcaacccacccgcctcggcctcccagagtgctgggattacaggcgtgagccaccacacctggcctttttactttttttttttttttgagacagggtctcagtctcgttctgcctcctgggttcaagtgaatctcatgcctcagcctcccgagtagctgggactacagacatgagccactgtgcctggcctcattacatatattttttataccttgacttttcagagtagcatgtatatagccccccagggtacgcagtgaaggggcaggtggttgacagccataacctaaacttggagcaaggaacaccctattgttgataccacaaacgtgaatctctttggaggagaatctgtaacccacatgtttttatgaggatgcacgtattttctttttcttttctttttcttttttttttcaagacagtctcrctccgtcacccaggctggagtgcagtggcgccatctgggctcactgcaagctccacctcctgggttcacgccattctcctgcctcagcctcccgagtagctgggactacaggcgcccgctaccacacccggctaattttttgtgtttttagtagaggcggggtttcacctgtgtcagccaggatggtctcgatctcctgaccttgtgatccacccgccttggcctcccaaagtgctgggattacaggtgtgagccaccacacccagcctcttttttttttttttttttttttttttttgagatggagtctcgcttttgtcacccaggctggagtgcaatggcacaatctcggctcactgcaagctccgcctcctgggttcacgccattctcctgcctcagcctccggagtagctgggattacaggcacctgccaccatgcctggcgaatttttgtatttttagtagagatgggatttcaccatgttggcaggctggtctctaactcctgatctcaggtgatccacccacgtcctgagattacaggcgtgagccactgtgcccggctgacaatacacatttttaatgctctgcccccaaatacctgagtgtatacctttcctttgctatcacaggtacttagggagaaaatagaattagcatcaccctttttgacagctatttggatggatgtactttttaatttatccaattccctattcatggatgtttaggtttgtttctagctttttttgcttttttttttttttttttttgagatggagtctcgctctgttgcccaggctggagtgcagtggtgcaatctcggctcactccaacctccacctcctggattcaagcaactctcctgcctcagcctcctgagtagctgggactacagacgcacaccaccatacccagctaatttttgtatttgttagtagagatggggtttcaccgtgtcagccagttggccttgaactcctgacctcaggtgatccacccgcctcggcctcccagagtgctgrgattacaggcatgagtcactgtgcccagcccattttgctttttataaacaccacggagatgagtgtccttgtaatgaaatctttgtgcccttccatgattctttctttaagatgagttcacaaacttggaatttctagatcaagggattgcaaccctgaaaggcttctggtaaatttggcctaatggctggtgcctgccctccttgtgccctgcagcaatgccagcacaacgccgcaggggagttctgcgagctttgtgcccctggctactacggagatgccacagccgggacgcctgaggactgccagccctgtgcctgcccactgaccaacccagagaacatgtgggtaccctagctcaaggcccaaggacacacttccactggggaatgagtggaaggcgttgcactggcttttggggcagaagtgaagggagcaagatggagattgggcttcccatgacctgacctttgcctccccgatcccaggttttcccgcacctgtgagagcctgggagccggcgggtaccgctgcacggcctgcgaacccggctacactggccagtactgtgagcagtaagtttgtaaacagaagtagggggagggtggaggacaaatggtggactcccaagtgagagccttaaagggtgttgctcagaaaagtctcttctaggattatgctccttccctgcctcaaacacttctaagacacctcattgctcttgggacaagcccaccctccttaggcagctttactgtagcagtctcatcccacttctgacacccaactctgtactttagctgggcttaactttttaaatgctttttctttttttttttttttaaactgagacagggtctcactgtgttgcccaggctggtcttaaactcctgggctcaagcagtcctcctgcctcagtgctggcattacaggcgtgagccaccatgcccagccactttttgaattcttgatgttcaggccttgcttatgctgttccctctgcatggaacagtcttcacccctaaaccacccgttcctggctaacttccccttagccttcagacccagcttcattcactcattcagcaaatttttatcaagcagctcctgtgtaccatgctgtgtgctgaggtgttggagataatggagtgaacagaacagattccaccccagcccttacggagtctgccacctaataagagatcagccctaatgggagataagacagggaaaaagtaattgtgcaaatgtgtatttacaaaccatgttaagttatctgaaagaaaagtacagcctgctctgaggtaatacgagaagtcccatcctcttggaagcctccctggctctccaggstgggccagtgccctcctctgcacccgcacagccctgatatgcttcctgcactctcattttcatgtagaatttccatgttgggttcccaactagtaagtcccacagaccagggactttatcacattcattgttgtatttccaacacctatagcacatgcctggcattcagtcattgcttaatggacatttgctggccaggcgtggtggctcatgcctataatcccagcactttgggaggctgaggtgggcggatcatgaggtcaggagatcgagaccatcctggctagcacatcctgcctctactaaaaatacaaaaaattagctgggtgtggtggcgcacccctgcagtcccagctaattgggaggctgaggcaggagaatggtgtgaaccccggagacggagtttgcagtgagccgagatcgcaccactgcactcgagcctgggtgacagagcgagaatctgtctcaaaaaaaaaaatggacgtttgctgaatgaatttctctggagaatagagaccttacctctctcatcacccaacctgctaacactcccttacactcccctttctcagttcaccagcaccctgcgttggggcctgtctggtccccaaagtgcttccagagctccgagcctcctcacctgacattgggtggcctgctgagcttctggctccccaagtccaccatgaggcactggggcccttgaggcctgacattgccggcccttgttcccccttacaggtgtggcccaggttacgtgggtaaccccagtgtgcaagggggccagtgcctgccagagagtaagtgggaccatggcccaggatggggacgatgggcaaggcagggagccctgggaatttgggggatactgggtctggggacagggctgagggtggggtaccccagcttttgggagagcagagatattgaagacaatgctgaaaggcccttcctgtcccggcccccacccccagcaaaccaagccccactggtggtcgaggtccatcctgctcgaagcatagtgccccaaggtggctcccactccctgcggtgtcaggtcagtgggagcccaccccactacttctattggtcccgtgaggatgggcggcctgtgcccagcggcacccagcagcgacatcaaggtacccatggccctaggctcctcagccccaagagccatcccagtgggaggggaggcaggggcctgtccctgccctagtgggatgctgtccttgyrcatggggctggatgtgagaaagagtgtatctgcaccaacaagctcttgtctcctccccaccaggctccgagctccacttccccagcgtccagccctcggatgctggggtctacatttgcacctgccgtaatctccaccaatccaataccagccgggcagagctgctggtcactggtgagtccctacgccccctgtaaccaagactgcctgtcctgggctgggctgcaggctgcagattcaggcagatggtgcattcacctgctgggagggggcagtggttgcccgaacaaggtcagcagccatggagatgaggagaggtggcagattcaagactcattttagaggtaggatcagcaggacttgactggtcggtgagggcaaaagaaaagggtgggccgggcacggtgggtcacgtctataatcccaacactttgggaggccaaggtgggcagatcatgaggtcaggagttcgagaccagcctggccaacgtcgtaaaaccctgtctctagtacaaatgaaaaaattagctgggcatggtggtacacacctataatcccagctactcgggagaactgaggcaggagaattgcttgaacccgggaggtggaggttgcagtgagccaagattgcgccactgcactccagcctgggcaacagagcaagactctgtcttaaaaaaataataataataatgcacctcagagtcaccctgccctgtcgtccagggaaaagtgagacagggatgggagggcrtccataaaggctgtgtcaycaagcagattgccaccgtgagcagttgttgcttagtacaaccgaggaagcttttaaagggagccggtgtaaaacacgcacctcaaagtcaccctgccctggggtccaaggagctgcagtatgtctaggccagcttctgtcagtcattgactgagacctattctgggagcatcaagtcccctgcacatctgtcccacccatgggtgtgcactgtgggctccagtggcctgagaaagccctcaatgcaaagaagtgcagtggctggcagaagtcaggcaggtgggcacggggggtgggaagcgtggctaggccaccagcagcacaggctacaaacaggtcagagagaatcgcaagtttgttttggacgtgttagagtctgagatgtttgggaagatatctcattgagtccaccaggcaggcatttgggtatgtgagtctgaactccagtaagaggccccagccagagaaatgagtatggttgctgttggcacagggatggtgttcaaagctatgggacaggatgaagtcacctagggagagtgtggcccgaggacagggccccagcccagagtcctgaggagctccagtgtgaacatgtcaaatggaagaggaagggcaggaagagcctgagagagtgcagccatgaggcaggaagagacagggggcatcatgggaatcagagggaaaagggctttcagggcagcctccctgctgggaagtcacataagggcagagaaatagcccttggaggtcatgctttgacaagagcggttttcagtggagagaagrgatagaaaccagattggaaggaggcgacacatgggtgggaaggcagcgagtgtggacaactcctgcaagagtcttggctctgaagggaggccaggaagtgggtcattgactgcgagagcrtgaggtcaagggggagttttcggaaatgggaaatcctagaatgcactctggaccgaagtgatcgcatgagaaggaggagacgctgatgttgcgagagcagaagaagccccggggaggggtggcactcaggcgcagcagtgggatggggtgagggcaggagaaggggcctgtccttcagggaccagtatctagagagctggtagatttgagaggctgggaaaactcctgacttgtcgtttctattttctccataagtgtgtgtcagcgccactagctaagaaagtggaagggtggttggagaggctggaggagatgggaggaggtgtgaaatagttgtttttgggggatagaaactcaaaccagacggagaaacccagttggagtggggtgtgatgtgtcaggagctcattgtggtctgtgatcaggaactggagccaagtggacccatggtgtgatgttccccaaccacatcctgtggccactctgtgctggcaaggagggtggggatggtggggttcagccagaatgggggagggaggtgccagggggtagaatgagagctaggctggaccaggaaggaagtgatgcctagaggttatggagaaagacaaagtggccacaggaccggggcctagccagcaccggctcacaggggggcttcccgtccctgcagaggctccaagcaagcccatcacagtgactgtggaggagcagcggagccagagcgtgcgccccggagctgacgtcaccttcatctgcacagccaaaagcaaggtgtgcaggtcagggagtggggatggaggaagtctgtcytctggggtctctgagccccacccatgaccccctttcgccttgccctgcagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcagggtacacctcccatctatacctgattctcccaccctggctctcccccattcccaccagaattagcacagcatttcttcattctgctgatcatttctgagcacctgctgcatgcctggtcctggtctaggctctgcagaagcaggggagagaagcatgtacagtatctcggtcctcctgaagtacacgtcctaggcagggagaccataagcatgggaataaatgaacaagcaagataactacacatggcgatgagtgccaggctaggaatgatgagaaagcaagaaacaaggtgggagaaggccaggagcggtggctcacacctgtaagcccagcactttgggaggctgaggcaggtggatcacttgaggtcaggagttccagaccagcctggccaacaggtgaaaccctgtctctactaaaaatacaaaaactagctgggtgtggtggcaggtgcctataatcccagctactcaggaggctgaggcaggagaatcgcttgaacccgggaggcttaggttgcagtgagccgagatcgcgccactgcactccagcctgggtgacagagcaagaatccatctcagaaaaataaataaaataaaacaaggtgggagaggcaagggctactctagatagggcagtcagggagggcctctctgaggaggtgacacctaagctgagacctgaaggaaaggtaggcattgagcaagttagagagttggcagagtgttcttggcagagggagcagcacatggcaaggccctgaggcaggagcacgttgctatgtttgaggaacagcagagaccacgtggctggggctgtgggagggaggacgggtgtgggcagacgggagagcatggagtatgtggtggatcagggtaggaattttggattttattctaaaagcaacagggagtcatggacaggtctcaaggtgggaggtcacaaggtcctgttgacatttcccaagctccctctggctcctgtgtgcacagatggccgtggagggctagcctggaagcagagaaagtaggcagcaggactgttgtgtgagtcagacgacactccccaccctgagtgcatgttccttttcctcccttgtcagcctcgggcaccttgtccgcccccgtggtctccatccatccgccacagctcacagtgcagcccgggcaactggcggagttccgctgcagcgccacagggagccccacgcccaccctcgagtggacaggtgagrccgtgatgggaatgacattcaaggcctgactctcctgggtgtgggaggggaggggcaggactctgagcaggcttggtgggtgctgaccccacgtctactcrtcagggggccccggcggccagctccctgcgaaggcacaaatccayggcggcatcctgyrcctgccagctgtcgagcccacggatcaggcccagtacttgtgccgagcccacagcagcgctgggcagcaggtggccagggctgtgctccacgtgcatggtgagaggccgggctcagggtgggggccgggagtgtgctcagcccagggcgtgttctcacaggactctgtctgcagggggcggtgggcccagagtccaagtgagcccagagaggacccagrtccacgcaggccgcaccgtcaggctgtactgcagggctkcaggcgtgcctagcgccaccatcacctggaggaaggaagggggcagcctcccaccacaggtgaggagatgggcccacccaggaggaggaggcccacaggctctgcagagagtcccagccaccttccctccccsttcacgccccaccccacctcctcctctgtggctcccttcacctccaagatggtggtctcctgcccctgcatcccagcagggagcccctgccgtcctcttggctgcctggcgtttgtcctccttcatgccccactgggccctaatattggccctgcacctgcctctcccttttatgccctatctgtccccctggccagccgttgtccagctgcctctggggcagctgacccatctcacccrcggcaggcccggtcagagcgcacagacatcgcgacactgctcatcccagccatcacgactgctgacgccggcttctacctctgcgtggccaccagccctgcaggcactgcccaggcccggatccaagtggttgtcctttcaggtacggactctctgggaayggaggggtggggagggcaagccagggctcccctggggcctgctgacccctactctggccccagcctcagatgccagcccaccgccggtcaagattgagtcctcatcgccttctgtgacagaagggcaaacactcgacctcaactgtgtggkggcagggtcagcccatgcccaggtcacctggtacaggcgagggggtagcctgcctccccacacccaggtatgtgggccctgagcctatggcaggggacccagggtgcaggggctgtggcggaggcggggcctgtacgctgggcsggggaggcggcacactgccccacacgttccaccagcagaagccaggcctcatctccctccctcccagtttctagcatgggatggctcggagcagagccagtgagagtttgaatgaatcactgaggctgagggagtggtgacaatagcccccgtccctgtcctcacgtacctctggctcctcctggcccaggtgcacggctcccgtctgcggctcccccaggtctcaccagctgattctggagaatatgtgtgccgtgtggagaatggatcgggccccaaggaggcctccattactgtgtctgtrctccacggcacccattctggccccagctacaccccaggtgaggagccaggtgtggctrggccggggctgagccctaggagctcccaaggaagatgcctgtggcttcttcagtgggaccaggacaggggggcattccaggcaggctttgacccttcagcgcctgctcagagagagraggaggttgagtggacgggagggaggttaaggctggtccagcttacctgggctccctatgagtgactgtttcagaatttgtcaggaagcagcagaatgtccaggttgaatactaagctgggagtcggctgacctggttcaaatcccagatctgccccttagcaaccttgaactagcttttaacttttggggcctcagattcatctatgaaatggagcagtactgcccacctgcttggtcatggtgtggtttttttattattttattttattttattttattttattttattttattttwtttttttgagagagagtctcgctctgtcacccaggctggagtgcagtggcgcgtgatctcggctcactgcaagctccgccttccgggttcacaccattctcctgcctcagccttctgagtagctaggactacaggcacacccgccaccaggccggctaattttttgtattttttttagtagagacggggtttcaccgtgttagccaggatggtctcgatctcctgacctcgtgatccgaccgtctcagcctcccaaagtgctgggattataggcatgagccaccgcgcctggccagtcatggtgtggtttaaatgagacagtgtctatggaaagtacttgtgagcacacggaagacgtcctgtagaagggaggtgtctcactgtcatccgcatccttgggcgcagcctgggtagtaaagcttgctggttccctatgggccagaggagctcatcatcaagaagtcatgggtgggtcaatgggcctccagcttgtggttagaggctggggagggaagaagccatattcggctggccatgtggaggcagaagggtgtggccctagtcccagaaaggccrcctgtcggccgtccccactagggcctggtcacagcccagagccttctgccccagggctacaggttacagcccaagagttcaggcctctgagcagccgctctgtgtccagtgcccggcagcacccggcccatccgcatcgagccctcctcctcacacgtggcggaagggcagaccctggatctgaactgcgtggtgcccgggcaggcccacgcccaggtcacrtggcacaagcgtgggggcagcctccctgcccggcaccaggtatggcagccccccrggaccaccttgctggaggggcyggatgggactgttccagccccctcccaacccaccccatttgcacacagacccacggctcgctgctgcggctgcaccaggtgaccccggccgactcaggcgagtatgtgtgccatgtggtgggcacctccrgccccctagaggcctcagtcctggtcaccatcgaagcctctgtcatccctggtgagtgactcccagtgacatggaaagctggaggaggcagagaggcctccggggtggtgagatccaagggacccctcttgmtgacagggcagaaggcccacaccggagctggctgcagggccctgcccaggccgactccacctgtcagagtaaccaycgccttcccgtcacactttgctttggccacatgactcctcaggcrtcccctcccacctcctcttcctctctccaactcatctctgccctcatctctctcacttcctcactcccctctgcaaggcrtggcccatgccctggtcctcccatcagggttgctgagctgagggcatcaagtccaggcccccagatgcctgaaaagctggatctggccttgaaaccctgggctgagctagctgcagggtgggcaacccctgccctctcatctcaggagcatctacaactctcactcccatccccactgctgcaggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggtacagggcaccaagaatgtgggacggggccatggacagtgggttgcaggatcctggcccctaggctgaggggctggcacttcctagatcggggggacagcggtggggcatytgctggcctccgggaagcccccctcacacctctgcccacggctgcccaggttcgtggctcccgcctgtacatcttccaggcctcacctgccgatgcgggacagtacgtctgccgggccagcaacggcatggaggcctccatcacggtcacagtaactgggacccagggggccaacttagcctaccgtgagtggggccaccaggctgggctgggatgcagagaacaggctggagtggcttcagagaacaggagtgaccggtgaccatcttatccctcagctgccggcagcacccagcccatccgcatygagccctcctcctcgcaagtggcggaagggcagaccctggatctgaactgcgtggtgcccgggcagtcccatgcccaggtcacgtggcacaagcgtgggggcagcctccctgtccggcaccaggtatgggactggaggacagacaggccaagaagaggaagcgggtccctgggtggcggaggttattgggggagggctagaggctcccctgagatcaggaagccctggaccccattgcacagatgtatagtgcagtggttagaaaccagaatctaggactgacyaacctgggtgtgaattctggctccaccacttagcttgtgacctcggacaagttacttaacctctctgtgctatagtttcagggcctataaaatggtaacaatggtacgtaccagccgggcacrgtggcttacgcctgtaatcccagcactttgggaggccgaggtgggcgaatcgcctgaggtcgggagttcgagaccagcctggccagtatggtgaaaccccatctctattaaaaatataaaaattagccgggcatagtggcaggcgcctgtaatcccagctactcgggaagctgaggcaggagaatcgcttgaacccrggaggcggaggctgcagtgagccaagatcacgccattgcactccagcctgggcaacagagcgagactcagtctcaaaaaaaaaaaaaaaagtacctcacagaattatcttaaagattaaaatatatgcaaaatcctcagagcttaggctcacagaaagtactctaagctgttaatattttactataatgccrttagctattgttgttaccatattttgtagaatttaggataccactgattkcgagatcygctatgattttatgtacctctaagaaaaagcttctatttgtaaggttattcattgtagatgcatcttgattttggagacatcgaaatgtgtgtctagaattgatgggatgtggtgtgagtgtgtacccagctcactggggctcctctggtctaccaccccgctgctggacaagagtcccccttccccatgtgaaggacagggaaactgatccagagctgatggccaggccttgggggtcagagtgaggcagggttgcaggttataggaacaggggtctcctgagggctccctctgactcacccccattctggccagacccacggctccctgctgagactctaccaagcrtcccccgccgactcgggcgagtacgtgtgccgagtgttgggcagctccgtgcctctagaggcctctgtcctggtcaccattgagcctgcgggctcagtgcctggtgagtagctctcagggagggcagrgctggggacccagggtgggaggccccccactcttgcaacggcaggatcaggaggccaagccrcagactgcacctgccttgagaccaggagccccatctcatctcacctcctagccrgctattgaccctttgccctctgtccccagcwcttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtaggaggcaggagctcaggaagcctgaaggaccctgtagctgcagtacaagagcataggcttgaccgggcrcagtggctcacgcctgtaatcccggcactttgggaggccaaggcaggaagatcacgaggtcaggagtttgagaccagcctgaccaacataatgaaaccccatctctactgaaaatccacaaattagcckggcgtggtggtgcgcrcctgtaatcccagctactcgggaggctgaggcaggagaatcgcctgaacccaggaggcggaggttgcagtgagccgagatcgtgccgttgcactccagcctgggcgacagagcaagactccgtctcaaaaaaaaaaaaccacaggctttgaactcaggcatgttcgagttcagacactgttccgctacttgcatgctgtgtgactttaggccagtcacttgtcacttgattctctgaccctcagtgtcctatgattttatgtacctctaagaaaaagcttccatttgtaaggttattcattgtagatgcatcttgattttggagacactgaaatgtgtgtctagaattgatgggatgtggtgtgagtgtgtacccagctcactggggctcctctggtctaccaccccgctgctggacaagagtcccccttccccatgtgaaggacagggacagtgatccagagctgatggccaggccttgggggtcagagtgaggggccaaatgggctcatgctgcctacctcatctcccctgtagcatgtcracaaacactggtccccacttttctctggtgccaagtctcagtcgtccctggcatgggtgaggtgggacgctagacccagtcctgacactggggcggtagataggaagggagaaggtggttttccctggaagagtttccatcgagttccagcwggctgggctgggagtggcaccagggaagggaacaggagcttggcgtgagccgcagtgcccagctctgagcctgcctcctccctcctgaccctcccaggtgcatggctcgaggctacgcctgctccaggtgaccccagctgattcaggggagtacgtgtgycrtgtggtcggcagctcaggtayccaggaagcctcagtccttgtcaccatccagcagcgccttagtggctcccactgtgagtgtctcgggggtcatgcaaatggtggagggctgggggaccccgactgcaccctcagcagctcccacaccctgccttacatctcaccctcccagcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccaggtacagggccagcaggtggggagggcaaaagcagggcacrccagcccccaatgggaagaggggggactctcagcacctcactctgtgctcattcagtcattcaamaaacattgagtatccttgctggatgggtcctagaccagtgctgagaatacagaaataaggctccctgacckcagggagatccacttctgcaccaaatctcactgaaaagctgctccgggycatgtcctgtgcctgacactgaagattccagatggaatgagacagttgcctgctctcaggcagctcgcaggctgtgggagccccagcaggatactgtgtcaacactccggagggccttaacaggctttctggaggggtgacaaaaggctagacgtccaccccagcccagagacaggccacatgccatgctgggagcttcacgaaggccactgaggaggcaaggcagggaggcccccagagtccaggggcagcggcagcagtgcccaagatgtggaggagctgcccacacctactgccatacctcctgccayctgcttcctgcagatcgtgggctcccggctgcggatccctcaggtgactccggcagactcgggcgagtacgtgtgtcacgtmagtaacggtgcaggctcccgggagacctcgctcatcgtcaccatccagggcagcggttcctcccacggtgagagcagagagggcagggggtmcagacaagtggcgcagagggtggcagagaggtccccggtgccatcrctgttatctcamtctggctgcgtggtccacacccgtctgtccccagtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccaggtacagagtggagccacagcagcgggggtggaaccatggtctcctggggtgagcagagcaggctccctgtctcacggattgggccctgggtagaccgatagcagcctcaacaggctgagcaggaaggcctgagccagctggtgaccccagcgtccctccactccctctccctctccttccccatccgcacgyccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccggtgagtctgcctaggaaagggacgagggatgcaggcaacagtgttccctggggagaaggaactttcaggtcagagtcctcagacytggtggtactcaggcaagggccagcrgaaagatgcgtgggttcagtggctacggctaccccatttctaacatttcaaattctcartagccacgtgtggcttgcagccactgacttggcctgtgcagataaaaagcatttccatcatcacaggaagtttacgaattttgtgagggttaagtgagttagtgcatgtaatgtgcttagagygtgcctggcatgccagaagtgctttataagtgttaactattattatcatttttttttttttgagagggagtctcgctctgtcacccaggctggagtgcagtggcgcgatctcaactcactgcaacttccgccttccaggttcaagcgattctcctgtctcagcttcccgagtagctgagactacaggcacatgccaccgtgcccggctaatttttgtatttttagtagagacaggatttcaccatattggtcaggctagtctcaaactcctgacctcaggtcatccacccacctcagcctcccaaagtgctgggattacaggcatgagccaccatgcccggccaagtgttaactattagtgttactctggggggtgagattttctatggcagagggtcccaccaaccctrttcccaaatctgacaacggctgtgccgactcactgatctctgttcccccagcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcaggtatgcagctggcaggaaatggtgggagagccgctggatgtgggggccctggctagctttgccaagagggagacctaggagccccygtggggtgcagtacccccctgtgtcagaggttagaccctggccccaggccttcaacagttccagactggcacctgactctgttcctctgtcctgtcccctattcagacccgcggctcacggctgcggctgcaccatgtgtccccggccgactcgggtgaatacgtgtgccgggtgatgggcagctctggccccctggaggcctcagtcctggtcaccatcraagcctctggctcaagtgctgtccacgtccccggtgagggtccctgcagtgggacgggaaggccgggggagggaggaagggacagagaccagggggcagaactggcagaaggaaacactttctggcactcggcgagaactgccgctctgattccagacttcacctcccgccacccrcacggtcccaggaccaaggagccggctcaggtggagtggttcctgtccctctccacggcttgcgagcataggctttggactatgctcatctgtgcatgagtcccagttcctctggccacacttggagatgttgcacaagggacctcagctttccacctgtcactgtcccttatctgtaaagaaggggtagtagtactcttgtactctactatctaattatagagttcccaaaagcctgggactgcacctctgcgagtattggagggtgatttacacatctttattagagccggtgtggtagctcccacctgaatcccagcactttgggaggccgaggtgggcagattgcctgagctcatgagttcgagaccagtctgggtaacatggtgaaaccccatctctactaaaaatacaaaaaattacctgggtgtggtggcgcctaccgttagtcctaactactcgagaggctgaagcacaagaatcacttgaacccaggaggcagaggttgcagtgagccaagattgcaccactgcactccagcctgggcaacaaagtgagactctgtctccaaaaataaataaataaataaataaacatctttattagtactggtggcatataagggacaaaaaaacacatcaagcctgtccttatttcttggaaatctttgcttacaatggggctaagtagttaaggttttttttgttttgttttgttttgagacggagtcttgctctgtcgcccaggctggagtgcagtggcatgacctcggctcactgcaatctccacctctggggttcaagcgattctcctgcctcagcctcctgagtagctgggattacaggtgtgctccaccacgcccagctaatttttgtatttttagtagagacggggtttcaccatgttggtcaggctggtctcgaactcctgacctcatgatccgcccagcccggcctcccaaagtgctgggattacaggcgtgagccaccgcgcccagtgtgtagttaaggcttttttaaagtgaatcagttgaaaggaaaatgtccagtaattaatagcacagggggcacatgctatgcagaaatcatgataaggggacacagattgctaagcagtaaacatgatccagcacttcttaggtgttggaccctatcatatttacacatattagttcattttatcctcacaacagccctttgaggtagatggcattgttctctccattttacagatggggaaactgagactcagagaggtgaagttgttttccaaaggtcatacaactaatcaatggcagagctgggatttgaacccaggcagtctggccccagagtctgggttcttagccacattctatctgagtctgccaaacattagtggtctagtggtctgtgtggaagtgtctagacctcagccctggccccactggtgctgggagcatgggaggaggaggagatggtggggccattgcctgggggcggggctgggggaatgagaagtgcctccacctcccaggctagcccagctgctccaggcctcaatggaacgggaagggaaagaagccatgtcccaaatggcctctggtcctagtatctgggccccaggggaagggctgagggcatcarggtgscatctcagctcactgacctctcccctgtgccccagccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtaaaggagctggagaaggatgcatgcatcctccacacctgcagtggtcctgcctgaatccagcgttgaagggaaagtggcctcagcaactggggcttgtgggaaatggcagcaggaggtcaatggaatcaggaagttgagagcgggctgggcacagcagggccaccaccagccccacagcaccttggtgcaaaatagaaaaggacatctctggctgggcgcrgtggctcatgtctataatcccagcactttgggaggccgaggcaggtggatcacttgaggtcaggagttcaaagccagcccggccaacatggcgaaacgaaaaacacaaaaattggccaggcatggtggcagatgcctgtaatcccagctactcaggaggctgaggcaggagaatcacttgaacccaggaggcagaggttgcggtgagccgagattgcaccactgcactccagcctggatgacagagcgagacactgtctcaaaaaaaaaagaaaaggacacctgttactcaaggctcttgacttcctcctgccggagaaaccatcataataaacatgccctccacaatgcggactgtcaaaggggtcgcctccaacakgatgcgcctacatatytgtgcatggcagtcccagggtgtgggtaccagaggcctgggcatctgaaggctcccagctcaccctccccgctctcaccccaccttggccaggtccayggcccactgctgaggctgaaccaggtgtccccggctgactctggcgagtactcgtgccaagtgaccggaagctcaggcaccctggaggcatctgtcctggtcacaattgagccctccagcccaggacccattcctggtgagtgatagggagcagtgggcgatgccagagcacaggcgcggggctccttcccagctctgctcctctcctctctcccagccgggcacttattgttgcctgcaggcggggtttcctaccacggaggatcaagccaacccaggtgttcccaagtctgacaatggtcccgtcccctcaaccagggggaccccagccctgagtttcaggaggacccttgagtccccagggaaaggagacccttcttaggttatatcagccactctcaagccaccgcgcccccaggatcaactggagctggtcttcactgccaccaccttcagcccctgccttgatcccyggagcctggcctctctcacccaccccctgtgcccacagctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccaggtacaggggccaggatggggaggattccaggtcaggcaagrttagacctgcagttgctttctgtacccaaacctcaygcaaacaccagcctgcttggggaccccaggggataaaatacgtttgsgggacgagttcaccagcctgcaaatcaggagacctgggtttttctcttggctctgcagctgaatcctttcctgggcctcagtttcctccactgtaaagtgagtgggttggacctctaggattctgtgaatgaagcttccaccagccctaccagctgrgaccctgagcttcygagagaactcttgggtaccggcacagttgggcttggggacattccttgtcctggggactttgccctgataactgtcccctcgctgctctgacagacccatggctcccagctgcggctccaccwcrtctcccctgccgactcaggcgagtatgtgtgtcgtgcagccrgcggcccaggccctgagcaagaagcctccttcacagtcaccgtcccgcccagtgaggggtcttcctaccgtgagtatggcagatgccatgggcaagrggggaagggagggccctgaagctaagcccacccctgctgagcccagccctctgcccctttggccccaggccttaggagcccggtcatctccatcgacccgcccagcagcaccgtgcagcagggccagratgccagcttcaagtgcctcatccatgacggggcagcccccatcagcctcgagtggaagacccggaaccaggagctggagggtgagccaggctggtgggcaggtgggcaagctgggggcaggcatgggggtgccgtcatccccactgtgcaagggtggggcagaagtctggacgccccacattcatggtgtggccctgagtaaggcccttcccgtctctgtatggcaagagcgctggacccaggagtttccaaggcctttgttacyttctgctatctgcgactccatgagctagacacamccaggccggagggattggggaagtgggcccaggggcacaggctggcagcaccaagacacragaaggaccaggtcaatcctctctcaccctcccccatgcaacctcacagacaacgtccacatcagtcccaatggctccatcatcaccatcgtgggcacccggcccagcaaccacggtacctaccgctgcgtggcctccaatgcctacggtgtggcccagagtgtggtgaacctcagtgtgcayggtgaggggacgttgaccctgtggggctctgccctgtttccagcmctgattctcagctcagagcctccaagtttaaatcctccttccaccattgactctgtcttgggcattctccctctctgagcctcagtttccacctcagtgcagtggggagacaggtgcccacccagcagttactaagctggaggccatggcagtgtgggtgagcagcagagccctgcctgtgtgtcagtggttgtcattcctyygcacagggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacrcggtgctgcaggtgaagccggggctgcctctctgggtctgaggcccagtccatggcccagccttgagcgggtgcttggaggagatagtagtggatgggcaggtggtgatgagtggatggagagaggaagggaggaatgggatgggatgggtggatgacgaatagactggaagatgagagggaagagagaaggaaggtaggagaaggaagaaagaatgagtgggagggtgggtcgaaggccaagtggatggatggactaatggggtgtcatgagggtgagccctcaagcaaccagatgggacagctaaaaaccaaggaaagggccaggcatggtggcacgtgcctgtaatcccagcactttgagaggctgaggcaggaagatcacttgagcccaagagtttgagaccagcctgggaggccaaagtgggtggatcacctgaggtcaggagttcgagaccaccctggccaatatggtgaaaccccgtctctactaaaaatacaaaattaggctgggtgcagtggctcacacctgtaatcctagcaatttgggaggctgaggcgggcggatcacaaggtcaggagattgagaccatcctggctaacatggtgaaaccccgtctctactaaaaatacaaaaaaattagccaggcgtgatggcgggtgcctatagtcccagctactcaggaggctgaggcaggagaatgatgtgaacctgggaggtagagctttcagtgagcagagatcgtgccacagcactgcagcctgggtgacagagcgagaccctcaaaaaacaaacaaacaaacaaaattagctgagtgtggtggcacatacctgtagtcccagctattcaggaggctgaggcgagaggattgcttgagcccaggaggcagaggttgcaatgagccagatggtgccactgcactccaacctgtgcgacagagtaagaccctgtctcaaaaaatraatatataaataagtaaataaatagataccaaggcagggtagaggaaayagggaagaccaagccagagctggggctgacatcagcgtccccactgagtccccacataaccagcctccttgctttctcccagatttcatcagctaaaccatcagatgcrggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggtgtgaccaagggctggcacatagggctggcagggcagggatgccctggggtctgaaatgtagacacatgtgatctagagatgatgtcatgcccaggggtggggagtacggggagaccrtgttgctagcatcccccagtgatggccgaggaacccaactggggtccccatagagggacaggatcacccagggcccttcctcaccatrgccaccctctgcgggtccctgaggtagcccagtgacttctgtcatcttccactcgactccacaggcagccccgygcccaccatccactggtccaagctgcgttccccactgccctggcagyaccggctggaaggtgacacactcatcataccccgggtagcccagcaggactcgggccagtacatctgcaatgccactagccctgcygggcacgctgaggccaccatcatcctgcacgtggagagtaaggcctcatcccttctttgtctgcaccaaatggagatctgagccccccgactaggctccaccccacacagaaccccaggaaccccatccagaggtctccaggcgctgcagggtcctggagcctgccctgcccgacacccacaccctggcctgggacctttgctttccttatccccagtcctctgggctcaccattcagcttccctggacactggatccaacgacctgctgccattctgacctttgccctccccaatcctgacctctgtgtccccccactcaggcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggtaagcagccccggctctgcgtggaaggggatcacctttcctcctggccctttgatgacccagctaggcagactcgggtgggaaggcctccctccataaccccacctggaatgccctcatctcccctactctccagggcccgaggcaggcttgccacctccaggaagccctccatcatgtgtgctcagctcctctagctctcacggctgctccccacctttggcacagccctggcactgccaaaggaaaccattctgtgtacataagcaccccagcctgcctcccctgccaggcagtgagaatgctcagggcagggcctggacccaggcatctcagcagccctgggcttaattgagggcaacaaggcccaggatgggctgggtaaatgcttgacagggacaacagtgaatgagtgacaggagcacccaccccagcacgcccagggcttcagtggatcttcagagagcccagcatttccatggcctcctgcatcaatgatacaaatgagggcttttgggccccaaacttaaagcagcacagcatgtagcccactggtcaagagcctggactgtggactcagacctgggttcaaagcacagcttggccatttgctggctgtgcaaccttggccaagtcactgaacctttttgagcctcagtttctttcttttttttttttttttttttttttgagacagaatctcactctttcacccaggctggagtgcagtggcatgatctcggttcactgcaacctccatctcccgagttcaagcctttctcgtgcctcagcctcccgagtagctggcactacaggcacgcgccaccacgcttggctaatttttgtgtttttagtagagaaggggattcgccatgttggccaggctggtctcgaactcctgacctcatgtgatccacccacctcagcctcccaaagtgctgggattaccggcgtgagccactgcactcgtcctgagcctcagtttctttatctgtaaagtggagagaacaatgccaaccatgtaggctgagttggaaaggtacacagaggtaaacacagatgtaaaactgtggctcgcagtaggcacttagtaaatggggacagtatgcatcagcccccgcctcccatctgtcccctgcatgtgtaggtgtctttgccatggccaagtccctggattctcttatttaaactgcaggcagaataggctttgctgtccttccttaaaatgtctgagtatggccgggcgcggtggctcacgcctgtaatcctagcaccttgggaggccgaggcaggcagattgcctgagctcaggagtttgagaccagcctgggcaacatggtgaaaccccrtctctactaaaatacaaaaaaaaaaaaaaaattagccaggcacggtggcgcacctgtagtctcagctactcrggaggctgaggcaggagaatcgcttgaacccgggaggtggacgttgcagtgagctgagatcgtgccactgcactccagcctgggaacagagcgagactccgtctcaaaaaaagtattgagtccctcccactcttttcgtggcctgccctccccacccagaagcgaggagctgtggaaacagagcccagcgctccacaggcccttatccatgttggtggaatggcagctgtgtgtgcagatgaatgaatctgccactgaacggtcttttttccctggtcagagaggctatcaggagaacattccttgaatgttgggctgggggtttcctgggtccctggaggggcatcagggacatcacacacacatatacctgcagaacctcatacatgtccccgcaggccctcccggctctctccctgccacctccatcccagcagggtccacgcccaccgtgcaggtcacgcctcagctagagaccaagagcattggggccagygttgagttccaytgtgctgtgcccagcgaccggggtacccagctccgttggttcaaggaagggggtcagctgcctccgggtcacagcgtgcaggatggggtgctccggtgagtggggccgggggcaggactggacttgggcagcatagcccagggctcacagtgagcagagttaaagcacctgccccagggkgcgcaacatgaagcactgtccttggacacatcactttacctctctgagcctcagtgktctcagctgtacagtgggttatataagactgaatgaggtccaggcacggtggctcatgcctgtaatcccagcactttgggaggctgaggcgggcagatcacctgaggtcaggagtttgagaccagcctggccaacatggtgaaaccctgcctctactaaaaatacaaaaaattaactgggtgtggtggtgggcacctgtaatcccaactacgctggaggctgaggcaggagaatcacttgaacccaggaggcggaagttgcagtgagccaagatcgcaccattgcactccaacctgggtgacaagagcaaaactccatctcaaaaagaaaaaagactgaaaggagattgtctgaagcacttgcacagtgcttggtgcttggaaggccttcagtaaacagtggcccattcatatttattattagcggaggaaagagaacaggccctggggccagaaatacacaaatgaccccagatctcagctctgctacttgataactgtgtaatcttgagccctagaccataaggtctttgtctaaaatgagtgtggtgccccccaacctgcctgcctacctctagtggttattgggaaactagaatgcaacactgcgtgctgttctacatcagtttttaatgcccacacaattgcaaagcattcttttttttttttttttttttgagatggaatcttactctgtcacccacgctggagtgcagtggcgcaatctcggcttactgcaacctccgcctcccgggttcaagcgtttctcgtgcctcagtctcccaagtatctgggattacaggcgtgtgccaccacgcctggctaatttttgtatgtttagtagaaacagggtttcaccatgttggccaggctggtctcaagctcctgatctcaagtgatgcgcckgcctcagcctcccaaagtgctgggattacaggcgtgagccaccacgcccagcccaattgcaaagcattctatcagttgttttcaactccctgatgtcttattattttttctttatagaatccagaacttggaccagagctgccaagggacgtatatatgccaggcccatggaccttgggggaaggcccaggccagtgcccagctggttatccaaggtaggagggtggcttcaggcctctgctaagagcagggaacagagatgagaaaggcagagaggcacaaggcccagaccctgttccctaggaatccccctaaatgtgtcagaataaagagaattattccattttgccttgcttgtgtctagcatagagtaaaaggggcttgatacatatttcaagggagggaagaaggatatggatggagtgtgtgagtgctcagatgaaccgatgaagattgaatcagtgtgaaccgggcatggtggaacgcacctgtagtcccacctactcaggaggctaagctgggagcattgcttgagcgcatgaattctaggctgtggtgagccgtgatcacacctgtgaatacaaccaagaccctttgtctaaaaaaaaaaaagaagtggacacgtgagtgagtaaatgcataagacctgacaagtgagtgtgtttgtgagtgaatgcatgaaaaagtgaatgaggagtgaatgaatgctggagcttcagtgctcacctttccttgggcagtctatggcctccctcgggccaggcctgcagtgactgatctcactggacctctgcctccctcctccccagccctgccctcggtgctcatcaacatccggacctctgtgcagaccgtggtggttggccacgccgtggagttcgaatgcctggcactgggtgaccccaagcctcaggtgacatggagcaaagttggagggcacctgyggccaggcattgtgcagagcggaggtgtygtcaggatcgcccacgtagagctggctgatgcgggacagtatcgctgcactgccaccaacgcagctggcaccacacaatcccacgtcctgctgcttgtgcaaggtgaaggccagtggggacttttgttgggggacagtgagtggggcaggggcttctcctgctgccatcttctgcctgcccgctctgctcttcctttctgttcacttgggacattttccattgtgtgtgtttaaggggcaggtttcataacaggtggcagcagcaggggataaaagtgagattcccccagggcagcctggaatgtacagggagagagctaggccatagagcatcaagaagaaaaaagaaaccttgtcctcatctgcagggagtgcctgctctgctgggagagacctgcagcatagtctgagggcagagacataacccagtcaacaaacagacctaatagagagtaaaacaaggacaacagatgcagggcagacacaaacactgtgtgttctttaaaggcaattcctttttaccccaagccctgtgacttgcctccaaacttycttacctatactgcccctagtgtgcacttctcaggtccccaaagggctgcacaattttttgmccaggcrtgttgaagaggtctcaggctgtggagtgaaatggatctggccctgaaccctgactctgcccgaccaggagcaaacagccgcttttcccctctgagccataatttcctcatctgtgaaatggaatgtagtggcttccttcaaggggtggtgtgaagatgaaatgaatcagggtgcaggctgggcacatatctgtgactgtcatgttgatggcctatgtctcttccatgcctctcagccttgccccagatctcaatgccccaagaagtccgtgtgcctgctggttctgcagctgtcttcccctgcatagcctcaggctaccccactcctgacatcagctggagcaaggtaagtgctggagagggaaccagcgggcatgacttgggggctgggaacagatctgaagcgtctcagtgtccccaggatgtggcacaggcttggccaagagcaaacgctcaatgttggaaggtgggcctgaggcacagatgggaggtgggcccctggagccrtgggccarggccagggccctcagtgctagtgcatttrcagctggatggcagcctgccacytgacagccgcctggagaacaacatgctgatgctgccctcagtccraccccaggacgcaggtacctacrtctgcaccgccactaaccgccagggcaaggtcaaagcctttgcccacctgcaggtgccaggtaagacaccacccctaagaattggcagtgccctgcccactccctgactggcagggtcttcagctgtgctctctgctggcagagcgggtggtgccctacttcacgcagaccccctactccttcctaccgctgcccaccatcaaggatgcctacaggaagttcgagatcaagatcaccttccggccygactcagccgatggtgagcaggagggttaatttgcggggtgggctggcctgggttgagggacctygtggagtaactgccatcatggcaggagccctggctgcccctcagtcctgccccaatccctcagccctccctctccagaagcccccagacctctgggcctccaccctggtgtgccttctcttgtgcctcccggcttctccatccctgcctctgtgatatctccagcctcctcgtggctcctctgccaccggggcatcacccccagtcctcctgtcccagcttcctttccccatctctgctccttcctccctcctctgcctccatctcaccctttcctcctctctttctctcgtctcttacgggtctctgactttcactgtccaggcctccttctctactcgggtgagtctctgcctccctctcccccttgagggagactccagtgtgtgtgaagcaaattcagtttctttctaggggcgctcagtaaggcccttgcgtttggggcaccagccctgagatagtgagaaggccctggctgtgtgaggagtgccagagggagggacaggttccgagagtggacaggctcaagagcttgggtggtttctagggtgggggaggacagggagcctgtggctggaagggggccccttacacagtggtgcccacccagggatgctgctgtacaatgggcagaagcgagtcccagggagccccaccaacctggccaaccggcagcccgacttcatctccttcggcctcgtkgggggaaggcccgagttccggtgagacccccagcctccccacctacagggggactggacacagggctttggtctggcaagtgctaccctgggctccattatacaaaggagatctggaggaaggagaaaatgtggccgttacccttggtgaccacccaatctgctagagtaggaatagtatgccagtcaggtggaggagggtgcaacctcagacttgggactgctgcaggccaggattcattcattcattcattcattcatgcatgcatgcatcagttatttgctgaccaccccatgtgtgccaggcactgatacaggtaaaacaaaacagaccaaattctggctcttgtgggaagaggtgtattctcactggggaagaataaacaagccataaacagagaaacaaggtgatcacagggagagaggagtcctcagaggaacaaggaggccaggtgctaggctgcagggcgctgagcctggggtccctgtgggctgctctgggaaagctcccagcaaaaggatgtggggagagaagatccaggggatgggtcacggggagggacgacaagacagggacaggaacgggaacagccccagggctgggactgcaggaagtggtgacatccctcctctgggacccctctayccaactgggcccctagcccttcttacaaaccccctatccactctctcctgccccggcctgccccacggagcaggttcgatgcaggctcaggcatggccaccatccgccatcccacaccactggccctgggccatttccacaccgtgaccctgctgcgcagcctcacccagggctccctgattgtgggtgacctggccccggtcaaygggacctcccaggtgagacccaaccccatactgctamttccagccctcatcccgcccttgcccagcctctgttgccattcctgacttccccacctccccagggcaagttccagggcctggatctgaacgaggaactctacctgggtggctatcctgactatggtgccatccccaaggcggggctgagcagcggcttcataggtgagccccctccccacctccagctgaggctgggccttacctggctggctggaagagccctggagagcctgggagggcacctcagggtatgggctgggacaccctgccctgtgctcatcctgcccactcacctcccaggctgtgtccgggagctgcgcatccagggcgaggagatcgtcttccatgacctcaacctcacggcgcacggcatctcccactgccccacctgtcgggaccggccctgccaggtgaccccacaccccacayaccacctggctgccgtggcctccacccctagccatggctggcccctgtggggattatggggggtactgaatgttctcggccttacttctgggggctgctttgcagaatggcggtcagtgccatgactctgagagcagcagctacgtgtgcgtctgcccagctggcttcaccgggagccgctgtgagcactcgcaggccctgcactgccatccaggtacgcaccccgacygccagtcgctgtcgccccagggcctgcctcttccctttgctgcctccccatatccaccaccatctcaaccactggggcacttccacaccccccactctcacctgagcactctccactcctcccatgtacccatcccccatctctgctacccgaaggccctcaccccatcactgctgcttcccctcctccagccctgctgaccaaattcttaccactaccccgccacccaggcactcccccacccccagcccatcttttttttttttttttttttttgagacgaagtttcgctcttgttgcccaggctggagtgcagtggcacgatctcagctcactgcaacttccacctcccgggttcaagcgattctcctgcctcagcctcctgagtagctgggaatacaagtgtctgccaccacccctggctaaattttttgcatttttagtagaggcggggtttcactacgttggccatggctggtcttgaactcctgacctcaggtgatccacccacctcggcctcccaaagtgctgggattacaggcatgagcccccacgcccggcccccagtcccatcttattacccaggtgcccaccccattacccgccaccaggtgctccccctccaacactgtccagtctctgaagaacctgcagacacacagagtccctcgactgcttcccctgcagtcctccctgtggcctcttctggctcccgccttgctctgctcagttccctcctccaaggcctcccaggaggctggcctggccctcactagcccagccccccggggtgtgatgggcagacctctggcatcaggacccccctccctccagagtcacctccgtgtcttttcactggcctatgtgccccccagaggcctgtgggccsgaygccacctgtgtgaaccggcctgacggtcgaggctacacctgccgctgccacctgggccgctcggggttgcggtgtgaggaaggtgaggggagccaggcctgagacccccagggtcctagtgtcagctggggaggctgggtggggcactctgaggccatgatgggccctacggatgataaaacgattcccaagccagaggmtctcgaagtcacctggccacatgtctgcccagcctgagccccttattgagtgagggcccccaaagaggacccctgtcatattggagctcctcccagccccgtgtgcaagggcaggggggctcctgtgccactgcagctggtgccaactggtcctgagcctctgggcctggagagtgaggcaggcaagggtcccagaggaaggcagartagctggaccccacccgagggtccaggatccccactgcctcagctgagctgtggctgctgcaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggyggccacctggagttccgctatgagttggggtcaggtaagcacccagcaccaaatgcrgggctctgcacrccaagccttgtgcccccctcggctcttcaagccccagggaggcatgggaggataaatgcagggatcagggcaagtcccctcttcctgtgcatttcgtctctgtgtcacttgaggccartccctagccctctctgagccatgggctcctcatctggaatacagaaggctgtagggcattccccatctgctcagggccctgtttgtggtggagagggcagggagccccgtgtgcccccatgtgcccaaccctgcctggcatcctccccagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtaagagcagcctcctcgggacaagcgggaggggaggggtgccaagccttgtgtccccctcggctctccaagcaccttggcattgggcccctccacctgcagccacccacgggccctgggccaggacactgtacctctgagcctcagtttcctcctctgtaaaatgggcatgatcacacctactttgaaaggttgggcagaggattgtctgcactgacggatgaatgtttctagcacacagtaggcactcaactcctgcgcctccctccccacaccgagaatccatgctaccactcagggcccaatgtgggctcccagctcccctctgctgcattcttctycctgctggtacacctgggtctctgcctcccaggcccctttagtccctcggtgtccctgtccccacaggtgtcagtgaatggcaaacggctggacctcacctacagtttcctaggcagccagggcatcgggcaatgctatgayagctccccatgtgagcgccagccttgccaacatggtgccacgtgcatgcccgctggcgagtatgagttccagtgcctgtgtcgagatggattcaaaggtgggaaagcctgcccagggcaccggaggggaggggcacaggtggtcagcgacacctccagcccatgcccacccacccactcgcctctgccctggcccacaggagacctgtgtgagcacgaggagaacccctgccagctccgtgaaccctgtctgcatgggggcacctgccagggcacccgctgcctctgcctccctggcttctctggcccacgctgccaacaaggtacccaggcctggcttctctccacttcatytctgtcttggggccccggagctcgacatagtacccacgggtgtctatgcccaccaactggaccctgcccttctccataggctctggacatggcatagcagagtccgactggcatcttgaaggcagcgggggcaatggtgagtacttgccatggcctcctccccagcttcagctcagctcactcttccagttaccccacaccctcaattctggcctgcaagcaaaacagctttatatgaggagcttgctgggcagagagacagaatgaagaccacagccatgtggagctagggcctgccccacacttactggctgggtgaccttgggcaggcctttgaaaccactctgacctcagtttcctcctctgtattcatgtattcagtcaacaaactattgttgcccatccttgccctgagagcagtaaatataagatgcataaagcaagaccctcattcccaagaattccaccgtctactgaaaagctaaggaaacagtgaagagtgaatgctgattgaatgtttacggacactgtgctaacccctttacagacacatctcttcttatgtatcactaatataataggcgaggcagtggtatagtgggtaagagtatagacttggagccagcctgcttgggttcaaatcctagctctcccacttactagctgtggaactttgggtgagtcgcttaacctctctgtgcctcatataaaatggagatgagtaacatctttccctaaagatttggataaaattttatgtgagagtaaaattacttagtgcatttttttttaaggtggagtcttgctctttcacccaggctggagtgcagtggcacaatctcggctcactgcaacccccgcctcccagactcaagcgattctgctgcctcagcttcctgagtagctgggattacaggtgcctgccaccacaccccgctaatttttgtattttttgtagggatggggtttcaccatgttggccaggcctgtctctaactcctgacctcaggtgatccgccccccttggcttcctaaagtgctggattacaggcgtaagccaccgtcctaaagtgctggattacaggcataagccaccgcgcccggccacttagtgcattttaaatgcctagaacaatgtgtggtacagagtcagtacagaatgttagctgttgttaatattatgttcagctggccgggcacactggctcacgcctgtaatcccagcactttaggaagctgaagcgggcagatcacctgaggttgggaatttgagaccagcctgaccaacatggagaaaccccatctctactaaaaatacaaaattagctgggcgtggtggcacatgcctataatcccagctactccggaggctgaggcaggagaatcgcttgaacctgggaggtggaggttgccatgagccaagattgcatgcaccattgcactccagcctgggcaacaagagcgaaactccctctcaaaaaaaaatactatattcagctgggtatggtgactcacgcctataatcccagcactttgggaggctgtggcgggcagattgcttgagcccaggagttccagaccagcctgggcaacaaggcgaaatcctgtctctacaaaaaaatacaaaaagtagctgggcatggtggtgctcatctatggtcccagctactcaggagacaggcaggaggattgcttgagcccaggagttcaagatcaacctgggcaacacagggagacctcatctctacaagaaatttaagaattagctgggtgtggtggcacatggctatggtcccagctgaggcagaaggatcacttgagcccaggaggtcgaggctgtagtgagctacaattgtgtcactgcactctagcctgggcaacagactgagaccctgtctcaaaaaaataaaaaataaggctgggtgcggtggctcacacctgtcatcccagcactttgggaggacaaggtgggtggatcacctgagatcagttcgagaccagcctggccaacatggcgaaaccccatctctactaaaaatacaaaaattagccaggtgtggtggtgcacacctgtagtcccagctactcgggaggccaaggcaggagaattgcttgaacctgggaggtgggggttgtagtgaaccaagattgtgccactgcactccagcctgggccacggagcgagactccatctcaaaaataaataaataaaataaaaattatctatatataatattcattcatagggttgttgtaaggattgagttaaatgcagtggtgtctgtagctggatgggacgctccccgcacagccacatcataggtgttaggtaaatgtcagccgttctcctcatcatttggtggagggtagcagagggtcccctactcttgtcccctgccagagctactgtggccagtgccggcctgtgggatgggtcatgagcagatagggctgggggggtgtggagccacacacagtatggacatcctgggccagtcactcgcccaagcctgcctgctcttctgtaagatggagagaacaccaaggctctgaaccatttattgccacagtccaaggtgaccaacggtcccagtagctccggactgaggggtttcttgggatgtgggactttcagggctaaagccagacagaatttggcaagtagaatggcgggtcacccgacacggatcctgttgactacacaaaataaaataaaataaaatacattgatttaaggaaagcaattatgctgaagtaaagtaatcaaaacatgttttaagtttcctgacttgctatatatgtgcttctttattaacacatcaaataacaagatctggtgatctcagtagctaccacaatttcaaagcagcaatatgtgtaaatgatattttgaaatatttgcagctactgtcatgtgataagcaaatactagtaacaaagttgcaggtcctaccactgctactttggtttcttgcctacatctcattgaaagaactgctcaatttcagtgagaagtgagtgaaattgaggtgtaatgctttcccatccaaggtcataggctccctgaattctgttggcagcccccgtgggtccccagggactgcaggctcggagccccctagtcctgcatgttggcgtggaggtgggggtcaggggaactgacgggggattttgatgcctgatgcagcaggtatggcaccaccctcctctctcccacagatgcccctgggcagtacggagcctatttccacgatgatggcttcctcgccttccctggccatgtcttctccaggaggtgagactggcattggaagggcccatgggcctaatggggaggatgggaatctgggacttctgtcccctcacccgctcttcctccgcagcctgcccgaggtgcccgagaccatcgagctggaggttcggaccagcacagccagtggcctcctgctctggcagggtgtggtgagtgtgggtatccggctgggctcttggggctcctggggcaggaagctggcttcctggtggccggagtggtggggggaggggaaagcagagccccctggcctcggcagcctctgctctccaggctggggaccccagagaccctgtgcttccctggcaggaggtgggagaggccggccaaggcaaggacttcatcagcctcgggcttcaagacgggcaccttgtcttcaggtaggtcctggcacctggcccttcctctcccttccctggtcccagcaccccaccccccggtcctgccccagctcatacttcttgggcctggatgactgcaggtaccagctgggtagtggggaggcccgcctggtctctgaggaccccatcaatgacggcgagtggcaccgggtgacagcactgcggtaagggaccctgccgggcactcgggatggggcccagcgttctggagtggggcaggacgccccctaccatgggcagagaggcaggtattgagctctgtggagacagaacttgaagccaggggaggggagaacccaccagccagggctcrggcttccatctcggactgaactccgctgggggcaggcgagtgccccaggagtgggaggaaacctgggtgcagaaatgaggaagctgtgtttgtggggcccgatctctcgttcagcgggggaaagaaagagcttgggaaacagggacagacttctgagtctggagtctcgatatcagagggaggggactctgtcgtggggccggggagraccaggaagtttgtggaaaggggcctgacccagttccactgcagggagggccgcagaggttccatccaagtcgacggtgaggagctggtcagcggcmggtscccaggtcccaacgtggcagtcaacgccaagggcarcrtctacatcggtaagtctggggctccttctcagggcaggggcaggaacggcactcccttagggctagagctcgcccagccttcctcgcctcctgggctgctggagcccacaggccctgtcctctcacctcccggcaggcggagcccctgacgtggccacgctgaccgggggcagattctcctcrggcatcacaggctgtgtcaagaacctggtgctgcactyggcccgacccggcgccccgcccccacagccyctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctmccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaastgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccacccsctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagamaacggacggacggatgccgctggtgctcaggaagagctagtgccttaggtgggggaaggcaggactcacgactgagagagasaggagggggatatgaccaccctgccccatctgcaggagcctgaagrtccagctcaagtgccatcctgccagtggcccccagactgtggggttgggaygcctggcctctgtgtcctagaagggaccctcctgtggtctttgtcttgatttttcttaataaacggtgctatccccgccaggggcctcctgagtctttgatgagggcttcactcagtggagcctgtggatggggcagagcagggcaggtgagatctgggggtgaagcaagctggcttgggatcagcgaggcccccaggcccccaaccctgtgaggcaggaattgtcctattttctagaggggcagctgagtctcagagggttagggggcctgtccaacatcagacagagagccagggggttagaacccaaagagtctgaccccagagcctagtatcattcccatgtgcccgaagcccctctagggatggcctccctgatcctataaggctgggccactcaactgcagccccctggggagacctggctgggacatgggtagcacgtggtacaggctgtgctgcagtggaggcagaggccacgggcaccaggttgccaggccagccagctgggagagcaacagcaccagaggaggcccaggaggaggccagcagaggccaggagcatcgaggaggccagcgccacccctcagagctgggggcctgtgggaagagaaagtccactcaggcctcggcctgggtcctctgccccgtcyccatcacctagagagggacaggtatgattttggtgggaagagtaggagcaaggtgtaaccttccaaagctgcgtcttgtctcgtggggtccctgcctgctggggaactcctctcagctgcaatccagagggatcctgcagacccgagagctggggagggagtcagggatctggaggtatgggcatctgtacttcctgtctggctgggcaccggagagggacctgcatgggaaagaacagaactagcacactgagaactgccctttctgggacacttgtgtgtttcattcaatcctcacaagacttccctgagtttgtcactctgtgtttccattttacagagaggttgtcacttgccgagttcaattagctggaagtgataggaggacttgaactcacatggtctggctccagggcctaaggtctatgagtggagctacttcccaaggaagagggtgtacatgtactgagcattgaggcagggtctcactctgtcgcccaggctggagtccagtggcgcaatcaccactcactgcaacttctgcctcccaggctcaagtgatcctcctacctcagcctcccgagtagctgggactaccagcacgtgccaccatgcctggctaatttttctattttttgtagagacgggatctcactatgttgcccaagctggtctcgactcctgagctcaagcaatccacctgcctcagcctcccaaaatgctgggattccaggcgtgagccaccatgcccggccatgagcattttctgtgcatcaagcaccacactctgtgctgggcccgttacctatgtatgccactcacagtttacaacaactctgaagggtgaggtttatccccatttcacagataaggaaactgaggcatagaggttccttcttccattcatttgactagtatttcttgagcatctcctatgcccccaggcatggctctagcaactgggggatacaaccatgagcacatgacaaatatgtcttcatggcactgggagtttagtgtggggagaaacaaaacacatgaatagaatttatgtctaaaggagatagatgctagtgagaaaaattaygcatgttggtgggggcagggctgccgcttttcttttcttttctttttttttttttttttttgagacggagtctcgctctgtcgcccaggctggagtgcagtggcaggatctcggctcactgcaagctccgccttccgggttcacgccattctcctgcctcagcctcccgagtagccgggactacaggtgcccgccactgcgcccagctaattttttgtatttttagtagagacggggtttcactgtggtctcgatctcctgacctcgtgatcctcccgcctctgcctcccaaagtgctgggattacaggcgtgagccaccgcgcccagcgggctgccgcttttcttactgtggcaaagcacataacgtttaccatttaaccatggttaggggtacagttcagtggcattaaatatattctgatagagtttggatctgtgttcccacccaaatctcaggtcaaattgtaattcccagtgttggaggtggggcctggtaggaagtgattagatcatgggggtggatttctcatgaatagtttagcaccatccgtttggtgctgttctcaagatagtgagttctctcaagatctggttgtttaaaagtgtgcagtgcctccccactcactctctcttgctcctactctggctgtgcctgctcccctcgccttctgccaagattgtaagtttcttgaggcatcccctgaagctgagcagatgccagcatcatgcttcctgtatagcctgcagaactgtgagataattaaacctcttttctttataaagtacccagtctcaggtgtttttttatagcaatgcgagaatggactaatacgcactcacattgtgcagccatcaccgccatccatctccagaactttgtatctgcccaaacggaaactccatcaactccgtcaattccattaactccatatcctccttgtccccacccccccagcccctagtgaccatggctctacttcctgtctctgtgattttgactattctaatatacatatgtatatgcttataaagaaaatttataattttcttataaatttataaagaaaggtaatttataaatttataaatttataaaggtaatttataaagaaaagaggtttaattgtctcagttctgcaggctgtacaggaagcatatctaatatacatattagaatataataataagttactaataataactttttttttgagacagtttcgctcttgttgctcaagctggagtgcaaccgtgcgatctcggctcaccgcaacctatgcctcccgggttcaagtgattctcctgccttagcctcccaagtagctgggactacaggcatatgccaccacgcccagctaattttgtatttttagtacagatggggtttctccatgttggtcaggttggtctcgaactcccgactacaggtgatccgcccacctcggcctcccaaagtgctgggattacaggcgtgagccaccgcacctggccagggttgctatttttatataaaggagtcagggaagaacttaaagagacccaccaggaagcaaaggaacgagcttgcaatgcagatctcagaagaaaagtcttctggtagaggacacagctactgcaaaggccagaacaaagctggagtgtggaggggaggcggggccagggagggggtggggcagggaggaggcggggccagggaggggtggggcggggggcggggccaggaaggaagaggcgaggccaggaaagaaggggcagggccagatcgtgcagggcctttgagcccgggcgaggctttgcctttgctgaatgtgatgagggttttgagcaggatagtgacataacctgatttactgttttaaaaggtacctctggcggggaagcataactccccactcaagtgggctatacatagtgacttcccaagaatacagtggggaaagatgggaccaaaagtaacggtggagaaatgaggcagacatcagccaggcggtcaaggtcagcgtcaaccaccgtccaacaccaaacacccaacaccaaagtcatgtttggtgtgatgtgatgtgatgaagatggcatttcacctctgtgaactgtaactctagtcttttcatgagaaaagtatcaaataaatcccaatagtggggcatcctacaaaatccctgagcagtactcacaactgtcaagatcattaaaaacaaggaaatcctgagaaactgccacagccaaggggagcctaaagaggcatgatgactattaatgaatgtaacatgaggccgggtgcggaggctcacgcctgtaatcccagcactttgggaggccaaggcgggtggatcacttgaggtcaggagtttgagaccagcctgtccaacatggagaaatcccgtctctactaaaaatacaaaaattagctgagcgtggtggtgtgcacctgtaatcccagcactttgggaggccaaggcgggtggatcacttgaggtcaggagtttgagaccagcctgtccaacatggagaaatcccgtctctactaaaaatacaaaaattagctgagcgtggtggtgtgcacctgtaatcccagctacaccggaggctgaggcaggagaatcgcttgaaccagggaggcagaggttgcagtgagccgagatcacgccactgcagtctgtctagcctaggcgacagagcaagactctatctgaaaaaaagtaataaaataaataaataaataaatgtaacatgagatgctgagtgggatcccgggacagaaaaaggacatgaggtaaaaactagggaaaactgaacaaactgtggactttagttaataatattacttcattaattaaaacaaatgtctcatactaatgtaaaatgtcagtaatagcacccaaactgagtgctgggtatatgagaattttctgtactatcttctcaatttttttgtaaatctaaaactgccctaaaaaatgaagttcatgcaatcccagcactttgggaggccaaggtgggaagatcttgagtccaggagttcgagactagcccttgcaatacagtgagacctcatctctacagaaaacacaaaaattagctgggcatggtggtgcatgtgtggtcccagctactctgggggctgaggtgggaggatcacctgagcccaggaagcagaggttgcagtgagccgagatggcgccactgcactccagcctggataacagaatgagaacctatctcaaaacaataaataagtaagttcatttgaaaaaaagaaaaagaaaaagaaggctcccccaggcttccttcttcctgtgttgtcagaggcaaaggacagaaggagggagaccagttcagaagttattagaacaacccagacgagagctggtggtggctcagaccaggtgatggcagagcaggtgtgagaagggtcagagtctggagagctttcaaaggacttgtcactggcttggttatgggttataggctatgggttaagcggggagtaaaagatgactcagtgaggcctgggcagctggaatgtgaagtcgctgctcagcgagagggaagcaggatgcagggagggctgtggacaaggagtccagtatggggcaagttaagtttgagatttcgcctatacatccacgcagagatgctgagcagggaggaggttatgtggctgaagttcaaagacaagtcccacaggtgatacgatataaatgagacccacaagggaatgagcctggatggaggacaaggggacataggacctgggtctcatggcacaaagcatacagcatcagggaaatgaccaggaacctgcaaaaaaggctgagcgggggatggggaaggtaagtgtgtggggttctgggaaactgcatttcacccctgttcaactgtacatggcagccctacctccatcccactcctaattgggtgtggtgggcaggtgggacatctttagatccccaggaaggttattcctgggtgatttgttctggtcccttccaccaaccctagccctcctatcccactcccctgtctacagagatcattcctgctcattttactcactggctttatgaccttgggcaagtcacttctctctaggcctcagtttcctgatctgtaaagtgtgggaatcagactggattgatggttttcaaagtatgtcttgagggtgacactcagggccctcagagagacatcaggcagccagggccccaggcccaccatccagttaagcagaggatatctcctttgaatgtcttgggcctccatgccaggtcccatttagcaaaagtttccaccactaaagcatcatttggaatccgccggatgagatcatctgcagca

SEQ ID NO: 17634 - DNA, 12884 bp, Homo sapiens
gagaccatcctggctaacatggtgaaaccccgtctctactaaaaatacaaaaaaattagccaggtgtggtggcgggcgcctgtagtcccagctacccggcaggctgaggcaggagaatggcgtgaacccaggaagctgagcttgtagtgagccgagatcgcaccactgtactccccgcctgggcgacagagtcagactccgcctcaaaaaaacaacaaaaaaaaaaacaacacagaaacccaacagagacctgaagacgtgcctgcctcccccatctccgggacctctcccacctgggtgaagggggcacgtgagcctcacctgatcttgaccatctcagctaaaacactgaaccacccttggcacccaccagcagcagacggagaagaactgtatagggtgcaaaagcgccccgccaccatcaggtccagatgaaaacctacaagttgaatcagcaaggtgctgacggatacgcaagcagaaaccctcttataggaggttcaaggctgggcgcagtggctcactcctgtaatcccagcactttgggaggccaaggcgagcagatcacttgaggtcaggagcctcagaccagcctggccgatatggcaaaaccctgtctgtactaaaaatacaaaaattagccaggcatggtggggggtgcctgtaatcccagctactcggaagcctgaggcaggagaatcgcttgaacctgggatgtggaggttgcagtgagctgggacagcaccatttccctccagctcgggtgacagcaagaccctgtctcaaaaaaaaaaaaaaagtttgagaatgtcagacaaggcagcaccctgtgtaggtgctcaggttgggcggagtctctctcgggggaggggggtaacaggacagcgcctcccggggcctccttgcatgtctgtgtcctgatgcacagcaggcgggggctgcggggaccagagaaggaagaagcgccccagctgggcacttcccgaggaggaagtggtgccggaatttcccccaggtgtggcctcaggtataagagcggctgctgccaggtgcatggccaggtgcacctgtgggattgccgccaggtgtgcaggccgctccaagcccagcctgccccgctgccgccaccatgacggtgagcctctccacatgccgctcggatggatgctgcttggatgtgcagcctggcatggaagggctggggttctctgagcctgggaggagggtgttgggatggggtctgggaaacccctcagtctgggggtaggggaggcagctgcagatcctcggagcgctggcatgctgggtgtcttgggctgaagggctagcctctctgggcttcagtttccccatctatagagggagggctgtactccatctttccgctgggaacaaggaaagctgaggtggaagtgaggtgccccctgccctgggcacctcctaaccacccacctgcctgtttcaccagctcctccccggcctcctgtttctgacctggctgcacacatgcctggcccaccatgacccctccctcagggggcacccccacagtcacggtaccccacactgctactcggctgaggaactgcccctcggccaggcccccccacacctgctggctcgaggtgccaagtgggggcaggctttgcctgtagccctggtgtccagcctggaggcagcaagccacagggggaggcacgagaggccctcagctacgacccagtgcccggtgctgcggccggaggaggtgttggaggcagacacccaccagcgctccatctcaccctggagataccggtgaggacctggggattccgctgtggcgtggggctgcccctcccctggcggggccctgactgcccggagagctctctgggccttggcggttctcacctgtcaagtgggcgtggccacctgagctccctccctccggccctcctgacctggacggctgagctgctgcttgcggctggccgtgccctgcctcccactgtcctaggtggccagggtcccctggggaaattctgggcccgtcacctgagctcctgcagaagtggggctgggtgatgaagtggaagggaggctcctagaggcctccggaccctgctctgtgctcttggagggccctggggagacgtggattaccaccacatgtgagcccgactgcaccccaagcccgtgtggctcagccctcgctgcctcaggtcctatcctgagtacacggagaggggccctgaggggagaggggcctccaggaggacagggtagggccagagactcactgtgcaccccgtcccgcagtgtggacacggatgaggaccgctatccacagaagctggccttcgccgagtgcctgtgcagaggctgtatcgatgcacggacgggccgcgagacagctgcgctcaactcygtgcggctgctccagagcctgctggtgctgcgccgccggccctgctcccgcgacggctcggggctccccacacctggggcctttgccttccacaccgagttcatccacgtccccgtcggctgcacctgcgtgctgccccgttcagtgtgaccgccgaggccgtggggcccctagactggacacgtgtgctccccagagggcaccccctatttatgtgtatttattgttatttatatgcctcccccaacactacccttggggtctgggcattccccgtgtctggaggacagccccccactgttctcctcatctccagcctcagtagttgggggtagaaggagctcagcacctcttccagcccttaaagctgcagaaaaggtgtcacacggctgcctgtaccttggctccctgtcctgctcccggcttcccttaccctatcactggcctcaggcccccgcaggctgcctcttcccaacctccttggaagtacccctgtttcttaaacaattatttaagtgtacgtgtattattaaactgatgaacacatccccagaggccaacattcaatgcgacattctcccgttcagccctggtccaggccagccatggacccaattctggggtgtccttccagaaaggtctacgcagccgcgagcagtgcatgcaggtgggactgagctgtagcacgggggggtcacaggtgtccctgctctgcccacacagtgtctcccctgaggacacccctgggaacaggaaccagcctccttcctcaagcagtgccttgagccctatgctttgtaatgatgtgagcgcctaggggcaccctctcggcccccaaggcaagtctctgaggatgaactgmagggctgtcggctcaaggcagggcccccagccttcgtggttcggatcaacatccaaggccaagcgccctccctgatggtgaactagccacgcttcgggacccaggctctgttggagattttagttaaggggccccggggggagcagccccagtcgtggaaagggggcccaggcctgtgacagtctcagggtctcagtctctaggcccccggccccaagggctgacattgccatggggctgctgggcagttgttagcccctcccctgcctggccccctggctcacccacctactgcgyccaggtgcctggagatgggggtsggggtgctgcacagaagaacaaggactccactcagactcccaaagcaagaggcctcagggaagacttcctggaggtggtggcccttgtccaggagatggaattttcattcaacacatttattgagtttcttttctttcttgaaaaagggtctcgctctgttgcccaggctggagtgcagtgtggtatgacttcagctcactgccacccccaccttctgagttcaagcgatcctcccagctcagcttcccagtacaggcgtgcaccaccacacccaactcatatttgtatttttagtggaggcggggtttcgccatgttggccaggttggtctcgaactcctgagctcaagtgatcctcccacctcggcctcccagagtgctgggattacaggcgtgagccaccgcacccagccatatgagtttctactaagcacctggcactgggaacaggccgagaacaaaatggtgaaaacccttcctgcctccacggtgactaatgaaacaagtggtgtgtagtctgtgagtgagtccaggacagaggctctgggggaggggctgcagttcttttttttttttttgaggagtctcgctctggcccaggctggagtgcaatggtgcgatctcggctcactgcaagctccgcctcccgggttcacgccattctcctgcctcagcctcctgagtagctgggactacaggcgcccgccaccacgcccggctaattttttgtatttttagtagagacggggtttcaccgtgttagccaggatggtctcgatctcctgacctcatgatctgcccgcctcggcctcccaaagtgctgggattacaggcgtgagccaccgcgcccggccaaggggctgcagttctaagcagagggtcagggaggcctcgaagacctgaaggggaggaggaaggagccaggcagccatgcagggaacagctccaggcagcaggaagagcccatgcaaaggccctgagaagacacatgctgcgtgtgtccaagggtcagagagtggcctgcgtggctgatgccaggtgagagggggaccgcaggggcagggcagggcgctgggggtgcagatcatgtctgccctggggccatcagaagcttgtggctgtcactggaggtagctgagcctgtgggttctgagcctgcggattctgagccggaggcactggggtgaggctttgggtttcaatggcagcatcaggatggtttcaggggatgagggcagagcgggaggcggcaggtggcctgggtggggatggcccatgtagctggggtctggatttgggccaggattggatgtggggtgtgggggtttcaagggtgacctgaagcttggtgacctggggggacggctgagatgaggctggattgagacgtctgtatggtgccgagtgttggctggtggggggtggattctgaaggcccccaggaacagaggaccctggctctgaagtgtgagttgctgggagagcaggtggacaagcagcaggcaagggcttctccggcctcaggggagtgggtgccttggcgagagcccaaaggtgggggacgtggctgaygccgggcaaagctttgggggcaccgggctggggtggtggtgaggacctgtgggcaggtgtgtgtgcagccagccacagcctccgcacaagtgaggggaaggggtggccagaagcccctgcaacttggcctgagcgtcctgggcagctggggggccccccagcatcagtgtgggggcaaacaaggccacatccgccaccagcttcaccccagcttctacggaaaagaggcgcagggtagaggctcaccacgtggctccgaccctgttcccttttcacttaacgccagcggcctcctctggaatccaagccccttagggaggcgttaggtgtggagggcctgcagggcctgcaggagctgtcaagggaggactctgctgcctcctccaggcccgggaggacctttctagggaggcacacacctggaatccaggtactatatttcgtggaatatacggtacccgggatttcgtgtgctgctgagaaggaaggcgatgctgatgttaatgaaactggaatgcggcccggctggcaggaaacggggtgcctgcccaggcctcgggaaccatcgctaccccagccccgcccaccggccccaggcagaggctcacgcgctcccggcttcgctgcatttattgcaggtgggtgcacctggcgggagggcaggtccggggcgaggtcacacgacctcgtcggtcaccgggatggggttgacctggggacctcccgggggtccccccgccgccgccgcagcctcctcctcgctgggcttcttgcgggcctcggccgggggccgcggcggggggttgcsgggcggctgcttgatggtgcctccgatctgcggccgctcccggggcttgggctcgatgggcgtccactgctcgccacgcacagccgcctgcggggcactgaagggttgagccgcgccccagcgcccgccctccctccctccctccctccccggaggcccaccccgctaggggccctgggacaggctcaagtctgaatcccacgcaggatggtgtgactgccactcagagaggttaagtgacgcgcccgaggccacacagccaggacctgggtcggcctgacaccagcccaagctatttcttcatgccaggagtggggcccgaacccctgggcttctggaagatcccgtggtggacactcccagatgcaaattctagtactcaaattctcctctcaaggtgccaagggcagggaaggcagggaggcaggcccgaggtccagcaggaggggtggcccaggagagtagcaggccctgctccgtctggtgggcgccattcacccacgctggccggcagccccccaagggtgcccaggcatttctgcacatgggggtggtggggggagagcttgaagaccacgggattccactggcttttactaaaaatacagactcctgggcccatgcccggaggttccactgcaacaggtcaagtggacctgggagtgtgtgcttttcatcttctatcccataatatctggtggaaaaatatgtcacatcatatacgtcatgaacagaaagagaaactggacatgtgtgatcctacctgactccaaaacggaaacattccattctgaaaagcaaaactagaaggctgatagaagaaaaggcaggaacgtgaaggcaggacccagggccagggaaaggtgttttcacaaagcacagaccatagagcaggtgaacagggaaacctctgctcttccgtgcagtgaaggactccacgcgccaagttaacagaccctcaccagaaagcatgaaggcatccccagtgtttaaaggttacaaaggctaaatagctaaaatatatgtggacttcctgcaacttaagaaaaagacaatcaggccgggcgcggtggctcacgcctgtaatcccagcactttgggaggccgaggcgggcggatcacaaggtcaaggagatccagaccatcctggctaacgcggtgaaaccccgtctctactaaaaataccaaaaattagccaggcatggtggcacgtgcctgtagtcccagctactcgggaggctgaggcaggagaattgcttgaacccaggaggcgaaggttgcagtgagccgagatcacgccactgcactccagcctgggcgatggcgcgagactccatctcaaaaaaaaaagaagaaaaagaaaaatacaaaaaccacaatagaaaaatgggcaaaggatttgaacaggcaactcaagggagaagaaactccaacagctcaaatccacagtcagagaagggcgagtccaagctccacacggccagctcgtgctgtgaaactggcaagcgtgggagaaagcctagtgcatggtgggagagatggggccacatggctggtggtgggttgtctgctggggagcagctgagcccggcagggtgaacggtgcagaggctgatgcctgacccagcaattcctctctgggtttagcacaaggaattcctcccgaggtctccaggagccactagctgtgcgtggcagcagggagacgggggggatgcgggtggcccccggaaaacaaagcaacagcccagatgagcacttggcaacaggaaggggttctaaaggagagttctgccggtggcaggtcagtgaggcttgaaacagaactccacttccatacgcggaaggcgtacacagaaagtgctgcacctttcccacgcacacacactagaagacgcacagcaaggggagggcagttgcctctgckggcaggagggacttggctctatggacaaaaggatttaaataagcaaagtctgagggctctgtccacccagagacccccgcagtgagaggtggcctgcagccgtctgttccggagcccagggcaggcagagggcatttcacccaaggcctggccaggctgcgccctgtcctcccacccatccctggcctctcagagagatcactgtatcccatgggatgggcagccttctaacagggtgcagcagtcataaaccaaacgcaggtgtcggcagtttaagaaaatgtctgcgtcctggcaccgcccatgaatcagcgcgaatagggtttaggtgagaaaagcctgataatgggacccaagcgcaggcacggtcttcggccggctgcgtgaccccaggccagtcacagcacctccctgagcctccgcatctttgtctgtaaagtggggaccccagtacccctcccagggctgtggtgcgggttaatgaggaaatgcaaggaaatgacccgacacactagacacgccaaaaatggcagcagcaaccgctgcgtccccgccgtgctgtgagcacacgcccaggctcacacttgctcccagccttggctcagcctacagagccggcttcaagggccatgcgtgtccgagggtgtcagggcaggggctggggatgggggtggccggggccgacctcagagggcgccactcaccagtaggtagatgccgctcgcaatggccaggcaggcggtcccaaggatggtggccagcaggaagccggcgggcaccgagagcctgggggacagcgggtgagaggcagggacacagaagggcactcagaaaggggaacggagccccaggtctgggggccaaggccacaaagtctcaggacaaggcagactgcagacccaggggacgtgcgcggaccggggcttgtttcggtcctgggtgttctcagccttgatgtggacactagcggctctggtgcacttgctcggaggaagcagccacgtgtgggtgtcctggcctcagccggcagtaaccagcagacacacagcacggaaccctccaccctaccaggaagcccaggcaagaccccccagcagtgcatgctgaccccagaccctggcgacggatcggagctcctcggatttggagtggatccttacaaatcctgcacactagacagcagacacaggccctgccagagccagggacccgaatttttgtttggaaaaacactgaggtaagtgggggtggctcctgtccaggcagcccggccggtgggacagtggggagggtcggctccaagccctcctgagccctagagggggtgcgggacggggactcacaggagatgcaggacggcccgaacatagtaattcctggtaaagggcccgaacagcttcaccacggcggtcatgtacttctgtcccctgggggagggaggaaggcgagacggcgcggctgggcctctcccactcgggactcctttgctgccctgctgaccaccccagggcacccaggcctctttcctcccacaaaacacaccgggcaggcaccggccttggtttacccacaagcaccaaagggttggttccggagcctccaagtgagaaaccaagctccacccaaccctgtgagccctgcctgggccccgcaacccccggagagaccccagagcaggaggagactcaccagcgctccatggtggagcccttcttcctcttcccccgggggtactccagcaggcacacaaacacgcccgccacactgaagccatgtggttaaggaacagcccagctcagcctgaggggccacagggaactccctttactgaagacaacacagagaggggcccgagcacggtggctcatgcctggaatcccagcattttgggaggctgaggcgggaggatcactggagcccaggagtttgagaccagcctgggcaacatagtgagaccctcatctctacaaaaaatttaaaagccaggtgcagtggtgtgtgcctgtggtcccagctactccagaggctgaggtaagagggtggcctgagcccaggtggaggctgccatgagtcacagctgcaccactgcactgcagcctgggggacagagcgagaccctgtctcaaaaaaggtcgggggcagccactgcctgaggtcacagagccaggaggcagccacgggaggttccaacaggtctggcactcggggctgcccacgccctccctcccaccaccctgcccagtgctccttgtcgcaaggtccggctgggcggcagggctgagatggggcagaggaggtagaggggccggtcaagggggatgactgacaggagcgggcagaggggatcccagcagtccaacagggaggcctcagtgctggccctggccctctggtgacaccccctgcccaccactcaccaggacttagactggcgggtctgccgctgatcgccacatggtcctggcgaggggcctggctgctggggcctgggctgcccaacccgtgcacagcccaccctgtgtcccagcctggctgcggtggtggggagcggaggcaaacagctcactgtgaagtggctccccagctctgccctgggcgttccccgcccaccccagcctcaggtggaaggatacatggagtaggcaccaaagtaccactgggtgaagcgcccagctgyggccacgatgcccccggtgatgaggactgcggggagaagtgggtcaggcactgtggggctcctgtcccgggggcctgggccaccccccttctctacctactgtgggccaccaggccacccagagctgccccctacccatccccacagcacagtgacagggtcggggacacccccaggaggcacccctctgcactggtgaagagcagagcctgtggcgcacgggctggcggagggggtgctggacatgcccgggctctgggtcccaggagtggccaaggacagcccgacctgcaggccccagtgggctctgggacccccaaatggacccccttgtcaccatgagtctttgtttgatgcactgaaagctaacaggccgagtgtggtttctgcatcttcttgggggagtgtctttttccccccgatacggagttcctcttaacccgtcagcggttttgccttaatttcggtttcgtctgatatggctatttctgcacatttttgggggggtattgtccaatattcccccttactgttttttttttttttcgagacggagtcttgctctgtcacccaggctggagtgcagtggcgcgatctcgactcactgctacctccgcctccagggttcaagcaattctcctgcctcagcctcctgagtagctgggactacaggcgcccgccaccatgcccagctaatttttacatttttattagagacagggttttcaccacattggccaggctggtctcgaactcctgacctcagggaatccgcccgccttggcctcccagagtgttgggattacaggcatgagccacggcgcctggtccttcctactattttatttctttttttttttttttttggagacagagtcttgccctgtcacccaggctggagttccgtggcgtgatctcagctcactacaacctccacctcccaggttgaagcgattctcctgcctcagcctcccgagtagctgggactatgcgcgcctgccaccatacccggctaattttttgtatttttagtagagacggggtttcactgtgttagccaggatggtctcgatctcctgacctcgtgatccgcccgccttggcctcccaaagtgctaggattacaggtgtagccaccttgccctgccagccattctgtttttgtctccacatggtcttgttggaagatttcctatccttggtttgagcccagctacacattaactctctgggtttgtctgtctgcgtcggaggaggggagggcagtgtccttgagtctactcagccaattgtccatgcatctttggggaccgtcctggtcccgagcctgccatccgaaagagggtgcaaagctgccgctggtgccaccagggaggtctgaggacgtattctggcacccagccacatttacagagcacctgctgtgtacaggggggactctttgtcaaggccctgctgtctccgggccagctgcctcctggggctgcacggtctggaaggacctccccaggcaggtggcatttgaattgagaaataaatgagacagccatgaggctctgcagaagcagcagcttgtgccgaggccctggggcacgctcaggagatctaggaacagaaaggaagcacggcagctggaggagggggccggagagccgggaggccagggcgggcagtgcagggcgtccagtctggctctaactcttcgggccaggagcccctggagggtttcagcaggaggccagactagagcccaggtctcctggctcccagctgggtgccctcagtccgtctacttcctgtagggagtgcggggcaggcagggtgagtctcacggggcagctctggggagagctgtctgaactgacccaccgacttcttggccgctgactcgaagcaggcggtcactttcctgggcacaggacaggctgcagggccccgtcctccagccctcccaccctgaggtctctgctcccactccagctgccacgcaccctccagacaacagggagggcgctcagagccccaggggagtggtggcggcgggcccctcctcctcaccctcagcccccaggcccttcccaggcactcctcccccggtgcaggtccttcctggagctgctgcagtggtgcctctgccctcagacctcgcctgagcccagcctcacccgtgctgggccagacactccctggccctggtcccgagagggtccatttccaaatggagtccgctgccctcaccagaacctctgagcaaatgcacaggagggtgactgggggctgtgccatcccaccccaagagcaaagtgcct

SEQ ID NO: 17635 - DNA, 28933 bp, Homo sapiens
cttcagggtcttttctctgaaaatgacaggctagcaaggagacctgggtcccctgcctcttccattccagatgccttgagtccacccaaataggggatgtgatgtttggagctgcagcagccgccctacggttgggagtcagagaagagccggtgttccagggacaatgcagcagaggctgagcccaggcctgctgtcctgagaggtggctggatcactgacactttggcagtggtgctggggtttatgtcatgacctgcagctgagcctacttccaatgamcgtgagatctgaaagactgttttgagggcgtagcctctgccatgattgtggggaatgctgtcctgtttcctcccttggccctgctcagcccagcgagaggctgaggcacacgtggctccccgggtgcccacaggcagcgtggctcaccagccgggcccttttccactgagccagaaccccccaaagccttcaatgcaggcaccacggtgagcccacgagaaaccctgcttgccacctcccacacccccacccccaagttcaaaggaaatggtccctgaaccaagggctgagatcagctgtgggtccagctgtcctggggagctgtactggagcccaccacggtgggactgttggtccggcggtgacccccacctccatgtctgtggccgcagctggacaggccactccctgggccacagagatgttttacctctcgcagccctcgggcacacattgagcagatgtgtgtgtgtgtgcgtgtgtgggtgggtgcgcatttgtgtgtgcctgtgtgtgtgcgcatgtggtgtgggtgcacgtgtgtgcacgtgtgtgggtaaacattgtgtgtgcgcatacgtgtgtgggtaaacatttgtatgtgcacgcgtgtgtgggtaaacgtgtgtgcgcacgtatgtatgtgtgtacatttgtatgtgtgtacatttgtatgcatgtgtgcctgtgtgtgtgtgcctgtgtgtgtgggtgcacatttgtgtgtgtgtgtgtgcctgtgtgtgtgtgtgcacgtatgtatgtgtgcacacttgtatgcatgtgtgcctgtgtgtgtgggtgcacatttgtgtgtgtgtgcctgtgtgtgtgggtgcacatttgtgtgtgtgggtgcacatttgtgtgtgtgtgcgcctgtgtgggtgcacatttgtgtgtgtgtgtgcctgtgtgtgtgcctgtgtgtgtgggtgcctgtgtgtgtggggcacatttgtgtgtgtgtgtgcctgtgtgtgggtgcacatttgtgtgtgtgcctctgtgtgtgtgcctgtgtgtgggggtgcacatttgtgtgtgcgcctgtgtgtgggggtgcacatttgtgtgtgcgcctgtgtgtgtgggtgcacatttgtgtgtgtgtgcgcctgtgtgtgtgggtgcctgtgtgtgtgtggggcacatttgtgtgtgtgtgtgtgcctgtgtgtgggtgcacatttgtgtgtgtgcctgtgtgtgtgtgcctgtgtgtgggggtgcacatttgtgtgtgtgtgtgcctgtgtgtgggggtgcacatttgtgtgtgtgtgtgcctgtgtgtgtgggtgcacatttgtgtgtgtgtgtgcctgtgtgtgtgggtgcacatttgtgtgtgtgtgcctgtgtgtgtgggtgcacatttgtgtgtgtgtgtgcctgtgtgtgtgggtgcacatttgtgtgtgtgcctgtgtgtgggtgcacatttgtgtgtgtgtgcctgtgtgtgtgtgcctgtgtgtgtgggtgcacatttgtgtgtgtgtgtgcctgtgtgtgtgggtgcacatttgtgtgtgtgtgtgtgcctgtgtgtgtgttgcaggccctggatgccagccacagagataaacgcaggaagacgtctgtcttcattctcctcgtgggtcgctggtccagaaacacctggatggaaagtgctctgcaggaacggtgcctctgcctgtggcggggaccctggtgagcggatgggccagccccacgtgtcttccggccactcagcatgcagtgtttccaggggcactaagagaccaaaatcgagatatgattagctgtaggatgtcatctaatcacagatcatcccgaggctaatttatctcccccatgaccataacacatcaaaaagttgactttttgcagctcggctgtgcctcatcttcccacgaagccccgacaggcacatccagtgaggaaccacagtgggagtcctgtggcagggtcaccccacttccgatgccctccagctgcatcttggcacgaaaaaggctgcccagttctcatgccctttcaagtcccgggctggggggtagcagtggaggctggggttaaccgccgtccgtctcaaaggcctcattgtggagctgcaaacacgaacgtccttgaaatgtgaggggacagtgctctggggcaggggctgctcactggttcatggccagaggtgagcgggctctgggtctgggtctgtgaggtgctgtggacgtcgggggtgctcctggggcagggacacagccacggccctcacaccagtggagccgtcttccttcccgaggcagaggcttggccttctcacaccttgggacccttctctcccctgtgctcatgctggaagcacagcgtgagggggcaaaggtcatgggaggcaaaaggctgggctgaggccgaggctctgtggctgtggccggacaccaggtcctgtggtggtgtgggcagggcgcgctctctcctctgagcagcctggggctgcgtgtgtgaacagaaacaggcctgccgatttgaagatggtttgaccaagtctcccaaagctgaagagaggtccctgcccatgtcccccgggtggcaatccacagacgcacctgtgtccatcagacggtatcgttgatagggagtctgaagccacccagacgtggtctgttcacgccgtggacaccacggtctgaggcagacggttacagccaccggcataggcgaatctcagccagagagagtgaactgggacaccattcacgtgatgggccagatgggctggcagcggctcgctggagccgtccgggtgggaacgctgtgtctgttggtctggtgctgcttatgtggctggttcaggtctgtcatccgtcaacctgcatatttatcactggtgcattttcatgtatgttgtacctcaattaaaacattttagggccgggcgcggtggctcacgcctgtaatcccagcactgtgggaggcggaggcgggaggatcatgaggtcaggagatcaagaccgtcctggccaacatggtgaaaccccatctctactaaaaaaaatacaaaaatttgccgggtgtggcggcacgcgcctgtagttccagctactcaggaggctgaggtatgagaattacttgaacccagtaggcagaggctaccgtgagccaagatcatgccactgcactccagcctgggtgacagtgagacttcgtctcaaaaaaaaaaaaaaaaaattaaagcagatggggtgtgggggctcatccctgtaatctcagcattttgggaggctgaggcggaccgatcacctgaggtcaggagttcaagaccagcctggtcaacatggtgaaacctcatctctacaaaaaatacaaaaaatagccaggtgtggtagtgggtgccgtagtcccagctagttgggaggctgaggcataagtattgcttgaatccagaaggtggaggttgcagtgagccaagaatgcaccactacactccagcctgcgcgacagagtgaaactgtctcaaaataaataaatacataaaattatatgtatatatatatatatatatatttttttttttttgagactgtatctctgtttcccaggctggagtgcagtggtgtgatctcggctcactgcaacctccgcctcctgggttcaagcaattctgcctcagcctcccaagtagctgggattataggcgtgcgccaccacgcctggctgatttttgtatttttagtagagatggagtttcaccatattacccaagctggtcttgaactcctgacctcatgatccgcctgcctcagcctcccaaagtgctgagattataggggtgagccactgtgcccggcaataataatttttttttttttgagacagagttttgctcttgttgcccaggctggagtgcaatggtgcaatctcggctcacggcaacctccgcctctcatgttcaagctattatcctgactcagctgggattacaggcacccaccaccacacctggctgattttggtatttttagtagagacggggtttctccatgtcggccaggctggtctcgaactcctgacctcaggtgatccacccgccttgggctcccaaagtgctgggattacagccctgagccaccatggctgacaataataaaaaattttaaagcaaaactaaagatttataaattgtaaaatgcggttgtaacaagtatttactgtaccagtaaatatgaaaaatattaatgtcctcacacacatggaggtggcttgtgagtggtgtgagcatttcatggtcagagtttggcagttgggcgagagacaggatggattttaactcgaacatcgcagacacaaaactgaaaaccctgatgcggtgcctgcaccgttgcctcctttcctgcagctgtaaatgggacgagtaattccatccccctcccgcttccacccttcagcacagacgcagtcttcagcaaggaagtgctgggaacgccctggagtgaacccaggaagatgcctgcagtgggtgccagggcccctcyccaccgtccctgctgggcttcggggccacgcccgactgctgtgaacggcctgcggagcaccacgtgcgacggctggaggcgagaggtctgcctttgatgtggctgttggtgcagggcctgtggtgccttccgcagcggaaatggcgcgccgcccggggagggcgggagcagcgtcccgggtgcccctgtgaggatgagcgacgagatgactggagggtccctgaagacctcaccagggtgcccccagccggtccgctcccaggaagcgacacccccacagccccagggctgcagctgagggggtcgccactctggctgggcgaggctgggcccttgggggcaggcgccagagtggcctcaggctctacgagatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgcggtgtgagggaccccctgggtcctgcacgccgcctggtggcaggcygggccatggtgggtgctcacgcccccggcatgtggccgccctcagtgggaggggctctgagaacgactttttaaaacgcagagaaaagctccattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcytcctcagcctggggctggtgagcttggtggagaacgcgctggtgktggccaccatcgccaagaaccggaacctgcactcacccatgtactgcttcatctgctgcctggccttgycggamctgctggtgagcgggagcracrtgctggagacggccgtcatcctcctgctggaggccrgtgcactggtggcccgggctgcggtgctgcagcagctggacaatgtcattgacgtgatcacctgcagctccatgctgtccagcctctgcttcctgggcgccatcgccgtggaccrctacatctccatcttctacgcactgygctamcacagcaycgtgaccctgccgygggcgcggcragccgttgcggccatytgggtgkmcagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggygctgtcaccctcaccatcctgctgggcattttcttcctctgctggggcyccttcttcctgcmtctcacactcatcgtcctctgccccgagcaccccacgtgcggctgcatcttcaagaacttcaacctctttctcgccctcatcatctgcaatgccatcatcsaccccctcatctacgccttycacagccaggagctccgcaggacgctcaaggaggtgctgacrtgctcctggtgagcgcggtgcacrcggctttaagtgtgctgggcagagggaggtggtgatattgtgtggtctggttcctgtgtgaccctgggcagttccttacctccctggtccccgtttgtcaaagaggatggactaaatgatctctgaargtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccartgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtrtggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccaccttagccccttccagaaagtgcttgaagtttgcgggtggagggatgggggaggggaaggtgggcaggggtgagagtcgagagggaagaaaggagtcccggaaaacgtggctgcctccccaggtgaggaagccacagccccagaggccccaaatgcctggggagtgtggaggtcccaaccaggcttgcgctgaccctgcttctcggttttctctccgtgctgacaaaccccagcctagaggaaggacgagcaggtgcagcagggccccagtcccctccactcttgacgctgtcctagctgcagaagaggcgggttcccagccttccctgtgaccacatgtgacctcagccgggacacatccctttgctggccctggccctgagtccctccagccatgatgagccgtgaatgggaccatccctgtccactctgagatgcctggaagggggctcagtgcaggtgggctgggggctgggtctgctgtctgcccagcactgccattctgggagtaggcaggtggggaaggggtcgggggtggagggtctgtgttcagccagtcctgggaaatgcttgatgtgaggcttctgaagatggcagtgaggcagaggcccagccggcggagaagtccctgggagtgagtacctggggatgaactatgctgcctggtgctggggagcagtggcgcccctgggccatccctctgctgaaacctgggcgtctcgctgaagagaccacctccatttcctctgcwgagactgagcactcagtcagcccccttcctgggacaggctcaatggaggctgcagggccatcagccgactccwwcgcaggctcagtcagcagccccctggccagccccacccctgactgccggcctcagaactgggagctgcttcctggcagggcccgcctctgctgggagaccggacggtgagtcagccttaagcccggcaccagacccctctgaggatggagcaggagctggctgccctgaggctgcaaaacttcttccctcgtggagacagggaggcacctcagacactcaccccggactcccttgaacagggacagggaggaaccccaggcagctagaccccagcagcagccacacgagcacactgtggggcagggaggggcatctcttgagaacaaaagatccatttctcgactttccaaactggagagcttcttgagagaaaagagagagacaggtacaggtccacgccacccacacacagccctgtgcacacagaccggacacaggcgtccacaggcaagttcgcagctgctcattttgtgaagtgaatgctgatttgggggccgggtggggttcgtctgtacatcgtgcactgtcagacccttcctgaaggatttttgttactgaagtatcagaaggcccttgttctaaggtggtggcactgtaatatctggcccaggaggaggtcagtgccgtgccggcgagtcctttgctcccttccttctctgaccagtaaacgcatctccagtcgctcccccgaggcccccctgcacgcagwctccgacctcagagagtgagtcagatagaagccgctgcccaccctcccccaccctggccgggttcttgcctggcttgtgcgtccttgtgacaattcctgacacggatgcgcaccgggcagtggcacgtccaggtgctgtgcgcgcccgggcccacaaagctcctttggacgctcatggcagccccttggtggaggaggtcgggtgcccaccccctccccgcccactgcggaagccggcgacccacggagctcgctctcggccgccgccacccctctgtgttcgcgcccttccgagctctgatccgacgctttgtttcttctcagtgggttcagggcctgggccagcctttacctacctcccccacccaaaaccggcaaaagctcagagcaccttgtctgccaaaagacagggagctgggatggtgcgggttggtctctaaaccggcgtggggaaaaaagaccctccgtacaaagccgcagggtggggctgtcgcaagggcggaaccgagagggtagctgggggcggggttcccagggccaagaggggccattgtcctccctggagcccggcgcccccacagccagctcctctgggagacagcccctcctttcgaatgcgcggggccctcagaccgcgcccggcccagcgctgggggatccttggctgcgggaggggcgccgcattgcgcgcggcgggcggggacgcgcggtgcggagcctgcgggccgggcggggctctgcggcggcgcctcccgattggccacccgcggtgacatcagccgatgcgaagggcggggccgcggctataagagcgcgcggccgcggtccccgaccctcagcagccagcccggcccgcccgcgcccgtccgcagccgcccgccagacgcgcccagtatgagggagatcgtgcacatccaggccggccagtgcggcaaccagatcggggccaaggtgaggctgcgcgccccggcctgtcccgggccccggggcgggaggagggaggcgccgtgccccgcgggccgcacctccagctgcccccgcccctgcgaacctgcaacaaagggatgcgcccagcgccgcgccgggcggccgggacgcggggcccccgccctgggactctcgcctgcacctctctgcccctgcccaggtgacctcgggctgtcgaggcgcagctcacgtcagtcgcgaagcctcagccccctccacacctgcgccccctccacacctgcaccccctccaccgggcctccgcaggtgcagctgggagccctgtctgggcgtggccctcttttttggggccgcggcatagccttgagtgagacgggtggggtaggcaggtttgggtggggtggggggttctcctcacagccgtgatttcctcggcccgaaccccccactggagtagccgaacgtcccccgagaggctagagccgccccgatttccccagcctgctccgacacccctcggcgtcctagctccaccctgtccctttgttggaggggttgggcctggactcgagatgaccttggtccaggaccaggctctccatcggcgcagccgctcctgggcaacccccgcggggcttgaccgcgcccacccagggtctaccagtctggggattggatgtgggaacaaagccgggctgtggggtgtggaggctgcaccgtggcgcgcccctccctccattgttagcccacctcgcagatgttggggccacgcagaaaggggcgttggtgcagctgtgcagggacccctgcctaaatcattaaggggacgtcgtgtcccctggtcctgggaggctgtccctggcccaaggtcacacagcaggtgcgagagagctgggctggcccttggttctcatcccctgcaggagccaacctggggctcgggcggggcgggttgggggcgctgcttgccaaaggatctgccctccgaacagtgttggggaacaggggatcggggggggaggctggctttgtcaggaccaaggccagggacccagctcagggctggtgcagcgctgattctgggaaggagggggtgcaggagacggtcctggaggggaaggggccagagaaaggcagcctccggaggctgttgccatggaaaccaggcaggaacaaaaagctaattacaacagggccagccacgtggctgacatgtaaattgcaactttggctccgggtggaggcgcctctgagggtgggaggcccagtagtggggagactctaatcacccaaggagacagctgtgcctgccaaggagagcctgggggaggggagacctgggggacagtggcctcaaatcaaaccaggactcccggagcagcctctgacagctgccttggcctgatgggaggggctgagggctcattaatgtggtcactggggccaagcctcccctgagcatctgctcctgggagggtcaggggtcgctggggggagggagggcaggcagccctggggctcctgggagggtcaggggtctctggggagagggagggcaggcagccctggggcccacctggggtttctccttctatggctgggatgggcccagagctgtggtcccacaaggcacttgtcaggcaagagctgggatctagaagtcaggtgcacatgcagacwtcccctgaggctccacgggtagcagagggagcccttgtcccctggaccgtgtccttsgctgccttgtgctctgcttctgaacactggagctcttagtttgcccgctactttttattccttttgagttgtttgttttttcttaatatatttctttttaaaaattaatacctggccgggcacggtggatgaggaatctcatgtaatcccagcactttgggagactgaaactggaggatcactttagcgaaggagttcaagaccagccgggataacatggtgaaactccgtttcttaaaaaaaaaaaaaaaaaaattagcctggcgtggtgggccgcgcctgtagtcccagctacctgggaggctgagatgggagcattgcttcagcgtgggaggtcgaggctgcaatgaactatgaccgcaccactgtactccagactaggcgatagagtgagatcctgtctcacagtaataatagtatctgattctttttaacaatgaaagcaacagagaaggaaattttctcgggggcgkgggcggcaagagcgtgttcctttgctctgctgcccttgtggaatcaatgggaagttccttggccgttctcggcctccactcccgcagctgatagggggtgcaacgcggctgcttccctgtctggggtcctcgggcggtgcctggctgggcaggaaggcccgtgcastctgggcagagggaagtcggggtgactcgaggccgggagcaaagccgggtcccgggcggtcacgcggcagcgcggacgactcaccgcggtcacccctgcgctgggagccgagcccccggcagctcgcggggatgcagtaagccgggcgcagcccgccgggaggatgagaaaacccgaagcccggaaagccgagcggccgcctgcagtcaccccggggggggcaggggcgggccgggctatgcagaaacaccggggcccgcgggacacaggacgctgccccactgccgcagagctgaatctggacccccgggctttgctttcctggggcctgtgctcctccctccccggggcggggttcgcctgcagcggcggaggggggagcctttgtcctccgcgcgggctgcggcaccgcctcctcgcggctgcggggcggggctgggggcggggcctggccgtctcagccaatgggaggcggagtccctggctcgccccgccctctcgcctgaaagacctgcggagccgcgggccgggcgggaaccgcattcgggtcctggaggggcttggaggccccagtctcgcagccccttcatcggggacccccgctcccacctgccttggccactgccctcaaagcccggccccgctttccccaggaccccaagcgctgcgcgaggtcagcaccaaggacagcgcccgggccgagcgcctggcctcgaacgccgggttctgctttgtgtttccaggtttttgtttttggttatgagaggaggcctggctctgtcgcccgggctggcgtccagaggcgcgatctcggctcactgcagcctcggcctcccgagtagctgggaccgcaggcgctcaccaccacgcctggccacaattttccttttttcttattttcttttagatggagtttggctcttgttgcccaggctggagtgcagtggcgcgatctcggctcattgcaacctccacttcctgggttcaagctattctcctgcctcagcctcctgagtagctgggattacaggcgcccgccaccacacctggcttattttgtacttttactagagatggggtttctccatcttggtcaggctggtctcaaactcctgacctcaggtgattcacctgcctcagcctcccaaagtgctgggattgcaggcatgagccaccacgccgggccgatttccttttctgtagtgatgttaacaatttagtttataaaattatattttattgtttattaaatatgtaacataggccaggtgcggtggctcacacctgtaatcccagcactttgggaggccgaggtgggtggatcacctgaggtcagcacttcagggccagcctgggcaacatggcaagactccgtgcctacaaaaaataaaaaacaaaaaaaattagctggacatggaggcacgccggcctgtggtcccagctacttgggagacagaggtgggaggatcacctgggggaggtgggcagaggttaaagtgagctgaggtcatgcccctgcattctagcctgggcaatagagcaagaccctatctaaaaaaaaaaaaggaacaatatattttattactttatctcaaattataattttattaattttaactacaaaagcaattaatatattctcctggttaaaaaaaaccttaaatattgcagataaacctggtgcccatctagccacctctctctatccaagtgggaacaaatttctttttctatccttctggtccattttttttaagtgacctgtgcatatggttttaaaactttaaatagtatctaaaacatttgaacaaaatgaagccaacatgtgctgaatgttttcatgtcaagctttgtgctaaggcctggatgtgggcaccattcacacgttcatctcacagatgagaaaacaggtcctgcgaggcacgcgcctggcccacagctgtgctcgtgctgggtcttgaatccactctgctccattgctcctgctgccctgtgcctcgctctgcagaggacttcccatagatgtgttactctctccacccctcctttacaggggctggtggttgtgggttccctggaaccataaatttggggtgtcccagtgctttggggagcaaggtccccgactcaagtggactgccagcaactaaattaatgggggatcctcaaagagagtgttagggaggcaagcagtaggtgggaagcttggacaagccccaaatgcctcagggacctttctgtattttttttttgagacaggctcttactctgtcgcctggactggcatgatctaggctcactgcaacctccacccccctggctcaagtgatcctcccacctcagcctcctgagtagctggggctataggcatgcgtcaccatgcccaactaatttttttgttttttggtagagacagggtttcaccatgttgcccaggctggtcttgaactcctggactcaagtgatccacctctcttggcctcccaaactgctgggattataaatatgagccaccatggccagctgatttttttgtttgtttgtttgagatggagtctcactctgtcactcaggctggagtgcagtggagtgatctcggctcactgcaayctccacctcctgggttcaagcaattctcctgccttagcctcctgagtagctgggattacaggcacccgtcaccacactggctaattttttttttttttttttgaggcggagtctctatctgttgcccaggctggagcacggtggcacaatctcggttcactgcaagctccgcctcccaggttcacgccattctcctgagtcagcctcccaagtagctgggactacaggtgcccgccaccgcgcctggctaattttttgtatttttagtagagacagggtttcactgtgccagccaggatggtctcgatctcctgacctcatgatccgcccacctcggcctcccaaagtgctaggaccacagacaggcgtgagccactgcgtctggcctaatttttgtatttttagtagagatggggtttcaccatgttggtcaggctggtctcgaactactgacctcgtgatccacccgccttggcctcccaaagtgctgggattgcaggcgtgagccaccgcgcccggccttttttttttttttttttaagatagggtttcactcttgtcccacaggctggtgtgcagtggcttgatctcagctcactgcaacctctgccccctgggttcaagcgattctcgtgtctcagactctgaaacaactgaaattacaggtgcgcgctaccacgcccggctaatttttgtatttttagtagggacagggttttgccctgttgtccaggttggtcctgaactcctgacttcaagtgatctgcctgcctcagcctcccaaagtgctgggattataggcatgagccaccacacccagcytgaatcatttttgtaatttaaaaatttaacgcaaaaagaataaaacttagcaataacaaaaatgcacaaaagatggaaagaaatccacccctgacctttgtggagagatgacctctgataacagtctcagggtgaacgggcacctctgataacagtctcagggtgaacgggcatcccgagacactgttagcagaggtggtccatgtccatgctgtccgcgttacaataattacactatgtttattcttaaggttttaaaaacatttatttttaacaaattttctttgaaaagctaccgtgtgcacgtgagaaaatctcaacaagaccacagggcacccgtgagaagaagctcctcccagtctggggcccctccccaggcacagccttccacacatctaccagaggcacccacgcatagagaagcacccacaagcagttttctttctttcttttatttgagacggtgtttccttctgttgcccaggcttgagtgcagtggcatgacataagctcactgcaacctccacctcccgagttcgtgtgattctccgcctcagcctcccaagcagctgggattacaggtgctcgccaccacgcctggctaatttttgtatttttagtagagacagggttttgccatgttggccaggctggtcttgaactcctgacctcagatgatccacygcctcagcctcccaaagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagtggcgcgatctcgactcaccacaacctctgcctcctgggttcaagcaattctcctgcctcagcctctcgagtagctgggagtacaggtgcgcgccaccatgcctggctaatttttgtatttttgggagagatggagtttcactatgttggccaggctggtctcgaactcctgacctcgtgacccacccgcctctgcctcccaaagtgcagggattatgggggtgagccacygtgcccagctatgagyggttttgtttctatttatttattattattctatgagacagagtctcactctgtcgcccacgctggagtacagtggtgcaatcttggcttactgcaacctccgtctcctgggttcaagcaattcttctgcctcagcttccggagtagctggaacgtgtgagccaccacccctggctaatttttgtatttttagtagagacaggctggtctcgaactcctgacttccggtgatctgcccacctcagcctcccaaattgttggtattacaggcgtgagccaccgcacctggcctctatttatttatttattttgagatggggtcttgatatgaattcctagactcatgcttctcatgcttgctaccacccagtcctgcctcctgcacagcagtttccactaaagtcacccctttacgagaggcatcttttttttttttttgagatggtgtctcactctgtcgcccaggctggagtgcaatggcatgatctcagctcactgcaagctccacctcctgggttcaagtgattctcctgcttcagcctcccgagtagctgggactacaggcacccgccaccattcccggctaattttttgtatctttagtagagacggggtttcaccatgttagccaggatggtctcgatctcctgacttcgtgatccacccgcctcggcctcccaaagtgttgggattacaggcatgagccactgtacctggcctactagaggcatcttaaaacacatctcctgtgtctccattccaaagcgcatctttgtctacactcctggggtcctcccacgtcagcctcccaaagtgctgggattacagtcatgagccactgtgcccggccccaccaaattgttttctaacctgcttttttcttgaggaatcttctgcagcacatgactcacatgtagagccccttgtttcttgaggccttcatacccgtcagctcatctaaaagtcactcctgaggagtaagggcaaggggcattgggagaggtcaggcagccctgggaagcctcccagcgtgtgtcccaggaggcctgctgcctgcagacactgctcccagacgcagcggcctcggccatcagagcgtgtcccacgatgaggtggcaacttccctgaagggcttgctctcacccaggggtgtggttctccgtgtgcacacagatagatagttctacgtttgccatataccatttatatgcctcacacagattaacccactttcatttcaaaaagacctcctgtcatcgtgcccattgtacagatgaggacactgagacacggaatcctagtgacctgtgcaaggtcacacagctgggaagggtgagggaagcgtctgtgaacccagcaggcccagcccctgagtctaggctccgctcggcagctgtcatgggagcagagtccgagaagcactgcaggcacctgctctagggggagagaggtggaggtggcaggtagagagaggacgacccctgggagctgagacgatgccagcctcacacggacaggctgggtgacctcaggcaagtcgcttcccatttgggaccccaaggacccttctgcagacccagctgggggtccccgatgagactggctctcagagtccctgtgagtcccgtcagctgaggccagtaatgtcctggcaccatcactggacatggtttgctctcccatggaggggcaggtgtagcagccaaaagcgatcctgagctctgggcctctgaaccctgctctgccagctactgtgggtgtctctacccgctctgtgtctcagttccctttcctgaaaagaggggatagtaaaaactaaccctcaaggtgtttattaccaatgcccttcatggaggaatccgctgctccaggcccttgccagcagctgcacagctgggcctggggacctgggtgtgggtctgttgaaccttggcccaccctggggctgtggtcggcctggacgygtaggtgtggaggtrcatatttattatggcaattttctgacaggtaacagagtgtggggctctcttctgaatggggctcgtggaggccgtgggtcaaaagccctaattttgtagtgagggctaaaaggcttcacaagggaaagggcctggytggggctatgggccggtgccgaccccysctctcccactttgtttgcagttctgggaagtcatcagtgatgagcatggcatcgaccccagcggcaactacgtgggcgactcggacttgcagctggagcggatcagcgtctactacaacgaggcctcttgtgagtgcctgycccagcctccctatcccagccctggactgaccaggtctcagcgtctgactgaccaggtctcagcacctggactcaccagctctcagcatmtctgtcctcccatgggttaggttggctgagatgccagcaggcgtaactggatgtcaggcatccagacgcacagaacagacaataaatcacagtcacaaaagtgagagccaaacatattagtgccatgagggcctgtgcgtgtccaggggcacagacagggatggggcaggccagagactttggaggccataagagggcctagagaaggggtcacctggagggcttagtcaggggctctttagcaactggtgtgaagtgatttccatatcaaagtggtgatacacccacctgcccacatggacatgtgatttaaaattttatttaatttaatagagacagtctcgatatgttgcccaggctggtctcgaactcctggactcaagcgatccacctgccttggcctcccaaagtgttgggagtgcagacacgagcccctgcatctggtggacgtctgactgaatcctgcctgtcctgctccgtcctgtcctgctccgtccttaaacacagtgaggcttaagggtgaagaaagttgctgaagcttgcctttggtccaggactctgacttcagagtacaggctcttaggatgtgagcaggaggatggcaggcgggcacagaattcagaaagaatgagggagaggctctggccctctgtgacccgaatcaccgagcccctctctcccctcagctcacaagtacgtgcctcgagccattctggtggacctggaacccggaaccatggacagtgtccgctcaggggcctttggacatctcttcaggcctgacaatttcatctttggtaagttccccctgctccaagctctgatggcagaccccatcacaggcaagcccaggtcggtggacggggacggctgtgagaaacaaggaatggtcagctcctcacatgatcctgaatggtgggaactcatctctccattttacagctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccacgtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcctggggcggggccgtggatgccacgttcccatgcctgtgtcctggggcggggccgtggatgccacgttcccatgcctgtgtcctggggcggggccgtggatgccacgttcccatgtctgtgtcctggggcggggccgtggaygcgccacagaaacaggagggcctcgcttcacttctgccttcccgaccgcagcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctygctctgctgtgaccccaagttctcaagacyctgtccagagccctcgtcctgagcactcagcagcatsggctcagggaagccacggcgggtatgagaaggggtgctcagtggggcctactttacagaagacagaacaggcatggggctgccacggctgcccttgggatgttcaggcaggggctggaggtctggactgcagagtccctggcccctgtctcttacccctcttctccctgtacaggtcagagtggggccggcaacaactgggccaagggtcactacacggagggggcggagctggtggattcggtcctggatgtrgtgcggaaggagtgtgaaaactgcgactgcctgcagggcttccagctgacccactcgctggggggcggcmcgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctayggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctrgccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaarctgctcgcagctggagtgagaggcaggtggcggccggggccgaagccagcagtgtctaaacccccggagccatctygctgccgacaccctgctttcccctcgccctagggctcccttgccgccctcctgcagtatttatggcctcrtcctccccacctaggccacgtgtgagctgctcctgtctctgtcttattgcagctccaggcctgacgttttacggttttgttttttactggtttgtgtttatattttcggggatacttaataaatctattgctgtcagatacccttgcttggtgccagagatgtccttttattctggaaagttgtgtccagtaggtggaggggctgacagggaggcccgggtggacaggcaagaagagctcatcctctcccaggctggcggctgagagaggcctgcgctgggggccggaatgtgtctcaaggcacagcccgtggggagaccccggaaacgggaagcccgggagaaggaacgggaagtacctcattccagacctcaagatgcagccctcccgacttggaaataaccccacactcgttccctggcctcccacagagcggcttgcaccccagacttttctcccacctgtctgtaggctgaaagttggggcaggtggtccctcctgcggtggaaactgccatcagacctgaagcctcgggtcacaaccagggaggtagggaagggggccccgagtgctccctgaaaaagacggtgtgtttagtgtctcggggctgggccctgggaggggctgctgaggtcagggagatgcggccacaggacgcaggcctgggctgccgggagggacgtatcagtcctcccgcccccggcagccccttcctggggtgcatgatacttggtgtccagccacacagggcatggcctgaggagccgctcacctggttccccacatcctcctacagggacagagcctggagcccagagaggccgactgcccagccctccacagtcgcctccctgccaccccgccccttggagctgaggggcatcagcagcctcagtctcccaggttctgcccagtggtaccctgagagcggccccttcttcttgaatcacccttcaacctggcaatgggcgcagaagaagacaggccgtgtgcactgcgggccccagcttcagatgcgagggctgcaggccccagaggccgccatctcgagttctggccctgacacccccaacatggatggggccggggatgtgtctcctccgccggctgctgctgtgtaacaaatcaccccaaatctacctgaaacagcacgggatcctttctctagacacagcgtgttagctggatccttctgctcctcacaatgttgggaggggccagctgcaagctctgacatctcactcttggggttgtcctccgcacggctgcctggccgacccctcgcatggtggggcggaggctggaaccacgtcttacatggcaccggttctttttttctttgtgacagagtctcgctctgtcgcctaggctggagtgcagtggcgcaatctcagctcactgcaagctccgcctcccgggttcacgccattctcctgcctcagcctcctgagtagcagggactacgggcgcccgccaccatgcccggctaattttttgtatttttagtagagatggggtttcaccatgttagccaggatggtctccatctcctgacctcaggatccgcccaccttggcctcccaaagtgctgggattacaggcgtgagccaccgtcactgattcttaagtgtgccagacccatgtcaatcacaggcctggcatcactgtcccatattcagtgggttcaagcaagaccagagccagtgcagatgcaggcagggagggaaaagccctgtggtgcggactctggggtgtggttcctgggaggctgcctgaacacagcctggcttgcacctgcaactccacacatgcggagctgagctcctgacccccagccctgcttctccacatccctcaggttggtgatgccaaccacgacaccccaggtgctcagggcaaacagccggggtcaccaggtatagggtccagccccatagggtcggtgggtctctccctgtgtgcggcgatgacagagtgtagaaataaagacacaagacaaagagataaaagaaaaggcagctgggcccgggggaccaccaccagcaagacgcggagaccggtagtggccccgaatgtctggctgcgctgttatttactggatacagagcaaaaggggcagggtaaagagtgtgagtcatctccaatgayaggtraggtcacgtgggtcacrtgtccactggacagggggcccttccctgcctggcagccraggcagagagagagagggagagagagagacagcttacaccattatttctgcatatcaagagacttttatactttcactaatttgctactgctatctggaaggcagagccaggtgtacaggatggaacatgaaggtggactaggagcgtgaccactgaagcacagcatcacagggagatggtaaggcctccggataactaatgattaatgatattcatatataatcatgtctatgatctatatctagtataactcctgttgttttatatattttattatactggaacagctcgtgccctcggtctcttgcctcggcacctggatggcttgccgcccacaaccaggggcttttcttcccctcaggtccacatctgctttgacagcaaatctggccagctgcaccttcagaacacgcccacagcccagcacccctcatgtctgctgctgcctcgggtcttcctcgtcccgtccgtgcgattgtctcctcactgggctcccacagctgcctggccgctcctcacatgcaatttggcatctgctcccgtgccacgctgtccttcatatcctcttgttatatatgccccgtccacaccacgtccctaatgttctagaacattggggcccggggaatgccctccacttgagtgtcctccctgcagatatccgacggcatcaccctaggggacccttcctggccccccgtgctctgaactctcctcccagagctgctttctgtgcagcactcagcacccacttcaggagactgtgccttcaggggaggggtcaacaaagagggtcgaatggcaggaatgggcctaattaaggggtcctggagcactgaaggtgaaggggtgggagggctggaccctggtgagaactggagctacaggagaggccaccccggctgagctgaggtctctgaagggtaagaaccccatcagagcagagggagccccggagccaacaccctgacctctctctcctccgtcccccggcctccaggcaccctgacttctctctcctccgccctccagcctcttgctgagctcagctggaagtcaggggacgtccaggtcagcctccaggcagagaggagggccaggaggcgtgagaggtgggtctggggccagtggaaggtgagaacctggcccaggtctaatgtgtcatttagtccccaagtgtctcctccacggggtcagctccacaagggacttctgtgttgttcccgttggaccccttaacctagaagaatgcctgactcatggtaggtaaagatttccggaaaaaatggcttgaattgtggtctttcatgtaacaacagactggacatggagcagttccagggtggggctgtgtgttggtctcatccttactgggtgagccccttcgtccgagaaaacggcccctgctccagttgttagaaaaccgcctttacaggccaggtgtggtggctcacacctgtaatcccagcacttcaggaggccaaggcagacaggtcatgaggtcaggaaatggagaccatcctggctaacaaggtgaaaccccgtaactactaaaaatacaaaaaaattagctgggcgtggtggcgggcgcctttagtcccaactactcgggaggctgaggcagaagaatcacttgaacccaggaggtggaggttgcagtgagctgagatcccgccactgcactacagcccgggtgacagagtaagactctgtctcaaaaaaaaaaaaaatgtgattgctatgtaaaatgattgtgtgccacagagatgaccaggtttcttgtggatttcatcttaactgtggctgtcctaagacttttgtcatccacagataactgttgtcttgtttcaccatttttttttttgttttgagacgaagtttcgctctgttgcccaggctggagtgcagtggcgcgatctcggctcactgcaatctccgttccctgggttcaagcgattctcctgcctcagcctcctgagtagctggggttacaggcatgcgccaccacacccagctaatttttttgtatttttagtagagacgggagttcaccatgttggtcaggctggtctcaaactcctgacctcgtgatctgcctgcctcgrcctcccaaagtgctgggattgcaggtgtgagccactgtgcctggccacattactgattctttttgttttgtttttcagagtcaagaaaaccttttttcttttgagctatttacagcttttagcagttgagtaaagtacacccctgtgaccaaaacttggtgcatttttctttctctacctgagttctccagattttggaaactgtctgtgagtattcttttttatttatttatttatttttaaaatttcagtaggttttagctggtgtttggttacatgaatgagttctttagtggtgttttctgagattttggtccatccattacctgagcagtatacactgtatccaatatgtagcctttatccctaaccctctcccaccctttcccctgagttcccaaactccttcatatcattattattattgttattattattattgaaacagtgtctccctctgtcacccaggctggagtgcagtggcacgatctcacctcattgcaacctccacctcctgagttcaagcagttctcctgcctcagtctcctgggtagctgggattacaggcacacaccaccacacctggctaatttttgtgtttcttagtagagatggagtttcaccttgttggccaggctggtcttgaattcctgatctcaagtgatctgcccgctggcttccaaaatgctggaattacaggtgtgagccaccatacctggcctattggatcattcttaagcctttgcatcctcatagcttagctcccatttatgattgagaatataggatgtttgctttaccattaacgtattcttttcttctctttttttttttttttttttttttgagatggagttttgctcttgttgcccaggctggagtgcaatggcgtggtcctggtccactgcaacctccacctcccgtgttcaagcgattctcctgcctcagcctcctaagtagctggaattacaggcacctgccaccacacccggctagtttttgtatttgtatttttatttaatttaatttatttatttattttgagacgagtctcgctctgtctcccaggctggagtgcagtggtgcgatctcggctcactgcaagctccgcctcccgggttcacgccattctcctgcctcagcctcctgagtagctgggactacaggcgcccaccaccgtgcccggctaattttctgtatttttagtagagacggggtttcaccgtgttagccaggatggtctcaatctcctgaccttgtgatccgcccgcctcggcctcccaaagtgctgggattacaggcctgagccaccccgccgggcccacactaatactttcaaatttgtcttttgtttttctgacctggactcaatgaaattgctactaactttttcccgaggcccagaaagttgaggttattctttgtaacacaggtgagaacattgtgtcagactgccaggggcttcctgctctgtaactaaagatgctttgagtctaacatctggatagatcgtgtccaacaataaacttcgtttttcttctgttttcatagaaatacctcttattaaaaatctgttcaccttcctcatatacataagtttagcccatctgcaacctcctgttatgggaaatagctgtttaacggaactgatcttgtctcaggaccaggaaatcactacaaagatatgtgacagtgtatctaaatttgttctttcctgtctatcccaatgtgtcttttttttttttttttttgagacagagtcttgctgttgtctcccaggctgaagtgcagcgatctcagctcactgcaacctccgcctcccgtgttga

SEQ ID NO: 17636 - DNA, 47196 bp, Homo sapiens
  misc_feature (1)...(47196): n = A,T,C or G, or insertion/deletion polymorphism (see Tables 1-2)
ccttggattgggtccatggttaagtgagtgagtgaggctcaagggcttctttttttttttttagagatagggtctcactctgttgcccaggctggagtgcagtggcatgatcacagttcactgcagctgcgacctcgtgggctcaagccatcctcctgcctcatctcccttagtagctgggactacaggcatgtgccaccatgcctggcaatttttttttgtatttttggtagagacggggtcttgccatgttacccaggctggtcttgaactcctggactcaagtgatctacctgcctcagcctcccaaatggctgtgattacaggtaggagccaccgcgcccagccttcaagtgcttttttttgttagtgagactggtacaaccaatgccaaggctggtgagcaaagttgcacccagttggggaggggcgaaaccaagggcagaagggcccagggcatggcctctcatggctgaaggaagaggggacacgtggccagtcacagtgacctctgcagacctcaagaaggaggccagctaggagccatagctgtcactaagacagtcaaaatctaatcagcaccctggcgccaagaggccattgtccgctgctcaggacagtgagtgatagtcgataaccagctctctggaggtcagggccccgaggtggctgagatctgtgcctgcattaggacatttaaggggactccaagccaggatttgctagtgtttgcccagcagggagaggtggaaaattggggatgaccaaccaggcctccctgctcacagccaggggaattcatcctgtcgttcttccattcagcaaatattcatggagcacctgctgtgtgccaggcaccgtgctaggctctggggagatggctgtgagcgggatcgacactggccttgtgtgagctggccttgcagtaggggatatgagcaccaaacacataaggcccgagtgtgcaatatgccacaaagattgcagagaaataaagcaagataacaggttgcagaaagatggaggccaggctggctgctgttcctgggtaggtggcttctggacacagtttcctcaggctctgtttcctcctttgggcctctggaatcttctgaagacaggcctggcttccaggatcccggatggagttgcctgttgactgtgtggactcaaagtgtccacagtgcgccggagcgcgtggtcttccccagcaaatctgcttctcttctcggctctccatcgtgggaagggtccctgggatcctccccaccaccccagcctgaggccactttccctctgtccccgctctccccagcctgctttccccaccaagcgccaccaagtccctgctgcctcctcctcccaaacaggctcaaacctgccccctcttcgccagctctcagctcagcccgctcctctcctgcttaagagccttcactggctccccactgccctagagacagagtttgagtctactgccatggcttggcagacggtgttgtccctggcctgccaaccttccagctgccatcccagccagtccttctcccccttgctccagccaagggccccgcttgtagggtgggaagtgggccgtgccctccctcctgcctgcctattcgctgggtcttccctcattccctccctcaccccgccctctcataagaaccttcagaatctgccagacgcagtggctcacgcctgtaatcccagcactttgggaggctgaggtgggtggatcacctgaggtcaggagtttgagaccagcttggccaacatggcaaaaccctgtgtctgctaaaaatacaaaaaaattagctgggcgttgttgtgggcacctgtagtcccagctactcgggagactgaggcaggagaactacttgaacctgggagacagaggttgcagtgaactgagatcccaccattgcactccagcctggactacacagtgagactctgtctcaaaaaaaaaaaaagaaccttcagaatcataaaatgggtttaataattatacttatctcatagggagggcttaaagcacctaggccagtgtctggcaccaaggaaacactgtatacctgttaaaataagaataaaataaaatacacatgctcacttattgagtgcctgctgtatgtcgggcccctccccgagagaactctggtgcatccccgataaagaaacctgaccctctaggatgagggagggtcttccctgagcgcctgctaacagcctcctctgctaatctgaagtcctgcagcttgcccagcaggctggcttgtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatctagaattcagccccttctcaacctccccatctccgcagcctggtgtgagccctggcacctctctctggggccagtgtggtagcctcctcactgctacccacttctacccgtgcccccaccacccaagcaagagaggtcttttttaaagtctcatcatgtcacttctttgctcaaaacgctctggcaacttcttccttgctcaaatatttgttaaaagaagaaaggaatgaatgaatgaatggcctgtttgcatctgtaatagccagcacataggcagtacttggaaaacacccacagcaagaataaatgaggagatggctggacacggcagctcatgcctgtagcatgttggaaggccgaggcaggaggtttgcttgaggccaggagtttgaggttgcagtgagctatgattgtgccatagcactccagcttgggccacagagagagatccccatctctacaaaaatttaaaaattattcgagcatggtggtgtgtgcctgtagtcacaactacttgggaggctaaggcaggaggatcacttgagcccaggagttcaaggctgcactgagccgtgacggtgcgactgcattctagccacagaatgagaccctgtctctaaagcaaaaaagagaaggagaataagtgaggtacttgagcaagtgggtgaggatggttgagccacagcaggcccacagggaggctggtgggtgctgttggtggagggggccgatttgtgttcctggtggctgcagagccagtctgttgcctcccctccctcccactggctgggctggggacggagccaaccaggcagatcccgggccattctggggccctggcctggcctgccttactatcccagtggggccaccgacgtggctgccatttctggaaaccccagttctaggtaggttactgtcccaggaagaagtgcatgcctagcttcctgccagcccagcccagctgtcccagaagccagaggaagctctgggctggtttcttataagtagcatgactaactgattgcgccacaggagctgaggtttcaggccagtttctgtcgtggagtttcaggggtcagcggctccaaagccccagcccccacccgaggcccctgctgtccctggattcctctccacatgccacctgtcacagaggtgcttgcatcctgtctgcagaaccagcccctcctccaagccaggtttcctgcccagagggaagaagagcagaaggcctgtaccgccccctgtgcgcccccagtcctccgccccctgcccccctgccacccgctgtgggttcgggaagagtcctgctgggtcgcttccaggctgctgctggcttctgacatttcaaggcttaatcacttaatctcccccgagttttttaaaaaaagtgagtcaagtgtgttctcctggtggcgggcgtgttttcccaggcccatgcttctgctcatttcctggctgcggccttcactgactttgctgcttcctaactctgtgaccttggccttgtcacttgctgtctctgggtctcaggccaatgggtctcaggccagtggggctccccggacaaagttccagggttttggggactgcatttcaagggtcagcaaccacagtccttaaacacgtggattttggagtgacaatgcctaggttatggttctgtgaccaccagcaagtgctctagcctttttgtgcctcagtcttctcatcagtaaaatgggaatgttaatggcacctacctcatagggtcgttgggagaaccaaattgattaatatattgtaagtacttagaacagggccaggcacaaaataagtactgcatatacagttaactatggacaaaagcttgggacctggttcatgtttaaaaatgattattgaggccaggtgcggtagctcatgcctgtaatcccagcactatgggaggctgaggcaggcggatcaggaggtcaagagatcgagaccatcctggccaacatggtgaaatcccgtttctactaaaaatacaaaaattagccaggtgtgatggcgtgctcctgtagtcccagctactcaggaggctgaggcaggagaatcacttgaacccacgcggaggttgcagtgagctgatatcgtgccactgcactccagactggtgacaaagctaggctccatctcaaaaaaaaaaaaaaaaaagattgttgaatttattattgctgaatttttttttttttgagacagaactttgctctattgcccgggctggagtgcaatggtgtgatctcaactcattgcagcctctgcctcttgggttcaagcgattctcctgcctcagcctctcagcctcccgagtagctgggaatacaggcacccaccatcatgcccggctaatttttgtatttttgtagagatggggtttcaccatgttggtgaactcctgacctcaggtgatccacctgcctcggcctcccaaagtgctgggattacaggcgtgagccactgtgcccagcctattattgctgacttttaaaccattcattcatttaatatatgtttattgtacacatgctatgcctgtgtcaggcactgtttcaggcactggggataaagcagtgagcacagcagacataaagctctgccctcatggggcttgtggtctctcagagggaggcaaacaatgcatttatagacaaatacataatttaaatttgaggttacctattatactcccaacttgaaaaactagcagtatattgaggtggctatttcacatctgatggaggaatatgtcttttgtgaaccatttatgttctttgcctatttttcttaaagggatgtttgtcttattgatttgtaagaactcttcatatattaaggccattaaccgttcataatgtagattgctacctttttctagtcttttgcttgctgatatagttgggatgtcatcctctctaaatctcttgttgaaatgtgatccccagtgttggaggtgggtcctggtgggagatgttgggtcatggggacgggtccctcatggtttggttctgtccttgccatagtgagtgagttctcacaagatctggttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcatgcctgtaatcccagcactttggaggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctrtctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtcagtatgatgaaaccccatctctactaaaaayacaaaaattagttgggcatggtggcttgcctgtagtcccagctactggggaggctgaggcaggagaatcacttgagcctaggaggtagaggttgcagtgagccgagatcacaccactgcactccagcctgggcaacagagtgagactccatctcaaaaaaaaaaaaaagaaaagaaaaagaaaaagaaatcacagagagacccctgcttctatgctgttccccccgagggcaagattgtagaaatctgtaatacagtatcacagctgggatactgacactgatataagctactgaccttattgggatttcccgatttacttgtactcatttttgtgtttgcgtacgcatgtgtggtttagtgctatgcaattttatcacggcataggtttgtgtatgcagccaggatccagcacagttctatcatcacaaggatggctcaaattctccttttatagccacatccaactcccttcctgacccaccccctcagcccctggcacccactgatgtgttttccatttccatggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccrgmcttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggwctctgacttctagacagatagtagttaagaaccaaagctttggagcttgagtgctggatttaagacccatgactgtcacagctgtgcaacctcagacaaatcactcagcctttctgtgccttggtttcctcatctgaaaatggagaaaataatattacctatttcatagattattaaatgcattcttgtatgtaaaagatgtaaaagaaaacttggcatgtggtaaactctgtgtgtttaagtgaatggtgaggctgcccagtataggagggcagagctttccaggtaaagactttctaggcctcctgggattatcaggccctctctgtgttggttgttgtcatacatgacagcagtattccttccaaagggatgccaagttgtggttgcacactgcacttagatccagttgattgacagcactgttcaagtcaactgtgtccttactgatttctgcctgctggatctgtcgattaccaaaagagttgaagtaatagtaataatactattattatccaataatagtattattcagaataatcacacagatttctctatttctccttgctgctctcagtttttgccttacatattttgaccctttgttgttagttgcctacacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacartagtattagtttgttctcatgctgctctaaggacaygcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattcaaggtgagatttgggtggggacacagagccaggccatatcacattattattaattagtgccttctctctcatttttttgattcgcctaggtagagatttatcaatttcattgatcttttcgaagaaccaatttttgatttcattgattytcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttattkagttaaaaatatttttagtttctcttgtgatttcttctttgatccatatgttattcggaagtgtgtttttaaatctccaaatacttggaaattttctggctttcttcctgctagtgacttctaatttgaatccattgtggcctaagagcatatgttgtgtgatttctaatgttttcaatctcttaaggttgttttatgtcccagaatgtggtctgtcttggtgattattccacatgaacctgaggagaatgtatattctgctgttgtgagatgtaacagtctataaatggatacctctgttaatatgacctcgggtgactctttttttttttttaagttgctgcttcaccattggcttttggagattttgcagatgataaaatcctcaggacttttctgctgctcagtcagattttcttatcctacacttgcggaactgttgtttgaaattgacaagcaggatggccaactctgcccggctcattttatttcatcttattgggttcagcctgcagttttaggagatgagattgaaggaactggtatactggaatccacggtgggctcggaagcaaacaaacgtgggttctgattctagctctgaccttttaccagctgtgggacctggtggatgggttatttggcctctctggcctcagtttccttagctagacagttgggataacagcctacctttcaggattcttgtgtggattcggtgaggtaatacttctaaagcacctagcaaagtgtcaagtacaaggtaagtgctgggcaagcagggattttgttcacacaaagccttgactcaacataaggaggctgtttccaatggctctgcttaactgagacctgagagtgattgctccatctgtggtggcatatgggctgaaactgcctagcagcatgtcagargtggggtgttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcaccygccaccacgcccagctaattttttgtatttttagtagagactgagtttcaccatgttagccaggatggtctcgatctcctgacctcatgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcrtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttgtgagagtaaaagttactaggacttgccaaggaaatcagtgtcaggaacccaccaccccattcccgcccctcctttacttgagactttacttttgtaactctcagcaaggaagacgagttcaacctttgagccgatacagagccttcccctagagagagctttgcagcctcatgctgagccagttaggggccccacatcatgtccaaaatgaatttaatcaacaaacagttactgaacacgtcctatgtgccaggcaccgttgtagatactggggactcggcagtgaatgggacagaccctggctgtcaggatgacagacaatttaaaaagggacagatgtcccacgctggcttgtcctttgcacccccggcacttcgtgaggagcagcggccagttcttgtatatagactggcccttggtgtacatttgtctgacgtttccaaatgatgtatgcatccttggcaggaacccaggaaaagacatgctgtgctcttctcaggaattgtttcagggaggtgatgttggggatttgtcccattcttgttggtgagtttagatcacttggtgaaggtggtgtctgccaggtttctgtattgtaacgttcattgatatgtattttcactcattagttaatatacaatacaagttttgcagggagttactttgaggctgtcatagtaaaatagagctttcccttcttccctgtttatttatttattagagatgaagtctgactctgttgcccaggctggagtgcggtggtgcgatcatagctcactgcagcctccaactcccaggctcaagccatcctcctgcctcagcctcccaagaagttgggattacaggcacacaccacactgcacccggcctcctccatttattgatctatgtcaatacagactcctggactttaactccaagggttacaagtggataccataatattcattttgatgctcaaaatgtgcctgttttgtccaggtcaggctagctgctgagtacttccttattgtctggcacaagaattccaagcctatctggtacttttccttctcctggaatcagctatttctctaaggcgctctggttcctttcagtacagaatagtatttagaagccaagacctggtcactaggaaggcatgataatcaaatgtgatgaatgatcttggattgcatcctggacgtataaagggcattattgaggcaattagcaaaacataaataggggccgtggatgagatagtggtgatgcatcactgttaatttcctgatttcgatggttgtattgtgattatgcagagaatgtccttgtttttctgacatgcacactgaggtattggggtaatttattcattatggagatatgtgagtgtgtttatgtgtctcatacacagatgtttcttaatgatggggttttgtccccataaactcatcataagttgaaaatattattaagtcagaaatgtacttcatactcctaacctactgaacgttatagcttaacttagctcggaacacttgcattagcctacagttgggcaaagtcatctaacacaaagcctgttttgttataaagtgttgaatagcttgtgtagtttatggaatactgagagtgaaaaacagaatggtcgtatgggtgctccaagtactgcttctactgaacacccattgattttgcaccatcataaattaggggaagagaggaaaagcacgcgtaagggaggaagggccgggtacagtggctcacgcctgtaatcccagcactttgggagaccaaggtgggcagatcgcttgaactcaggagttcgagaccagcctgggcaacataatgagaccccatctctatcaaaaatacaaacacttagccaggcctcatggtgcacatctgtggtcccagctactcaggaggctgaggtgggaagattgcttgagcccgggaggtggaggttgcagggagtcgaggttgtgccactacactctagcttgggtaacagagtaaactctgtctcaaaaaaaaaaaaaaaaaaaaggaaagggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggcygaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaaccygggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgcacacagtrcttcagaggcaacacctccgttcctgtttgctgcaagcctgtgaggttagccttggaaccattcctgtgccacagaaacacagccagagcaccaaaagagaaatgctgttaatggcaaagaactactcactagcagaacaaagcctgggagctgcttttttgaataagatcccaggagagagacccaagcgggaagtgaaggatgggcacttgaaatgttgcagggaatataacccagcgcgtgctgttttctttttttctttttcttttttttttttttctctttttgcaacagggtctcactgtgtcgcccagcctagagtgcagtggtgccatctcggctcaccacaacctccacctcctaggctcaagcgattttcctgcctcagcctcctgagtagctgggactacaggcacgcgccactaccgcccggctaatttttttttgtatttttggtagagacaggtttcaccatgttggccaggctggttgtgaactcctaaagtgctgggattacagatgtgagccaccacgcccggccccagtacacactttttggagggtatttgacgttatgtaccaggagtgctggggaaaagtacacacttgactccgtgagattctgcttcttagcatttttttcttttcctttttttttttttttgagacagagtctcactctgtcacccaggctggagtgcaatggcatggtctcggctcgctgcaacctccgcctcctgggttcaagcaattctcccacctcggcctcccgtgtagctgggactacaggtgtgcgccaccacactcggctaatttttgtatttttagtagagacagggtttcactatgttggccaggctggtctcaaactcctgacctcgtgatccgcccacctcagcctcccaaactttctgttttcttttcttttcttttttttttatgacagggtcttgctggagtgcagtggtacggtcttggcttactgcagccttgacatcccaggctcaaacgatcttcccacctcaacctcccaagtagctaggattacaggcatgcaccaccgtgcctggctgattttgtttaatttttgtagagataaggtctcactctgttgcccaggctggtcttgaactcctgggctcaagccatcctccctccttagcctcccaaagtgctgggattacaggtgtgagccaccacacctggcttctgaacattttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgccctyatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaactatgcattagaaaatttatttatttattatttatttattttgagatggagtcttgctcttgtcgcccaggctggagtacaatgacgcgatctcgactcactgcaacctctgcctaccccagttcaagcgattctcctgcctcagcctccagagtagctggaattacaggtgcccgccaccacactcggctagtttttgtatttttagtacagacggggtttctccatgttggccaggctgatctcgaactcctgacctcaggtgatccacccaccttggctccccaaagtgctggaaatacaggtgtgagctactgtgtctggcctgaataataaaatttaaaacaatttttcaaaaattcaccatgaggtctcactatattccctaggctggtctcaaacccctggactccaagtgatccaccccaccttcccgagtagctgggactagagatgcacaccattgcacccaatagagcaatacgtttctgttctttgtaaattacctgctctaaggtatttttgttatagcagcctrtatggactaagctgacttgtaacgttacttgagactttaaagtgttccggtcactgttggagggctctgtctgtgttagctcatttaatccccacaacacctcaatcagatggggctattcttagtcccactttatagataaggaaactgaggcatggaagcacagcttgctcaaggttcacatctagtcagtgacagagcaggtatttaaacctcaggaaataatcagagaaacatgtgtagagggttgtccaaggaaggccacatccagaagcatctcccaggacagttgttgtgtagctcaccctctggactttgtgggtctgggtgttgtttcatgattatagagagagctctgtgaacgtggaggacctgttgtcggcagagacacaaatggccagggcatggctgggcagccgcagtggctcaggcctgtaatcccagcacttcgagaagaccagaggggcagatcatgaggtcagaagttcaagaccagcctggccaacatggtgaaaccccgtctctactaaaaatacaaaaattagccaggtgtggtggtgggcacctgtaatcccagctactcgggaggctgaggcagaagaatcgcttgaacccgggaggtggaggttgcagtgagctgagattgcaccrctgcactccagccttggagacagagcgagactctgtctcggaaaaacaaacaaacaagcaaacaaacaaacaaataaatggccagggcaggggagggttgcatattgaataagatgagctctgctggaagcacaggtcagcactaacctgcttcctctctctctgcaggtgccttggcatctcccaatggggtggctttgctctgggctcctgttccctgtgagctgcctggtcctgctgcaggtggcaagctctggtaagtcaccacttctcaatcattcatttgttggctattaatggcgtgccagggtcctgcagtatgtcacctggccttatggagattacactgcagtgggaggggacagccaatgacaagtggccctgattatcagtaaattctaaagattgttagaaagtgatgggagccgggtgcagtggctcacacctgtaatcccagcacttcaggaggccgaggcaggaggatcgcttgagcccaggagttcgaggtcagcttgggcaacatagggagaccttgtctctacaaataataaaatattagccaggtgtggcagtgcacgcctgtagccccagctactcaggaggccgaggtgggaggatcccttgaactcaggaggtcaaggctgcagtgaactgtgatcgcgccactccactccagcctgcgtgagaaagtgagaccctgtcaaaaaaaaagagaaggtgatggggaaagaacacagaacagcataagagggggttggggaagctgggtggagtgggggggattgcagttgaaagtagggaagtcagggaaggcctcattgagctgacttggaggaagcgggamccgtgcagatgtctggggaaggctcattcttggcagagaggccctgcactgagcctggcgggagggttgagcacaggagggaatgtggtggaggagagtgagcagcaggagggagcagtgaaggtcagcaaggtgacagagtggctgaatcaaaaaagaccttgcagtgtttgagcagaggatccatatcatccattatgttccaaaggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagayagctccttaacatggtaagcccttatgcaagttgttgtcagctgagatgggcgtggcactgagcatgggagcatggaggcgcctgagtggtctcatgctcaggtgrtttagcaaactcagtgtacatcctgccaattccagtcctgccatggccactgacaagctaggagggcgctgaaaggagaaggaccccgatgtctcctccagcccatccatctcctctctcccattggccaaacccaaccggaaactaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatggaatggcactccttaaactgctacatattttccctttaatttggccaagaacaagttgtcaagtttgtgtgagataaaggtgcacttggttcgttcttgtctaatggcccccrcacccatgggtatttcttcagcttccacagtcatcccgacactagctgggaagctccagcagccctggtcctggccccagctctgtgggcgctggccctcaactttgcctgcactgtgcttttgtgytattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgagtaagcctgcgctggagctggaggtttggggaggttgtgcccaaagggtttgccccaagagtgagctgggtccaggtggtgcgctggagtgcaggatgctgagtatggtttgctgctgtttatatggtgttagaggggaggtcccatctccagggacatgttatgtaagatacagtggagcgcatggtgggagtgttggtccacgtggcacatggatacggctggaatactggactagaccagcagttctcacactttttggtctcaggaccctttttcacacttaaaaatgagtgaggacccaaagggctttggtgtaggtaacacatcattctatgtttacctaattagaacttgcaatgaagaaatggtgtaatttttaaaaaattaaaacaattaaaaattttttttcttactgaaatggaggtctcactgtgttgcccaggctgctctcaaactcctgggctccagtgatcctcctgcctcmgcctcccaaagtgctgggattacaagcgtgagccgctgtatccggcccaaaatggagaaattttaagtcccaacaacatgcaagcccgcattcaacaaatcttcagatcaattacatgatcacaggtcatgtagcctctagaaaattccactgtacgccagtgagagagagtgaaaaggcaaataacgtccctgtattatgatgaaaagagttttacctggtgggcccagaccacactttgagaaccactggactagacccttgattgaggagtacggtgttgagagtggagtcctctgtgatggtggatggaccaggacacatggcataggagtcaggtggttccctgggctactccatggtgcacaggatgcttcgttacactggtgcccaggacataatcacgtacacaagacacacagttacggggcagactggggatatacggcacaccagcatgcagsgttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctctgcctcccgggttcaagcgattctcctgtctcagcctcccgagtagttgggattaatggtgcctgccaccacacccggctaatttttcgtatttttagtagagaccggttttcatcatgttggccaagctggtctcgaactcctgaactcaggtgatccacccgcctcagcstcccaaagtgctgggattacaggcatgagccactgagcccggcctcctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactakgcagcatatccagtgagaacagatctgaggcttgccatcaaaattgcacttgtaaggccgggcrctgtggtggctcrcggctgtaatcccagccctttgggaggccgaggtgggcagatcacttgaggtcaggagttcgagaccggcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggctgttaaggtggaacattggaattatcttacgatggccaaactgtgcgatgcagagcttatgttgttctaaattaattagtgccaccggttcttccctttcatgggctttcaggaacaagctaagtcccaggaccagggccggcagctaggcaggtgtgaggagcatccttggtgcatgtggtaagaggctgtggccagcaagagaggcaaccctagtcggctgccccagcacaccctggccgctcccaagcccccagatctgtcctcacatccgtgatcgggaagctggaagagtctgatgcggttcctggaggcatgtcccggacacagctgtggggcccagccagcctacaggtgaccagcctaacccagcccctgtgtctgcagagcccacacgtgtntccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgcggcaggggtggctgggtgtgttcccacagctgcctgggctgagggtggggtgggcaggggaggaggtggggtcatagcaacagcaggaggaagccgcctgtattttcccaaatctgatgggattcctgcccctgcctgggcctcagtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacaktccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatggtaaaaccccgtctctactaaaaatacaaaaaattagtctggcatggtggcaggcgcctgtaatcccagctacttgggaggctgaggtaggagaatggcttgaacccaggagaaggaggttgcagtgagcttagatcatgctactgccctccagcctgggcgacagagtgagattacgtctcaaaaaaataaaaataaataaaaataaaaagattttttaaaaggctgaagtttgggttactttggctcatacactttgccttcactgtagaaaggtggttagtaaagaccaggcgcggtggctcatgcctggaatcccagcactttgggagcccagcgcaggcagatcacttgagccctgggctattgaggctgcagtgagctgggattgtgccactgcactccagcctgggcaacagagtgggaccctgtctcaaaaaagaagaaaaaaagggtaattaataaacactaaagttctatgtagaattttagcaacattattgttattataatcttctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccrcagtgaaacccagggccccaggaaacctgacagktcacaccaatgtctccgacactctgctgctgacctggagcaacccgtatccccctgacaattacctgtataatcatctcacctatgcagtcaacatttggagtgaaaaygacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgccctaggcaagtccctttgcttcctggccccccacycctcacatcagagaaggggagttatctctgcatgccgctcctcctctgtaaaggtagrgctgtgggccacrtctgtgtttcccagtttgggggacacaagtgatcgtaggtggcacattgacagctcacttgaataaccctattattgaagagaataatactgactcaagagacagtgacccgtgtcagttcccttttgaggccaacgggttaaggagraagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagccgggactacaggcacctgccaccgtgcccagctaatttttgtatatttagtagagatggggtttcactgcgttggccaggctggtctcaaactcctgacctcagatgatccactcgcctyggcctcccaaagtgctgggattacaggtgtgagccaccgcacctggccagtggagttccttcttaagtacatgtattgacatctttaaaaagggcgagaggatttacaggaaactatcaggtcagtaatggcaggggccgtccacagtgggtggctgagtccccctatttttctgctggtgtgcrgggaggtcatttcctgccacccatgtttccccaccctgaatccaccttcctcacattcccattggagggacactctctggacatatgggacctggggtcccacagggctgcattccaatgcctgctgtgccactcgccagctgtgtgatgttgggcatatcccataacctctttgtgcctcagtttcctcatctgtaacacaggagtgacaagagcacccgcccacagggctatgacagtacaaggtgtgtgatacagatgagctcccctgtttggcccacatgtgtcctaaaagccatgtgccctttctcttgagtgccccaggccacagagatccccatctgcccrctgtcccacacactggtctgtcatttgttccttgaggtttgtgagggccggctctgtgcatcccaggggcccaggctgggcctggttggctctcagggagcaggcacccgccaccttaagctcccatgctggtgtctgtcactgcttcctctcaatctggccaagccaggggtgtcgatttatatctctcaggtctggtttcccctttggcactgggccaggtatggggaaagagcaggaatggggcagttggctcacacagcagaggctcagaaagcggggggcatggggggaaggagtgcacagatgctagagagtggggcaagttttgtttggtcaataaatctccttctcatgccccaggcctgtgcaagacctacagagagtcccaaggatgggctggggggaagagaaaggtaccaccttcagagtccaaagatatgttatttaatattttcatatttctagatctgccttcaggcatggctggatccagcttctaggaacctgtccagctctgcgccctgctttattctgtactggcttcrtttttaggcaggctcttccctcatgtagtggcagatatgcctactagttgctccaggcctacatcccaaagccacagtgggaaaagggttttttttcttgacggttctaataagagtcctaaggctgctgctcagtggcctggcttcgatgctgtgccagcctctgaaccaatcactggctgtgggtggagagagggtgctggtggagggccctgcttgtccagggaggagtcacatacctgcctctagggctgcaggtgggctcagctccatccaaaccagatgaactgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactryaggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgataaaaggtttatgggtgtgaaaattcatggaatgtttgaggattatggggttgggggatgtgggaatatgtgtagcgataaagcaccaaacaaagccaaaagtttagttagagccctgaatgcctgcctcataatggtttccatattttatatgcctactatgtgccaggcacattgctcagggtcacacagctggaartggcagggctgagtttttgttgttgttgttgttgttgagacagagtctcactctatcacccaggctggaatgcaggggcgtgatcatggctcactgcatccttgacttcctgggmtcaggtgattctcccacctctgcctcccaggtagctgggactacaggcacaggccaccacgccaggctaattttttgtatttttagtagcgacagggtctcgccatgttgtccgggctggtctggatctcctggcttcaagtgatmcccctggctcagcctcccaaggtgctgggattacaggcttgagccaccgcatccagcccagatctgagatttgcacccagtatttgaactcccaagcctgtgctctttttcctcccatggacatttctctcagagatggtctcccaaacacctgtccttcttgttaaaaaacagacaaaccgcaagtagttctttggaagctcagatttctcttttgtttcttagtaaaacatttcccagttcccagctcccttccagggtgtaagatttcttcggtaacttacatctagctgttgcttcttgtttgctcatgtttagaaagaaagacaaaagagagtgagaattttctctcccttccccagtctccccacaactcacaccccaccctcagctccctctgtaataggaaaatctctgaactctctgtagttgctccagcaatcttttggaactttgcttctttcttgtgaaaaaacctccccttggctcactttgcaccaggtttccccaaatgtgcttccaaccacaagcagaaatggagctgccagtaaccaggaagaaactgccgggggctgaggaagaggagagggaggtgcatagccctggatctcgcagggagaggggtgacaggatgagaactcaggttgctcacttgccatcagggtcagtcatgaatatagcgttcatgtatcactttttaaagcttttttggagggtaaaagtaatagttacacaaaataaaaatacaaatggtacaaaaggacttagaatggaaacatgtttctctcccgactccagcctcctgtttttcttcccagagactgaccactgctgtctgtctcttgccagaagggaaagggaggcaaggttagggcaggcagagggcatgtgcatcctttagagagagcttatgtctatacaagcaaatgtgtgtgttcagtcatcgctgtcttagttttctattgctgcataataatggtactaccagcttcacagctttaaacaacacccatttattatctcatagtttctgtggttgggagtctggacatagcttagccaggttctctgctttagagtctcgtgaggctataatcaaggtgtgggatggggctgcagtttcatctgaggctcaattggggaagggtcacttctaagctcatacaatattggtgacattcagtccctggcaggctgttgaactgagagcctcagtttcstgctggctgttggttgtagttaaccctgaattccttcccatgtgccctttgcaaagccatcaaggcagagagacttgcctagcaagtaggatattacagtcttctgtaatataatcacatccatgaaatcctctatatatcccatcacctttaccatattctgtgggttagaaacaagtagcaggtcctgcccacactcgagaagaccagatgacacaaagatgtgattcaaagtggggatcatcggggccatcttaggtttgtctgcagtgatcactgtgccatctctctctctctcttttttttttttttttttcgagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttrgccagrctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaatagatcttggaagtcacttctcagtagaggctaggttgggcagagcattggattctaggccagtgagtttggacttgaccatggagacactaggaagcccatgaaggacagagagagatgcctcgaccctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacraaaactcagaaaggttaaacaacttgcctaagtaacatacagctaattagtcgaggagcctgacgcatgttgctctagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgcygtggtgtatctgccaggtaggcaggctaggctgcagtaacamacaagcccacaatttccatggcttaacactataggaatatatttcttgctcaygtaacaagctaacgtgaatgttgctggtttgtaggtggtttccctccctgtagaaatctggggagtgaggttctttccatcttgtggtgccatcattctccaggacaaagattcttacctacttttgtgtcctggtttcctttggcagcctggtgaagcctatggacctcatttcagaatatttttaaatacataaaatcccagcctgggcaatatagtgaaacccccatctgtacaaaaattagccaggcatggtggcatgcacctgtagtcccaggtactgggaaggctgaggtgggaggatcacttgagcccaggrgtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcrcataaatactgtaatttcaaagtagataagcataaataatactttatgatactgaaattgtgatgtgatatgagaatagctgtgagttttgttttgctggggacaggatcactgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttcccaaagtgctgggattacaagtgggagccagtgttcctggycccttcctccattcttaatggaaggagatgctaggtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacstacatcccagaaacractcttttcagtgaggtatcccacaggtctttcgcagtagaaatattgattatctcacataaaatgaagtcttacaaatggacctactgggttttgtacagcagccaagtgatatctcttcccttctgctgtcttcccttctgccrtccttcacatggtggcattgtatccttagacttgccacccatgccctcaggttggccgttgcacactgtcttacataaagcaggaaggaaaggaaaggctgctacgagagagtgtaccttgtgcatctcttttttaatcaggaagcaaacatctttctagaagcttccctagcaaaattccccttacatctcattggccaagactgttacatgttacatggttactgttattacttgctcattgcaaggaagactgggaactcaaatgcctggaaaaaggaacaggataatcgtgattggctcaagccttagggtgggcatggctccctgacaagggagagaggaaaaagctgttgagtgaagaagactgcttcagtttccccatctgtataatgggaggagtaagggctgtcgtgaaaactcaatgaaagaagattcttcaacgtggtaggtgcagtggcagctggcagtaccctgaccctgccaccgcacagccctctcagcattgctcrtcctgcactgtggatatcagttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgyatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggrtctggatgacagtgagtgctgggaagaaaataaaagcagaggaaggggatggagcgatgggcrgggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctgtgcttccggaaagaaagagcagcaagtttaagatctggaggtggcactgagctttggaggagcagggggcaatgaggtggccggtgtgacgaggactcaatgtgcaagagggagagtggyggggagatgaggtggaggggtggtcggcggtcagatcgtggagggtctcggacgagggtcctgaccctgggtctccagtcctgggaagtggagcccaggctgtaccatggctgacctcagctcatggcttcccctcccacttccagcctacagggagcccttcgagcagcacctcctgctgggcgtcagcgtttcctgcattgtcatcctggccgtctgcctgttgtgctatgtcagcatcaccaagtgagtcctgggcccagtgctgccgagcagtccctctggagtgcagggtggcagggacttgcccctctagtctgcccctttgcagtcctctcagtcaataatacgyatttactgagcagctactacacaccttgagagtagagctgagaacatatcgacaaggaccccacttttttctttttttyttttttttttttttttgagacggagtctcactctgtcacccaggctggagtatagtggcacaatcttgcctaacagtaacctccgcctcccgggttcaagcaattcttctgcctcagcctccagagtagctgggattacaggcgcatgccactatgcccggctaattttttgtatttttggtagagatggggtttcaccatgttggtcaggctggtctcgaactcctgacctcatgatctgcctgcctcagcctcccaaagtgctgggattacaggtgtgagccactgcacccaaccaggactccacatttctaaaaccggcatcctactggggagactgaaaatacatatcaatcacaaacaggtggttttccatagtgacccactctctgaatgcactagaccagggtgsaggccagagatcttctggggtgctttttgcaagggggaccaggataaggctctccaaggagggaaaatttgaggggggccctgactggggagaatgagctggccagggataagcaagatggagtcatcccacatccccttacaacrctgggtgcctgggcaactgggggcatttgggggcatgtggtaggagccagaggaatttgcgacgattgccctgatggagtcaggagacctgggtttgaatcctggccttggagcttggtagctggcggccgacaagttgctgaaacccctgagcctggggttcctgctttgcagagtgacagtgatggtgagaacatatttcatcagccagaagaggccaaatcacagtaaaggctgagggaggagatgagtggcgagtggctgggaggtggtggaaggagcctcgtttccagagagctcttgccagcccttggaatcatggtgtctcagagcctcagtcctcccatctctgaaatgggactagcaagctcaacctcactaagtcaggattagaggtggctaaggattattaacatgattgatgaaagtgcccactcttggcccagcacacactaggtaggcagggaatgcaaattcccctccatatcttgtcactgatgcctccgagcaaccttggactgatcgccttgctctgagcctcagtttccccatcacctgtacctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggcgcttgccaccacacctggctaattttcttattttaatttaatttwattttattttttgggacagagtggagtctcaaaaaccaagctrgagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcatttctttcgtttttttttttttttctttgagatggagtctcatgttgtcccccaggctggagtgcagtggcgcgatctcagctcactgcaacctccgccttccgggttcaagcgattctcctgcctcagcctcctgagtagctgggattgcaggcgcctgccaccatgcctggctaagttttgcatttttagtagagacggtgtttcaccatattggccaggctggtctcgaacttctgacctcaggtgatacacctgccttggcctcccaaagtgctgggattacaggcgtgagccgccatgcctggcctcatataagcatttctgtctccatttatcatccatctttccctcttgaaggtcagtttcaccaaggcaggcatctttgtctcgttcactgttgtrgcctcagggccaggcacagtgagtcaaacatagaaggtgctcaataaatatgtgtttatttattgaaaccatgggcagaggctaattcagaagcggtctgaggaccttacctcccagtgatgatgcaccatggccccaggcaggccaggaagagagaagggttgtgtttctccgtaggtcccccagcttcccaggccatcccaggccattccctggtcatttgccctcagctgctctgaaaaagggattgttgaggggaacctagaatcctctctctgcagtttgagtctttcctaatcccctggggtctcattcccactgaggacataggtggcctcctcaggaactctgtgctgggtaacagaatgcgggagtgtgaacctggctctgccacctaccagctgtcactccacctccttgggcctcactctcctcatctgtagaatagggttagcaatagaatccatgtcaccaggttagaatgatgagtcagtggtttgacctccagaaactaatcagcctgatctctgatgccaaataagtattggtgataacgaccacttttatgggaggagcgttcacctgtcaataattcagagatcaacaccttttccttttgtttttcaggattaagaaagaatggtgggatcagattcccaacccagcccgcagccgcctsgtggctataataatccaggatgctcaggtaggagtaggcgtggatgaggacatgtgggactgtgtacatgaagaagtgtggttcagaacacctgggctgttaaggaccttcactggcttctggaatggcaaatagacagtcaggagggttgcaggggagacagaggcagaagccgaatgaggtcattagcagaccagaggctttcccgcccttccccttggcaatcccagcctggggtgggcttctctggggttggtttcctgtttttttccctccccttgggagaatgacccttgggtcatcatcactgtgtcattccctggggaggtgccagtaccagggctagaggccagaaggagtggaggaaggagagggtgacaggctttctgtgtcttcttcttaagcataggaaactgcccccgaagcactagcaaatcccttccgggttctcattggcctgaaatgtatcccacccctaagccaggggtggagtcagcttccccaaggcgatggtcctgtgggtgagtgggtggggtttgcctgagcaagatgagagttctctaggtaggagaaagggggattataggtcctgtctagaagagaaggtctgagggtccttgcttttccagggactctggaatctagtggtgttggctttgaatcctgactctgccactcactggcagtgtggacttgagcaagttgcttaattctctgagcctcagtttcctcttgtgggttataacagtgtttacctggtaggacagatattggaatttattgagacaatacatataaagtgcatattccagcctcttgcaaataccaagtgccatttatgtatcagttagtgtttgctgtgtaacaaaygaccccgaaatgtagagggttacaacaactttatttagcttatgcttctgcaggctggcatttggggctgggctcagcagtgagggtggcgggggaggctgggctgggctgggctgggcagatctgaattgagctgacccgtccccgtagcctccctccgtgtctgacagttggctttttttttttttttctttttctgagacggagttttgctcttattgcccaggagtgcaatggcrtgatcttggctcactgcaacctctgcctcctgggttcaagcaattttcttgcctcagcctcccaagtagctgggattacaggcatgtgccaccacgccaggctaattttgtatttttaatagagatggggtttcttcatgttggtcaggctggtctggaactcctaatatcagatgatccacccacctcagcctcccaaagtgctgggattacaggcgtgagccactgcacccagcctagttggctgacttttacctgggacagtgcaggtgcctgagccatgtgcctctcactctccagcaggccggcccaggcttgtttacagagtggctcagttttcaagggtgggaagtcccaaggcttcttgaggcctaggcgcagcactggcatgatatcacttccatcacattctatgggcccaagcaagtcccagggccagtgtagattcaagggatgggaggagattcagagcactcctctgtggccacttttgccatcgaccacagtccctgtaaatattaggacaatgtaattaattcccaggaatctgaggctcagaaagcgtaagtgacctgttggacttctgatctgtgtgatgtcgaggcttgtaccccttcctgagcattgccgtactccaggccgggctgcaaggccactctgctctttcattggctgtctctgtattttaggggtcacagtgggagaagcggtcccgaggccaggaaccagccaagtgcccgtatgtatctgaacttaggtcacagcctgcatgcattgggaaggtgatagaattggagaggcaagcccctagctccatgtctgccttctcttccctgcattcggtaattgccctgtgacattagccttcaagggacggcaggaggaggggtgttctggaaacgtggactgctggccaagccccctgagtttcactggtgtgtcaggtacatggtgataccccttgggagtgctgttatagttaacaaccagagcagccgtgcctgttgttaaaatcttgacctaattgtatacttgtcggcaaatagccactatcctgaacactcccctccttttttttaatatacaggatctcactctgtggcccaggctggtgtgcagtggtgcgatcatagctcactgcaccttcaaactcctgagctcaagtgatcctcccatcttagcctcccgagtagctgatactacagatgtgcattaccacgcctggctattttaaaaggtttttgcctgtaattccagctactcaggaggctgaggcatgagaatcacttgaacccgggaggcagaggttgcagtgagcgcagattgtgccactgcactccagcctgggcgacagagtgagactcttgtctcaaaaaaaataataccaaaaaaagtttttgtaaagacaagctctcgctgtgttgccccgccactgtggcctccttagcttcttccctggggcctgctggacctttccatactccagaaactaaagggggtccaggaccctgcttcaaccctaggatcccgcatcttttttttttttttttttttttggacgcagggtcttgctgtgtccctcaggctggagtgcagtgattcactgcagcctcaaactcgtgggctcaagtgattctctagcctcagccttctaagtagctgggactacagtcatacaccaacatgcccagctaattttccttttttttaattcttgtagagatgtttgagacggcttgggctctgttgcccaggctgttctcaaactcctgagctcaagcgatcctccctcctcagcctcctaaagtgctgggattacaggcgtgagccaccgcacccggcttccatatcctttctaattggtcatggcttgggataatggtgttgcttttaattatcatcatccataaagactttttcttactcaacagatctgagcttgtatttggtgcccaggacatgtgctgggttcccgaaatcccaaagacacagaccctaccctcagggatttctcattctagcaacatagactgatcaattactgattataacgttagaaggcatgtctgaagtagacagccatcaggacatggtgatttcaggctgggctttgaagaatgaataggagtttttcaagtgtcgaaactgaaccctgaccaamctttgcttttgcagacactggaagaattgtcttaccaagctcttgccctgtttyctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggmgggcattgtggcccggctaacagagagcctgttcctggacctkctyggagaggagaatgggggcttttgccagcaggacatgggggagtcaygyctyctyccaccttygggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaacyccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcrggagtttrtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccycagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggkcctcgccccctacaacccccctgagggccccagacccctctccaggtggggttccactggaggccagtctgtgtccggcctccctggcaccctcgggcatcycagagaagagtaaatcctcatcatccttccatcctgccccyggcaatgctcagagctcaagccagacccccaaaatcgtgaactttgtctccgtgggacccacatacatgagggtctcttaggtgcaygycctcttgttgctgagtctgcagatgaggactagggcttatycatgcctgggaaatgccacctcctggaaggcagccaggstggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacrtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctrtgactaaagcagggacaatttgctgccaaacacccatgcccagctgtatggctgggggctcctcgtatgcatgsaacccccagaataaatatgctcagccaycctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttattttttatgtattaaccaaacatacctccagacactgctgtgagtgctgtgtctctgttaactcctggaattcacccatccagaggaaccaggatgcaagaggttaagaaacttgccgtctgggtttgggttccccatacaaggattcaaatagttgatttaggaagtaatcccgggaaaccctgctaaggtagtggggaactgaggcagggaaggacacaaaccaagaaagtgttacctgaaaggggtccagatgcagaccccaaaagagggttcttgaatctcatgcaagaaagaattcagagcgagtccatagagtcagtgaaagcaagttaatgaggaaagtaaaggaataaaagaatggctactccgtagacagagcagccctgagggttgctggctgcctatttttatggttattgattaattatattccaaacaaggggtggattattatgcctcccttttagaccatatagggtaacttcctgatgttgccatggcatttgtaaactgtcatggcgctgttgggagtgtagcagtgaggacaaccagaggtcactcttgttgccatcttggttttggtgggttagagccatcttctttactgcaacctgttttatcagcaaggtctttatgacttgtatcggtgacgacctcctgtctcattctatgactaagaatgccctaacctcccaggaatgcagcccagtaagtctcagcctcattttacccagcccctcttcaaagctccagtttaaataaacctctgacaaaagggtgagttattcaacagattaccagcatgagtaactgatgcttacctgccggggatctctggaagaccatgcatggcacatgcccagttatgcctgcaaaggagagggagctggggtatttgtccaccagctcccatctgtcattggctgagagctgcttccaggagcattaattctccagcacttccagctactccaggaaaaaaaaaattcttcaactgagagttggaggtgttgagagactctggcacaccaagaagacaggaacaggacaccaacagtggctgatgatacactgccaaggtcacacagctagttagcaacagatctatagtggaatccagacagtgtctccatcacccaggctctctgtagtgatctgcgcttcacatccgaggcaggcagagggatggtgtgggccttagatgggaaggctgggaacctgaagctcctatgtctgtatcacttttgcttctctgagtagctgccctgatttcacacttgaggggcttggccattttagattccttcctgctctaggagcctacatactacactggaaatgatggggagctctctacctcacatgcagcctgatgtttgttagaaacacctccttgcgccaggcatgatggctcatggctgtaatcccagcaatttgggaggctgaggcgggtgtatcacttgaggtgaggagttcaagaccagcctggccaatatggtgaaaccctatctctaccaaaaaataaaaaattagccgggtgtggtggtgggtgcctgtaatctcagctacttgggaggctgagttggtagaattgcttcaacctgggacgcggaggttgcagtgagctgagattgtgccattgcactccagcttggatgacagagtgagaccctgtctcaggaaaaaaaaaaaaaaacaaaaaaaaccttgttctaagccaaaatcaatccctttagctgcccaaatcacacagtttacagatggagaaacagttttagagaggaaaagggacttgcccaaagtcacccagagaatggcagagcctgaactagccttctggacttcttgcctccaaaagctctttataataaaatataattttaaataaaaatagttatctgtttagggccaagcaatatgctaagtgccgtccagccactgtgtcatttacgtctccaaacagctctagttgggaggctcaatgattatcccaattttacagataaggaaacaggtccagagaggttgaggattagcctagaaccacacagctaggaaatcctggagycaggatttgaacccgggtctgacctaagagctcccagccgccgtgatatatcagcttatgtcatcctgacacctacgcrgatgtcggctcgaatccactttgcctgagcattgtctcagagaaatctaatttaaaaattaggcagcaaatagaaaatatatttgactgctagagatgcaatgggactgggagcccaacaaaggatcttaggcaaaagaaatccaagttgttggcctcagcaactattactgaactggctgggctttgggaagctacagagggatgagaagacctggtggatcaggtgggcccaactcaggctggcccccaccctgcaggaagtaggaaaagtccagggtcataggcccagtgagatgccggctgcgggagtttcagcctccggggctggaccagagggcaggaggggacgcccctgggtagcagcgccagagtgggctgagtggcctgggcccctgcgggggagctttcagagatgttgatttgggggtactccctcagccctgcctttacacagaatttgtgggggatgaggggagggggaaaggggggaggaaggcagtgagtgcatctgaattttttttttttttttacaaaaagtggcttattgcatttttctgattactctatcagcacgtgcagaccttttcctattcagagaaagcctgaagatataaagaggaaagtgaagaaaaaccaccggaaatcccatccccgccccagcatctggcactgtgtgggcgatcacgaaatgagcgcttgtttttgaaggcgtagtatctccgtgaacatccggttgaacaacctttctgactttatttttcccacgaaagttattaattaaaaaacaaaaagcaaaacaccgaaaaaacaaaaaacccagcaagtgtttgagctcccaccacgagggaggcctgacgtcactggatcctcccggcagccgatgaggctgcatgggacttgcccacgatgtgctgttaccgagtggcatagccaggcttcaaaccagagtcctagctaaccgccctgtatataccatgggctcatcatcttccctggttccagctcagaacagagactcagaggaacaagggctctgcgctcaccctgcctggttaggtccagcctttccaattccaagctgtgtgaccatgggaaaagtgtttgcccactctgggcctaaatttcctccttggtaaaaggcacacaagagcagtactctgcacgccacagtggtggggtgagcagcagatgacgtggtgggtggaggccaggtgacaccaggctgctctcaagcttaacttgcctgtgatggtggcgggaccgtgtcagttcttccaccaaatcccacctgtttccacgacgtttattgacaagtcaggggcaccgccccgggtggagggggtgtgaagaggaagtcagctccctggtccctgctgccctctggtgaccacatcagcatcagcacctgctccatcccagcagctccaggtccaggccgtgcccagaaaacttggcctgggagattccccacccgccctgccccgatcccacctctcttccatctctgcattttccagaaattcccccagcaccagacaaaagagcctaatgtccattagatatgctgtgtggcgccaggccagcgtgtaacctctctgtgcttgattcgttatctgtaaaatgggaatcattataatatctgcctcatgtagctattgtgagaattaaatatgttagtacctgtgaggtccttagaactatgcctgcggctgggcacagtggctcacgcctgtaatcccagcactatgggaggccaaggtgggcagattgcctgaggtaggcgtttgagaccagcctggccaacatggtgaaaccctgtctctattaaaaatacaaaaatcagccagacatggtggcgggtgcctgtaatcccagctactcgggaggatgaggcaggagaattgcctgaacccaggaggcagaggttgcagcaagcggagattgtgccactgcactccagcctgggcaacaagtgggactctgtctcaaaaaaaaagaactatgcctgcaaatagttaatgccttaaaagtatttgctaacattcttcttcttcttcttttttttttttttttgagacagggtctttctctgtcacccaggctggagcgcagtggcccaatcccggctcactgcagccttgaacacctgggctcatgtgattctcccacttcagcctctcaagtagctgtgaccacaggtgcacacaccactaagcctggctaatttgttttttaattttttgtagagacagggaatcactatgttgcctaggctagtcccagactcctagggttcaagcaatccatccacctcggcctcccaaagtgctaggattacagatgtgagccaccatgcctagtctgctaacattatccttaatattacactgaatatgtctgtggattttgtgggaggtgagggtataaaacataattagaggaaataatgacattctaaatttaatttgactttattacaaaaagggcagaatggagcaacagtaatccaggacaaaaaattgtcccaatcccatcattcaacccacttgtgtttgtatctgtttgtgccacttctgtgtgttgtttacatgcagagtcagtgtttgcgtatttgcggttttatatcattcatttctcatcatacatacatatatttatattcctgacatttttctagggaatatctttatattcctgacatttttctctttttcccttatgttcttccataccgggacttataggaccttgcccagactcaacttccctcttccccatggacccaagttgctgagcttccaacaggtgtttacagcaaaggagaatgagacagagagaagcagagatgcagagagaaagacagacagagaagactaaactgattgatcccaactccattatgatatctgactccaaccacagaatgaccctgatccagccacagactgacttctgatcctggccacagtccacctcctgtcctcagccacagaacagctctgactcaagccaggaactgagtcccgacccatgttactgacttactcatgatcctggttgcaggctggccccagccacatgctgacccctgaccctcaccacagatggatctttgatcccagctataggctgatctctgattctggctgccctgaaccaccactcctatatactgatgacccaccttagcgtgatcccacccaggaactggcatttcctgggacaggctcttggccacctgctgctctgccctgggcacaccaggccctacgcatcctcccccttccaccaccatccatgatttcctgatttctagcagcaaatttagcttgagttggtcaacatagctgggctgcctgaccttcctctctgccatggaaccacagagcaagtcagcagttctccttcctaatcaaaaagcagcatggaggagaaggctcctttgccaccttcctttctgctttggatggtgcttttgcaatcatgaggagacaagcctggagatgaaaggaggcattctgaatatggtggagtggaagaagaagaaggcctgcctggggctttgattacatcaccaagtgatcaaaccaaccttaaattcttaaataaactgtaagtgtgcttttctttaaaccactgtgagttttcttttgcagtcataaagcaaccttaaaaattgtagtaggtacaataatgaaccccccaagatgtccatgtcccaatccctggaacctgtgaacatgttacattacatggcaagggggggattaaggttacagatggaagcagggttgctaatcaactgaacctgagatgtagagggagattatccttaattatccagacaggcccaatataatcccaaggatcttca

SEQ ID NO: 17637 - DNA, 56510 bp, Homo sapiens
ggtggctcgtgcctgtactcccagcattttgggagggtgaggtgggtggattgcttgaggtcaggagtttgagactagcctggccaacacagtgaaaccctgtctactaaaaatacaaaaaatagcctggtgtcatggcacaaacctgtaatcacagctactcaggaggctgaggcaagagaatcaattgaactcgggaggcagaggttgcagtgagcagagatggcaccattgcactccagcctgcgcaacacagcaagactctgtctcaaaaaattaaaaaaaaaaaaagaaaaagaacatgcagattttccttcagtgtcgggcatggcggtgggactggagactgcatttcttttcttttttttgagacagagtctcactctgtcacccaggctggaatgcagtggcacaatcttggctcactgcaacctctgccttccaggttcaagtgagtctcctacctcagcctctggagtagctgggactacaggtgcccgccaccacacctggctaattttttgtatttttagtagagatggggtttcaccgtgttagccaggatggtctcgatctcctgacctcgtgatccacctgcttcggcttcccaaagtgctgagattacaggcgtgagtcactgcgccgagcctggagactgcatttcttaccagctctgaggtgatggatgatacttgcttctgctgctgatgtccctgttccagagaccacacctttaatggcaagggtgaggggattctggaatccgaatacctgagtctaaatcctagctctaccccataacaactgcatgaccctgggcaaaatacttaacctctgagagcctcagtttctgaatctgagaaagggggaaataataggacttagcgaattgtgagaatcacataagataaggtatagaaagcacttagcacgatgcctggcacatagtaggaactgtacactaagattaataagcagattgggcctcgtgcggtggctcatggctgtaatcccagcactatgggaggccaaggtgggtggatcacctgaggtcaggagtttgagaccagcctggccaacatggtgaaaccccatctctactaaaagtacaaaaatttgccaggtgtggtagtggttgcctgtaatcacagctactctggaggctgaggcaagataatcgcttgagcttgggaggtggaggttgcagtgagccaagattgtgccactgcactccagcctgggagacagagtgagactccatctcaaaaaaaaaaaaaaaaaaagagcagattgggcctggtgaagtggctcacacctgtaatctcagcactttgggaagccaaggaggcaggatcactcgaggccaagaattcaagtccagcctgggtaatataggaacaccccatctcttaaaaaaaaacaaatttagccaggtgtgatggtgcatacctgtagtcccagccactccagaggttgagatgggaggattggcatgagcccaggagtttaaggttgcagtgagctatggctgtgccattatactccagcctgggtgacacagtgagacattctctctaaaataaaaaataaagcagattgaagaaagcgggcttctagtagaaacagagacaggaaaaaaggcagaaagtaacttccagatcaagaactgagctggcctctgggcatggctgtctcttctactgcttttttgttcaaccacctcatgtgttagcccacatggaaaatgcttctgctttgtaatctgcactttttatggggcttgttcagatggtgctggtataaaggctgaaacccacattgctggtgggaactacctatggggtttccttgaatttggtgccaccgcacctgctcagcgaccgtgccttgatgtgctttagatcagccatccctaaattgctatcctgtcgcttcagtccaagcagaaagaagcgagtaatgagtccatcctgatgaacaattcagggaggaacattcttttcttcccctggtgagacttcattgactacccaggcaagaagcagcaggagctctgaattaccgtgatcttgttagcagctatggcttgccattggtggagcaggtacatcttgtgctgaaggatgctggtagggcagaacactcatgaaaggctactggcctgattttttttttttttttttttttttttttttgccaattcaagagaattgtctgtacaactcttagtcttagtcttatttctcctggacattcaagactctaatagtaggctaactcattttttatttgtaactaactatcaaagcctggtataactcagtgagaaaaaaaaaatcctggttagaaatgttgcaaacaaacaaaaaaaatcttctctaatatgtgaccaatcccacagtagccacaatggcttagaaggcatttgaagtctcttctacagcagtctcatggggccttttttattgtatcagaaggatgaaagatgggtcagctcctccaggattcttatcttttatttcaggagtcttcagttaaacctgagcttcagaccttttccatgtaattggatccaagtcaggacctcagtctctgtttcccacctttgagtttaggagagcaagctctagggctgcatgaaacaagaggtccttttaccaataaaaaagagaggccaggtgcagtggctcatgcctgtaatcccagcactttgggaagctgaggagggcagaccacctgaggtcaggagttcgagaccagcccggccagcatggcaaaaatcccatctctactaaaaatacaaaaagtggctaggtgtggtggcacacgcctgtagatctagctactcaggaggctgaggcaggagaatctcttgaacctgggaggtggaggttgcagtgagccgagatcactgccactgcactccagcctgggcgacacagcaaaactccatcacaaaacaaaacaaaaaacacacacacacaataaagatgggacaaaaagaagtgtcttggtctgttcctgctgctataacacaaataccttgaataggttcatttataaacagcaggaattcatttttcacagttctggaggctgggaagttcaagatcaaggcacctgcagattcagtgtctggtgacggctggtctctgattccaacatggagtcttgtcactgaatcctcacgtggcagaaggcatgaattcttactacatcctttcatggcagaaaggctaatactggctgaactttcttcctcaaacccttttataagggcattcatcacttcataaaggtcctgcctcttaatactgttgaattggggattaagttttgacatgccttttttttttttttttttgagacagatcctcactctgtcacccaggcttgagtgcagaggcgcgatctctgctctctgcaacttctacctcccaggttcaagtgattctcctgcttcagccacccgagtagctgggattacaggcaactgccagctaatttttttgtatttttagtagagatggggtttcaccatgttggccaggctggtctagaactcctgacctcaggtgatccacctgcctcagcctcctaaagtgctgggattacaggcgtgaacaactgcgcctgacctatgcctttttttttttttttttgagacagagccttggtctgtcacccaggctggaacgcagtggcgcagtcttggctcactgcaacctccacctccggggttcaagtacttctcctgcctcagcctcctgagcagctgggattattggtacccgccaccatgaccgactaatttttgtatttttagtagagacggggtttcaccatgttggccagtctggtctcagacacctgacctcaggtgatccgcccgcctcagcctcccaaagtgctgggattacaagcatgagccacctcaccgggccttgacatgcattttggaggcacacaaacattcagccatatcaggaaggttcagcagtccgagtccaaattggtttcaggcaatagcagccctgatgaatgtaatattccagatggatcagttgcacaggtaacctatagcttgtgtcttgagtcaacacatttctcattttaaccatttctcatgcagatctttttgaaatgcacttcacacactttaatatggaaaattcaatctattttccatggattttgtaatcatcattacgatattctttattctagttacaagctcaggaattgttgaagtgtagacccatacacaaaacagcctcagaccctcaacttttataactaatctttattgcttttttaattacaaagtgatacggtcttaagttttttttaagttatgcatttttttgtgtagtttttactatctccttctagactattcgcctggcatgttgtcacttttgtctctctttaatgtatttctagcagcatccctctcatttataatcattcatctagattttggctggaaaactgcacaatcaggctaattacaattgtgtgtgaagaatacccttaagacaaacgcttagccaaccaatatgactgttaggatagaaggatagaacttaccagtggatttggcatgaagtttacactgtggaatcagataggcccaagtgtaaagtgcctcttattggtattgggagcttcaacaaatgaccttatcatcctcagtttcctcggtgtaccttcagtttccttaatgtaaaatttaaaaaacaaggctgggcacagtaggtcatgcctataatcctagcatcttttggccgaggcaggtggatcacctgaggccaggagttcgagaccagcctggccaactaggcgaaacccccatctctactaaaaatacaaacatgacagacgtggtggtgcacatctgtaatcccagctactggggaggctgagacacaacaatcgcttaaacccgggaggcagaagttgtggtgagccaagatcacaccactatactccagcctgggtgacagagtgagactctgtctctagataaataaataaataaataataaacaaaacaaaacagaacacctaacttgcatggctattgtgaggattaaagggaataggatgtaaaacactcatgacagtgtttggctcgtgatggtgactcgaggaacactagtttcctctctcatgcatccctcccatgtatcaggatattgtggcagaatgtgtctaggacaatagttctcaaacttgaacttgcatcagaatctcctagaggacttgttaaaatatagattgctgagctgggtgtggtggctcatgcctgtaatcccagcactttgggaggccgaggctggcggatcacgaggtcaagagatcgagaccatcctggccaacatggtgaaaccccgtcgctactaaaaatacaaaaattagctgggcatggtggcgcatgcctgtagtcccagctacttgggaggctgaggcaggagaatctcttgaacccagcaggcagaggttgcagtgagccgagatcgagtcactgcactccagcctggtgacagagcaagactccatctcaaaaaatatatctatatctatatctatatatagatatagatagatagatagatagatagatagatagatagatagatatagattgctgggccacaaccccagaatgtctactttaggaggagcaggttgggtcctgaaaaatgtttcataaaaaatttccaggttatactagtgatggtgatgctgctggtctgggggccatacatcgagaaccatcagtctaggaggtagatatacttgcatccaaattcctgcttggccccttggcagttgtgttaatttgggcaagttatttaacttttctgagccacagtttcctaatctgaaacaggggcacgataacttttgcctgataaaatgttgtaacgtgatatggcagttgggaaagatctagtacttaataaatcttttttttttctttttctttttttttttagatggagtctcgctttgtcactcaggctggagtgaagtggcatgatcttggttcactgcaaccactgcctcccaggttcaagcaatcctcctgcctcagcctccggagtagctgggattacaggtgcctgccaccatgcccggctaattttgtgtgtgtttttagtagagacgggattaagtcacgttggccaggctggtctcaaactcctggtctcaagtgatccacacaccttggcctccaaaaatgctgggattacaggcgtgagccaccgcgcctagccaataaatcttcattaatctcaatgttgccttctttgtggcagagtctcttcctgtttagcttaaggacttgtagtgttccaaggaactacagcgactagatgatactgcccctaaaattatgtacatcttatcttagaacctttaaaataagacatctgtcatttctcaagaaggacaataataagatctgtagtaggtagcaaattttgatcctgagcaggtagcttaggacgccaatttcattaacttcccaccggtttatcttctggggcaatgaaggattaatttaaaaagtactacatcctgaagactgaaaagagttttacggaagagcatatacaagttcatgagtaccttctctattgggtatatgtgggctgtgggctgtgggttgagagcagctacccagaggcataaaagcattctcataagttgcaaagcaggtacaacgctaattgaatttgttctgctcagatgacatactctccaggaaagaaaaaaaaaatgttttcctgctgtgaaattggtttgctggtgttctgacaaatgaaagccttatagtaaaggcatcaactttaattattcatttctatttgcttaaagacatattcttatgtgacatacatatgctcatacatttccttgttgtaacaacatgaactaaataagtcactttcacacataaatgaaactccatgaattattattgctaacgcacgttctctatattattcagctggagaaaaagtaatgtttgtgtaatggggaagaattacagagcgaaagatgaggatctttttagtgtttttttcaggtagacaggaaaaaaggcaaaggctaccatctgctattactgatgatattactgaggaattgatacatttctatctatagagatttattaatgtacaactggttctacaactttatttgttcagtctacataaccaaaatgaggcttcaagtccggaagttccctgttacccaaggcaaacgtattagggtctgttctgccatctggtgttctttgaaggaaacatccacagaggcattatgagataaatagccagtgttgcctatgttggtggtgggtgttacaacctcgatgaaaagcaattccagaatctctgccaaattccaataggagataatttgagaatatatattaagaagaaaaatatacatacccttggagtaccaatttcacttttatgaattcatcttttggatatatttatacatgtgcacaaagaaatgtatataaaaatattcctagcagtactgttggtaatagcagaagattggaaacaagctaaacatccatgagtagggtaccagttaaataaattgtgacatattcctacaatggatatagtatagcatgttgttgtttgaaaaaaaagtcaaatctatatttacagatatgaaatgatcaccaagacacacacacacacacacacacacacacacacacacacacacatatatatatgtgtatatatatatattttgttttgttttgttttgttttgttttagatagagtctcactctgtcacccaggctggagtgcactggtgtgatcttggctcactgcatcctccgccaccctggttcaagtgattctcctggctcagcctcccaagtagctgggactacagatgcatgccaccacacccgggtaatttttgtatttttggtagagacagagtttcgccatgttggctaggctggtctcgaactccygacttcaggtgatctgcccgcctcagcctcccaaagtgctgggattacaggcatgagccaccacacctggcaccaaaacattgttaagtgaaataaacatgatcaagaacaatgtgtatcggtagggtgtggtggctcacacctgtagttccagcactttgggaggccaaggggggcgaataatctgaggtcaggagttcgagaccggcttggcaccaacatggcaaaaccccgtctccaccagaaatacaaaaattagccagtcatggtgcatgcgcctgtagtctcaactaccctggaggttgatgcaggagaatcacttgaacccaggaggcagaggtttcagtgagtcaagatcatgccactgcactccagcctcggcaacagagcaagactatctcaaagagagagagagaaaaaaagtaacaacatgtgtaatatgctgaaatttgtataaaaatgttcataatgcataggatatttctagaaggtttaatcaaaaataaaattttgaaggcctccccacaaccataggaatggacttcctccttggccaggacacctaaaatttagcctgaaagacttgttcaggccatgatggggaagtgggggtcagatatgcctcattatacccctccagcattaacatcaatgcagacttttaagtctgatatgaaacatttacaatctagtctcactgaagcctgttactgctacttggaggcttcatctgcaggataaaactttggtctccacaaccctttatcttttttttctttttgagacgtaatcttgctctgtcacccaggctggagtgtagtggcgcaatctcggcttactgcaacctccgcctcctgggttcaagcgattctgctgcctcagcctctgaagtagctgggattacaggcgcccatcaccatgcctggctaatttttgtatcttttagtagagacagggttttgccatgttggccatgttggtcttgaactcctgatctcaggtgatccacctgcctcrgcctcccaaggtgttgggattacaggcacgagccatcatgccyggcttcacaatcccttatcttaatcacagtataattaaatctacctatgacctggaagcaccccctaatctgccactgcttcaacttgtcccacccttccagatcaaaccaatgttaatcttacatgtattgattgatgtattgtgtctccctaaaatgtataaaagcaagctgcacccccaaccccatcccctgctgaccaccttgggcacatgtcatcaggacctctgaggctgtgtcagttgcatccttaaccttggcaaaaataaactttctaaatttgttgagatttgactcagatactttttggtttaccaaggatactcaagaaagtggttggccgggtgtggtggctcacacctgtcatcccagcactttgggaggctgaggtgggcggatcatgaggtcaggagatcgagaccatcctggctaacaaggtgaaacccctctctactaaaaatacaaaaaaattagccaggcgtggtggcgggtgcctgtagtcccagctactcgggaggctgaggccggagaatggcgtgaacccaggaggcggagcttgcagtgagccgagattgtgccactgcactccagcctgggtgacagagcgagactccgtctcaaaaaaaaaaaaaaaagagtggcaaccgtgattgactttgagggcaagaaccaaggtgatcaccagtgagaaggtaacttctctctcactatttacatattgtactgtagaaatacttttcttttttctttttttcttttttgagacagagtctcactcttgtttcccagtctggagtgcagtggcatgacctctactcactgcaatctccgtctcttgggttcaagtgattcttctgcatcagcctcccaagtagctgggattacaggctcctgccaccacacccggctaatttttttgtattcttagtagagatggggtttcatcgtgttggccaggctggtctcaaacctgtgacttcaggtgatccacctgcctcagcctcccaaagtgctgggattacaggcatgagccatcgcacccagcctagaaatactttttaacatgtgcttgtattaccaaaccctaatatgtatgcttggatgacaatgaactaagctgacttgaagcctcattttggttttatagactaaataaattgtacaacattgtgtgtgtgtgtgtgtktgtcttttacagagtttcactcttgttgtccaggctggagtgcaatggcatgatctcagctcattgcaacctccgcctcccgggttcaagcgattctcctgcctcagcgtcccacatatctgaggttacaggtgcctgccaccatgcccagctaatttttgtaggtttagtaaaggtggggtttcaccatgttggccagactggtctcgaactcctgacctcaggtgatccacctgactcagactcccaaagtgctgagattacaggtatgagccacaacacccggccagaactttaatacatctctatagatagagatgtttcatcagtattgcctaacacatgttaaaaagttcaaataacttttaaaaactagtgtcctgctgtagttctagattgtcatgactattaccaacaaattcactgaaaaatatattttttaaagaaaaaaaagagaattcatcccagtaaacagtttgtaaaccagggagatgcagtctttggtacaaaacaaaggtgcattctgagagaataaagagagaagttatcttttatagagaaagttccctcccaggttcccactctggtctgcttatgcaaatgaaggatgcaaatttatgtagttctgattggtcaacacttgctgagttccagttggctgatgcagatcacagtctattgactgatttaggtcatgtaaatagaaatagacaattcacactactatatggcccaaatgttaaatacgtaaaattcaagacaaaaaatttttctcttatgtccattgctgtgatctagtgttagccatggtcttttgttcaaataacatgaaatgagggcataagatttttttttttttttgagacaatctcactctgtcgcccaggccggagtgcagtggcacaatctcagctcactaccacctccacctcctgggttcaagtgattctcatgcctcagcctcctaagtagctgggattacaggcatgtgccaccatgcctgggtaattttttgtactttttagtagagactgggttttgtcatgttggccaggctggtctcgaactcctggcctcaagtgagccacctgcctcggcctcccaaagtgctaggattacaggcgtgagccaccatgcctagctgagatttttatatttatcatgctgattttgataaatacatctcagggactaacatctacgtgtggaagaaaaggagggtcaggagttatagtaatttcttcccccatttacagccacatgaagctctatcttgctactagctgaagacaagcagtaaataataaactgcattggcttattttgaaaaatgactttgagaaaggttaagaaacactattcagtggcaatcttatcttttaactgaggctttgcaagcagctgctgctggggcctcaagagatgtgataagatgacaagattaactttggttatgtaggggaagaaaaataattttctttctaccctccatagttcttaactgggactccctgagcagattaacaagagaaaaacaaacaaaagtttattagcgtgtatacctcatgtacgcatggaagaaaaccgtggagaaatgcataaacctccagagtagatctccaaggaaaagtttaatcttcaggtttaaatgctgccctttttattaaacaaagaaagaaaggtgtggggaaagaccccacagtctttcaagatggccagaaaaagcactgaaaagcaagggtcagttttgttgttttgttttgtttttttgagatggagtctcactctgtcgcccaggctggagtgcaatggcgggatcttggctcactgcaagctccgcctcctgggttcaagggattctcttgcctcagctttccgagtagctgggattacaaggatgcgccacagcaccaggctaatttttgtattcttagtagagacagggtttcaccatgttggccaggctggtcctgaacccctgacctcaggtgatccacccgccttggcctcccaaagtgctgggagtacaggcgtgagccaccactgctcctgrccaagggtcaggtttgttatgcagagttaagtccaggccttctccatcctttaggagtttctagtgattttctttatagatgtaaatttccttacaaaagggcgacttttctgaaatactcctgtgtctgcagtttctcaaaataaccagctcgaaataacccatacataaaagagacatattttggggtagcatattctggtctcctgcagtcatatttgggggtggtgtgtcctgagacctatcagtcaccttttctaaatcttttccagttctgccctctctctctttgggccaccacactggctctccttccatactttgactcttttgttccagcttcactgaggcctagaactcccttcaaggtattcctcctgggccaggtgcggtggcttgtgcttgtaatcccagcactttgggaggctgaggcaggcggatcagttgacctgtaattccagctactcgggaggctgaggcaggagaattgcttgaaccaggaattggaggttgcagtgagcagagattgcgccactgcacttcagcctgggtgacaagagcaagactccatctcaaaaaaataaaaagatatcccggccaggcacggtggctcacacctgtaatcccagcactttgggaggcggaggcaggcagatcacaaagtcaggagattgagaccatcccggccaacatggtgaaaccctatctctactaaaaatacaaaagttagctggrcgtggtggcgtgtgcctgtaatcccagctactcgagaggctgaggcaggagaattgcttgaaccaggaattggaggttgcagtgagcagagatcgcgccactgccctccagcctgggcgacagagcaagattctgcaaaaaaaaaaaaaaaaaaaaaaaaaaaaaaaatcccttctgtttcaaccaaaatgcttaccttttgaatgctactctatctgctatatgtaggtcatctgattaaattagttcattcatattacaatatgaatgaggcttaacttttccaggacatatttatatttgtattttctttttttctttctttctttttttttttttgagacggagtcttactcttttgcccaggctggagtgcagtggcatgatctctgctcactgcaacctctgcctcccggtttcaagctgattctcctgcctcagcctccctcagcctcccgagtagctgggattaccggcgtccaccaccacacccagctaatttttgtatttttagtagagatggggttttaccatcttggccaggctggtcttggactcttgatcttgtgatccacctgcctcagcctcccaaagtgctgggattacaggcatgagccactacacctggccttttttttttttaaggtagggtcttgctctgtcacccaggctggagtatggtggcactatcacagctcactgcatccttgaactgggatcatgccattctctcacctcagcctcctggttagttgggaccacaggtgcatgccatcatgcctggctaatttttttcttttgcagttttttcgtggagatggaggtttgccatgttgcccaggctgtatctgtattttccaaagagaattttattagcggaagtgaacttccagttggcaagtgttgccagggaaatggctctgagcaacgacattacttccctcmttgcttcccttatcagtcagttaatagctatttctggagcactgactgtgtcaggcactggtctacgtgctggggatgcagccagtaaagacagagtcagcccttgagaggcatgtgttgtgtgggacatttattggccrtaataaggatggcaccatgtctgagaggctgaaaaagagacccagagccagtgagcgagacatagggtttattgaggacttctacatggagtggtccaggggcagtgagctggacaggagaaccgtgacctgccaccacacccagctaatttttgtattttttatagagacggggttttgccatgttgcccaggctagtcttgaactcctgagctcaagtggtccatcagcctcagcctcagcctcctaaagtgctaggatgacaggtgtgagccatcgcgcctggcctgccctgctcatttttctacatagcacttaccttaacccttcatctatttgtttattatttatttatttttgtctttcttctcccactatgatgtcagcaacttcagggtagagattttgcctgctgtgttcacaactgtgccagcacatggctgaccttgaagaacagtcctggagtaaatgaatacttggatgaaaagtaggaaaagggagaaagctgctgatacaggtcagcagagccagatcacacagggcctagtagaccaggatggggagtttgcattttgttctaatttttttttttttttttttttggagacagagtctcactctgtcgcccaggctggggtgcaatggcgtgatctcggctcactgcaagctccgcctcccaggttcacaccattctcttgcctcagcctcctgagcagctgggactacaggcgcttaccaccacgcacagctaattttttgtattttttttagtagagacggggtttcaccatgttagccaggatggtctcgatctcctgacttcgtgatctgcctgccttggcctcccaaagtgttgggattacaggcgtgggccaccatgcctggcctttgttctaattttaatgtgaagccatggagcatctaagcagaagagtgacccaatatgttattttaggatgatcactcagttgaacttccagggcctagaacttgatgttatgattgacaggatgcacatcactttttgaagaaacccacttcattgctgaaagtctttaattattaaacattagggcaggcgccgtggctcacacctgtaatcccagcactttggaaggccgagacaggcagattacttgagctcagaagttcaagatcagcctgggcaacatggtgaaatccgtctttacaaaaaaatacaaaaattagccaggcgtggtggcaagcacctatagtcccaactacttggggtgggggctgaggcaggaggatcgtttgaaccccagaagtcgaggctgcagtgaactgagattgtgccactgtactccagcctggaggacaaagtgagaccctgtctcgaaaaaaaaaagaaaaagaaaaaaatccattttttcacacattgaatctttctttcttctctaaaactggtacccattaacccaaagtctgtgctcagaatccactgaraacaagtttaaaactccttccacataatggtttttgaaatatttggagactttcttagtcttctccagggtaggctttcatgatactttgacttattatcctgttacatgactttcagagttttcattgtccttcagagaggtctggcttttcagtatgctcctgaagaactgccaaactttggtctgaccaacacagtgcaaagcagtaattgtgttcaagactggagttttctgtgtctgaacacagcctaattcaattacacttcagctgtgtcactagcaggtcaggctaaacttgtggttgatggaaacatctggaacttcttcaagctsatgctgcttcctcctccacttcacctgcatgctgagatttgcagtgatcttgtgaaatgtatcctgtggtttccggctgaagtggtaaggtttttgagatcaactctctctgcgttctctcagttgcgtaacatctgaaaatttgtagttttgttcttatactttttttttttttttttttgagatggagtcctgctctgtcacctaggctggagtgcaatggcgccatcttggctcactgcaacctctgcctcccaggttcaagcaattctctgcctcagcctcccgaatagctgggattacaggtgcctaccaccacgcccagctaatttttgtagttttagtagaggcagggtttcaccgtcttggccaggctggtcttgaactcctgacctcgtgatccacccaccttggcctcccaaagtcctgggattacaggcatgaaccaccacgcctggctcttgtttttattctttatccaatttgttgaagatattgaacagaataggactgtggaaataattctatagtcttgtttttttttttacacagtctcactctgttgtccaggctagcgtgcagtggtgtgatcttagctcactgcaacctccacctttcaggttcaagagattcttatgcctcggcctcctaagtagctggcattacaggcatgcgccactacactcagttaattttttgtatttttaggagagatggggtttcataatgttggccaggctggtcttgaactcctgacctcaggtgatccgcctgcctcggcctcccaaagtgctgggattacaggtgtgagctgctgcatccagcctattgtcttattcttgaaattttttcttcttcgttttcttttccaagatggagtcttgctctgttgcccaggctggaatgcagtggcgcaatctctgctcactgcaacctctgcctcccaggttcaagcaattctcctgcctcagcctcccgagtagctgggattataggtgcccaccaccataccgggctaatttttgtatttttagtagaaacaggatttcaccatgttgggcaggctggtctcaaactcctgacctcaggtgatccccccacctcggcctcccaaagtgctgggattacaggcgtgagccagtgtgcctggcctgaaattttttcttaactgtcagcttttaaaataatgaactggggggtagaggagtatatttgtgtgtatgtagtgtgaggttccttagctgtgggatattggcagacagacaaaagtgaaggttttcaaacagagccagtagatgaaggggacatgccatggtgaagaaaattaatgagagaacacatagaaacaaaggggaaagcacagatattcttgacaggttaaataataagttgaatttcctttgatctaggagacaagggcagtcatctgtcaagctccttgacgtatttttgcttgttcacatatccagacattgtgaacccagaaaatctgaggcaggtctcagttaatttagaaagtttattttgccaaggttgaggatgtgcctgcgcccgtgacacagcctcaggaagtcctgacgacatgcgcccaaggtggtcggggcacagcctggctttatacattttagggagacatgagacattaattgctttatgtaagaagtacattggttcggtctggaaaggcgggacaacttgaagcaaaggcaggaagactcaaagcagagaagttacattcttttgagtttctgattagtttttccaaaggaggcaatcagatatgcatctatctcagtgagcagaggggtgactttgaatagaatggggggcaagtttgccctaagcagtttccagcttgaggtttccttagtgattttgggggctgaagatattttactttcacaatatcataagactgcttcttaagatccatggtcctctcgaagaggccagtatgaatcaacatcggtgggtgttcatactcactttaaacttaaagatttaggccaggtggggtggctcaagcctgtaatctcagcactttgggaggctgaggccggcagattgcttgaggccaggagttcaagaccagcctgggcaacatggcaaaacgcagtttctaccaaaaaacaaaagaaaacaaaacaaaacccaaaattagttgggtgtggtgacttacacctgtagtcccagctacttgagaggctgaggatcacttgagtttgggaagttgaagatacagagagtggagatcatcccactgtattcyagcctgggtgacagagtgagaccctgtttcaaaaataaatataaataaatatatataaagatttaagcttaaggccgggcgcagtggctcacacctgtaatcccagaactttgggaggccgaggtgggtggatcacaaggtcaggagtttgagaccagcctgaccaacatggtgaaaccccatctctactaaaaatacaaaaattagccaggtgtggtagggcatgcctgtaatcccagctactcaggaggctgaggtaggagaattgctttaatctgggaggcggaggtttgcagtgagctgagatcgtgtcactgcactccagcctgggcgacagagcaagactccatctgaaaaaaaaaaaaaaaaaaagatttaagcttaaaacaaaaagcaatagatgatatttgtgggagacattcatgcctctactctcttaaaaaataatgaatcattccccaagtcctcattttactttcatataatctagacctatggcagctaataaacctctgtggagtttgggtgtttcatgttatagctattgagcagaacttttcatatacagtttgtacaagcagctgtcaaatcacttagaagtaccatatcccaagccacagttcrgtatsttactcccaaggatgccagtagataactcatcaaatgctttactaaaagagggatatacaytgtagctaaagtgttgcccttttctactaacctaataacaatgtcaaaaaacatawttggatttaatttgttgaaaccttcaaatgttttgaagagagttcatattatttttcagtcatcatttcacattcatctacatacccataaaccatttgtttaacaattcataccattgggctgtggatttatgtcaaacttactgaggcttggctgtcagaatctattgcttttccttctgtgtcttcaggcatctttgtgttcatcgtttttgaaaatgtttttttctcccatcatgaaataatacaaacacattacataaaatttggaagcagagaaaacaagaaaaaaaaatctccttctaactcaaatactcaatattttggtacactaacttccagcattttttctagatatattctttttaaaaaaatttttaggccgggcatggtggctcacgcctgtaatcccagcactttgggaggctgagttgagcggatcacaaggtcaagagatggagaccatctggccaacatggtgaaaccccatctctactaaaaatacaaaaattagctgggtgtggtggcacacacctgtagtcccagctacttgggaggctgaggcaggagaatctcttgaactggagaggctgaggttgcagtgagccgagattgcaccactgcactccagcctggcaacagagagagagaccccatctcaaaaaaaagaaaatctttatgttaagttccagggtacatgtgcagaatgtgcaggtttgtgtatgtgggtatatattcttaacagtatcacagtgttgtacatgtattttttttaattgagacaggttttagctctgttgcccaggctggagtgcagttgtgtgatctcagctgactgcaacctctgcctctgagttcaagtgatcctcctgcctcagcctcctgagtagctaggactacaagcgtgtgccaccatgcgtggctaatttttgtatttttggtagagatggggtttcactatgttgcccgggatggtttcaaactcttgagctcaaatgatctgtcagcctcagcctcccaaaggtctgagattacaggcatgagccacctcacccagccaattgtacatgaattttaaaatacaattttcattttattagattgtcctccttaccatcctatattgtaaatattgttgatagtgaacttcccagggtcacaattacacgttttaacaacttggaatatgttttcctgggtttctagcccctaaattcattttggacagctagtttcttgtattattttctagctggacttttattccatcttcctgatatacatttttatttttcagtgtgagtgtaatttctttctttctttcttttttttttttttttttgctatataggtgttttagtctgttcttgggttgctgtgaagaaatatctgagactagaaaatttacagagaaaacagttttaattggcttatggttctgcaggctgtttacacagccagcatttgctgggcttctggagaggcctccaggaaattttattcatggtagaaggtgaagagggagcagggagcaagagaaggagctgggaggaggtgccacacacttaaacaaccagatctcatgaggactcaactcacacgtgccaaggaaatggtgctactcyattcctgagaaatctgcccataatccattcacctctcaccaggtcacaccttcaaccctgggaattacacttcagcatgagatttgggggcacaaatattcaaactctaccaataagtcagaagaaaactaacaattaaataatcggtctctctctttgtcagctttcaaccttakgtttagaaacttcatccttgtaaatcggaacaaaaattgggctaacctttcaggaaggcaactaggcagtatgtttgaagattcttaaatgttttaccctttgcttaagtaattccacatctaggactctatcctaaggaaacaatttattcaaaaattttataaaagggccgagtgaggtggcttatgcctataatcccagcactttgggaggctgacgtgggcggatcacttgaggccaggaatccgagaccagtctggccaacatggtgaaaccctgcttttgtaaaaatacaaaaaattagccaggtatgggyggtgggcacctgtaatcccagttacttgggaggctgagacaggagaacagcttgaacccaggaggcggaagttgcagtgaataagatagcaccattgcatctgcactccagcctgggtgacagagcaagactctgtttcaatgaaaaaaaatttgtaaaagaatcttggttgctctgcctatggggaagccattcttttactcctttactttcctaataaacttactttcacttaaaaaaaaaaagaatcttaactgtacctttattcataatggtgaaagatagcacccaaatatcccaaagtaaagaaatggtcaaaatagagagcatctacatgatgtaagattgtgtagacattaaagaaaaaagcaagctttgaagacacaaataataatctgggaaagtgctcatgatatgaaaataaaatayacaacaatataccgaatatgattccaattctgattatgacatatacaaatgctgaaaagaaataaccctaaatggtgatattataggatttttagtcatttcctgtttgttttccagattgatttaaatgatactgtattactctcataatgagaaaagtataattccatatgtacgaatcatcttccttgtgaaatacaataactcttccttcctctttccatcctgacttctacactttattgtctttgcattttttctgatctttatcacatcttggatttagtttagtcagctgagctcctgacattttatggacttggtttatactgtacttcgtttttttttttttaattttttttgagacagagtcttactctgtcacctaggctagagtgcaatggcactattgctgctcattgcaacctccacttcctgggctcaagcgattctcgtgcctcagcctcctgagtagctgggattacagacgtgcaccaccatgcctggctaatttttttttatttttagtagagacggggtttcttcatgttgaccaggcttgtttcgaactcctggtctcatgtgatccacctgcctcggcctcccaaagtgctgggattacaggcatgagccaccgtgcccggcctctatgctgtacttcgaatycatcccatgtaatattccccttcctccatcctttttttttctttcccaacctgagctcatcagaaaaacttcctgggaagtcayattagtttctctggctgcctcctcatcttctgcaccagatcgtcagcaaatgcatttccagaatcttattatcargctctcatctgttaaacctcattcccttttaggttttctggtgatgagatcatccccataatttctttctaattctcacaatatgtttttctaaatagtccgtgacacttgtgtgaaaggtctcaatgttctcttcttctttctttcgagatggagtctcactctgtcacccaggctggaatgtagtggtgcgatctcagctcactgcaacctccacctcccaggttcaagtgattctcctgcttcagtctcctgagtagctaggactacaggtgcgcaccatcatgcccagctagtttttgtatttttagttgagacagagtttcaccttgttggccaggctggtctccatctcctgacctcatgggatctgcccgcctcgacctcccaaaatgctgggattacaggtgtgagcccccatgcccggcctcagtgttctcttctttgtattccaaagcatcatggcctttttgtctcaaacttgtcctaactcagaacttcttgtgaagcaggaaaatgaagtgagctggggggctgataccagactctcacactgggactggacagagggctgagatgatccagccagctgaacagctgactctggagggactggctgcaatttgtggtggtcattggctgagagttgggtgacataatgaccctactgaatgtcgcagaaacatctatattattttctataccaagataagttggggagacttacaattttgctactcatggggactaaaaccgggtaagcagtatcattatgggacgctcatttaacctgcatgaaccacatgcctacctttgtgtgattttgtgtaggaatttcaaattctttggagtaagacatcagaggcatgtatattaatgacaagaagaatgttaatgagaactaactttcattaaacactcattataatatcaccacttagggttatttctttcagcatttgtatatgtcataatcaaaattggaaccatattcagtatataattatgtattttattttcatgccataagcaatttcccagatcattatttgtgttttcaaagattgcttttttttctttaatgactacataatcttacatcttggagatgctctctattttaaccatttctttgctttgggatattttggtgcttactttcaccattatgaataaagctacagttaagtatcctgcctgcattctaattgaatcctgactacacccatttgaagggggatttgtttatttatttattatttattttttgagacagagtcttgctctgttgtcaggctggagtgcagtggcgcaatctcagctcactgcaacctccgcctcctgggttcaaacgattctcctgcctcaacctcctgagtagctgaaactacaggtgtgtgccaccatgtccaactaatttttgtatttttagtagagatggggtttcaccatgttggccaggatggtctccatctcttgacctcgtgagccacccctgttggtctcccaaagtgccaagatgacaggcatgagccacctgcacctggctgggggttttatttattatctccattttagacatgaaaacttgactagagaatgttacttgcccaagatgacacagctactaagaggcagagccaggactccaactcaagtatacggtgattaaaacctctgtccttagccatgacaccatggtcttgccacagtgatgaacttgcccccattctctgatggggtcactctatgaagagccagagactatgctcctttttctatttggtgcacaccatcctccacagactcaatatcacaattatatctaagcacctttctccaaatccaatctaacacgtaacatatgggttggtgaatttgcctagcaaaattcctgccagtttctaagtaaagactttggcccctagctaggactccgttcctctggcatttcaggccttgatttcggggaaaaggggaaggaaattccttccttctaatgtatgcttcacaagagcagcacatgttctggttcatcagaatggccagtttcatattgttcatctcacagatgaacaccacagaagatgccattggtttggagagtggaatkaatggaagatgagtttatgtggcaacatactacggtttttcttcttccagtctctctttctccctgcactactctctgatcccagtgtgtcttctacactgctatcgatatactttcgaaaatacaaacctgatccggttcctccccttcaccgccttcaagataagttctaattcctaaacgtggcttacaagagcctttgccagctgggtgcggtggctcatgcttgtaatcccagctctttgggaggccaaggcaggtggatcacttgaggccaggagttcgagaccagcctggccaagatggcaaaaccccgtctctactaaaaatacaaaaattaggcccagtgttgtagctccgtagctaaggttctctcctttcacagtggtggcccgtgttcgattcctggcttagagaatgagtactttctggttaatatctgtgtgacttttggggctgggtatggtggctcatgcctgtaatcccagcactttgggaggccaaggcaggcagatcacttgaggtcagaagtttgagaccagcttggccaacatggtgaaaccctgtctctacaaaaatacaaaaattagccaggtgtgctggcatgcctgtagtcccagctactcaggaggctaaggcaggagaattgcttgaacccagaaggcagaggttgcagtgagccaagatcacaccactgcattctagcctgggcaacagagtgaracactgtctcaaaacaaaacaaaacaaaacaaaaaacaaacaaaaaaaacaaaagagcctttatcatctagttcctacccactctccacctttgtttgctgctattccttacctgaaatattctgcaccagcaacactcaacaatttgcaactgttgggtgcatgatgctgttttatgcctttgctctttggcaacaacctggaacatcctcatcattgccactacatccttatgtgcggggatacacatgcatctgacactttcttctatgattgtaattgtagcattgtacctcagtcttagtaaactgcgaactccttatagccagtagtcaactcttgtttatttctgaaattctgctatcaaccacaaattacagcttagtaagggcttagtagcagtttgtaaaaaaataaaataaaataaaaaagaaagcctgggcacggtggctcatgcttgtaatcccagcactttgggaggctgaggcaggcagatcacttgagatcargagtttatgaccagcctgggcaacatagggagacccccatctctacaaaaaataaagaaataagaaataaggctgggcgtggtggctcacgcttgtaatcccagcacttcgggaggcagaggtgggcagatgacttgaggccaggagttcgagaccagcctggacaatatggcaaaacgctgtctctaccaaaaatacaaaaaattagccagacatggtggtgcaatgacttgtgatcacgccactgcactccaacctgggtgacagagtgagacactgtcaaaaacaaacaaacaaacaaaaaacacccaaataaataaataaataaaagcattaatggcacttaggagaaaatgcacaagagactcagagctgtgtcatattcaaagtacagaaaatagtctcacttggcaagggagaaaatgtatgtggtagaaccgtattagctgaacttgtcttaggtgaacattgacgtgctagatcagtggatctttatccttacttcaatcatacttacctggacaattgttttaaaaatcactataccggccggccgcggtggctcacgcctgtaatcccagcactttgggaggccaaggcgggtggatcatgaggtcaggagatcgagaccatcttggctaacacggtgaaaccccgtctctactaaaaatacaaaaaattagccgggcgcggtggcgggcgcctgtagtctcagctactcgggaggctgaggctggagaatggcgtaaacccagggggcggagcctgcagtgagcagagatcgcgccactgcactccagcctgggtgacagagcgagactccgtctcaaaaaaaaaaaaaaaaaaaaaaagcactatacccagaaattatgagtattggtatttttaacaaacaattgggaacatctactatgcagccaaggataagactaactactctagataaaaatagaaattgcaacatatggatattagttttttcaaggtaaaagctacctgtattcagaggatcccagtgtccacacaaaaatgtcccagtgctgacttaggcccattattgatttctagacatatttaatcatgcccattaagccctgtgacatgtttataccccttataaatgcatatctagttcctgacatattttatcataaagagaaggcatttgaatcttttctctgaaatgtggttggtagatattgactagaattccaactcagaaggagacaacattgaaagtaggtttttaaacaaatagtctaaactgttgctaaatgtttaatatcatggtcaaagtctctgcttgggaagtaaataagaaagtttttgaacatgtgatgcaatgtggtttcaggaatacaaaaaccttggactctgaatccaggtctctatagtttaatttacaaattagcgtaagaaacgctataaagtcattaacagtttcaaaagacgaggtcccatgttacttgtgataaaaatgttgttattttatatattcttaaattctcaggtattcttgatcatgcttgtatatatatatacgtatattttatatattatatatattatatatacatatatattatatatatattttcagatggagtttcactcttgttgcccaggctggagtgcaatgagtgatctcagctcactgcaacctctgcctcctgggttcaaatgattctcctgtcttagcttcccaagtagctgggattacaggcgcccrccactacacccggctacttttttgtatttttagtagagatggggtttcaccatgttggccaggctggtctcgaactcctggcctcaagtgatccacctgcctcatcctcccaaagtgctgggattacaggtgtgagccaccatacccggcctgttaaaatatattaatagcatgttaagtgtaacattaaacccaagagttgccaatctttactgatgagtataaaccctgaaaatacaagacagccacttgatttgccaaaattccatattttttaacagtttttccacttgctctgccaaataaaacttcaatggtaagtttaaatgtgtctttaaaactgtcatttaacattggtaagcagccagctcctcagttattatcataggttagttttgggaatgtgaatcgaagtgcgtggagggaagatagatcagttaactgatcaaccagatggtgctaaagttatgtggcccaatgtgtcacaaactggaaggtgaaaataattgaaaggtgcaattgcatcttatctctccaaagacttcttcattagggccatgtgtgtttctggaagagttttaggaataccttgtagttctctctctttttttttttttttttttttggagatggagtctcgctctgtcacccaggctagagtgtagtggcgcaatcttggctcactgcaagctccgcctcccgggttcacgccgttctcctgcctcagcctcctgagtggctgggactacaggcgcccgccactacgcccggctaactttttttttgtatttttagtagagacggggtttcaccgtggtctcgatctcctgacctcgtgatccgcccgcctcggcctcccaaagtgctgggattacaggcgtgagccaccgcgcccggccaggaataccctgtagttctcagacatgttcaagttcagccggaggtaatggctcacacctgtaatctcagcactttgggaagctgaggcaggcggatcacttcagtccaagagttcgagaccagcctggccaacatggcgaaactctggctctactaaaaatacaaaaattagctgagcatggtggccagctgataatcatcataatcccaaaattatgattatgaataaattaatcataattatactcataatttattaattatgcagattaccatttattatctttgtatttaattgttcaaacaagggaaatttttaccagccgaagagtaaacatgaaagttgtaattacaaatgcatgtaacagcccacaaaagccgtcaaactaagtttgatttagtggtttctccattttcctgtcactgttattttgcataatttttcaaagctcagtagctggcaaataggagctgagtgtcaatgatggcggtggggtgggggccaagcttgtattcctctttagggggcgatgcaaataaaatttgaggcctcgtatgatccagtttaaaaatcacatctcaatagaaggactttcaaggaaaccacaaaaagcgtccttccttccttccttcttttcttccttccttccttccttccccttccttccttctttctttttctttcttgtgctctctctctccttctttccttctttctttctctctctttctttcttctttttctttttcgttattttttaaatgatttcaaattacaaacatacagaaaagttgtaagaatagaacaaaaacttccttgttctctttacccagagaccctagacccttccattcaagtgtcaccaaatgccccttcgggcccacactgtgcacccagttctcatgtccacctgggttccctaagtctttctttgcctttcatggcttttgcccttttgaagatgacagggcagtcattttgcataacgtccttcaatttgtgtgtgtacagtgccttctcatgacacaatccaggttactaagcttttggcaggaatatcacagaagtgacgctgtgtccttctcattgcatcctcttggtggaggacatacatgccaatttatcccattagtggtgacattaattttgattacttaattaagatggtgtctgccaggttcttcccctctaagtttctctttgtcycctttataataaatagttattttatgtggagacatgtttaaggctgtatgaacatttctcatcctacttgtatcccctgattctagcatcaattgatacttctttgccagaattaaatcgtttcataattatttccaaattacaattctctaagtccagtattcctctatattaattgcttggcattatactctaaggaataactttcttatctcttcacataattgttaatgtgtttattactatcactgtggactcactgattcctattttattcagtggagtataatccattactattattacttatttggacaaactgtcacatatttgaccagagaaagcaccccccgccccccgcttttttttttttttttttttttttttttttttttgagatggaatctcactctgtcgcccaggctggagtgcagtgtcacgatcttggctcactgcaacctctgcctcccgggttcaggtgattcccctgcctcagcctcctagctggcataacaggtacacgccaccatgccctgctaatttttgtatttttagtagagacgggatttcaccatgttggccaggctggtctcaaactcctgacctcaagtgatccacccacctcggcctcctgaactgctgggattacaggcgtgagccaccgcacccagtcaagaaagccactttcaaatggcttctctgtcctttggacatgtccctatcattctctgagcattacctaagttgttcaagatggtgttccaggctcatcttgtacttttccttgacccagttcaagaatcagccaattttctaaggagctttggtgcctttcgatggtggattgcatttatttatttatttagatagtgtctcgctctgttgcctaggctggagtgcagtgttgcaatctcattggctcactgcaacccctgccttctgggttcaaatgattatcttgcctcagcctcccaagtagctgggattacaggcacctgccatcatgcctggctaggttttgtagtttttgtaaagacagggtttcaccmtgttggctaggctggtcttgaactcctgacctcaagcgatctttctttcttcctgaagtgctgggattacaggcattagccaccacggcctggccaagaattgcatttaacaaccaatatttaggcactgtgtgtgctcattgctactggatgtactactgctattatcctagtggacagaactaagaattatatgtatattcaggcatacattcacacacatgtacataccattatatctatattgatttctgtatctgtttatatatacgcacaatttgtactgtctccattttcaatccaacacctcaaggttcatgctaactttccttctttccgcattgttacttctcttgttagtgagaaacctgacccccattatcctcaatatatttgcttgtttgctcaatctcctatatgtagctaagcttgtgacaccatcacgctgccatccttacacagataagcatgactttccccttgaggccttccttgtgacttttagactgagttaggatgaaaagaaggaggaagggaggaagagaggaagggaggaaaggagaaagagaggaagggagggaggaaggaaggaaggaagggaagaaaggagggagggaggaagggagggaaaaagggaggggagaagggagggaaggaaggagaagggagggagggaaggaagaagggagggagggaagaaggaggaaaggagtgcatagttttccarttgaagtataatcaagtaaacacacagatcttaaatatttggcttgatggcttttgaaaattgcatgtagccaagtaacaaccacctaaaatagaatataaactatttcgacacccctaccccaagtttcctaatgcaagggagcccagccaccaggaaacatcattaaaaacccttctccttgtcctctctcaatatcaggcactcagtttgtagctgttgctgaaaatattctcgtctcaattttaaccttttctcaaattttctttaactgatgcccgacctctttggtttctctctccttttccccttctacttcagatcttactatacagaacgacttggctcctcctgacttcattagttttctttcttcttcattcatcaaggagattctccacaataaagcggaacctgggaattatccagagaacaagaatctccttccccttagaaggacaaatagggaaggaccactgttatttcacattagtggcagcacactcttcttatcatggaacacaatgttcattaggatcgtaatttaagaatcatctgcctgacagatggagatttctcaagctgatgtgtctcagggaattttagacctctggatataaaccaagatcacccaaatgagagcaagcggaggttatttattcagagcttgctatagsaagggaggcagccattaacagttgtgtttggcagagactcaaagtcaaagtcagacagaggagtgggaaagctttataatagaaaaaaggaaaggcttcaggtgtgctccaacggattgttggtatggggaggatggaaggaaactaactagaagtgaggtgtccatgtgattggttagagaaatatgtttggatttctctggttggccttaagttgggccaactgctatagaggttgtaggtttggctttctagacctgttgctacagatgtgtgggtcagagttctgttttcacatatggcctggctattgtccatttatatatccttttttttttttttagagcaaatgatgtagaagagaactagggaatcaaagacaaccccccttccgaaccctctcaagcaacaacatcagcactggcccattatcttatcctactcaagtttttttttcttcttcgagtcccaagttgttaatttcaaatcaattttcaaattcctgaaacagatctagaaacctgtctagacagatccaagacataytaagaatggatgaggaggactttgtattgatctgacgtaagagaagatagagaattcaaggatagctctaaggtcctaactggagctataggagcttgcaagagaggatgttgagctcagtttgtagggaattaaagttgtaagtgcctcctggaagacattctttgtaattatacatctgaaaactggaacatcattttagagaggtggagactgagaacagagagtaggtgtttgtccaaagtttatatgccaaggctgtgagtgaaacaggagcttygatcttttggtgttccatctacaacatacacaaaacaaaagatggagaatgagaagtccaggcaaccccggaaacaacaagtttctgtcaaaagcaataatgaactgttttgtgccattaacaaaaacgttatgaagacagaaaccatctcccaaagatttcataacagagccacataagtggaaagtaaatgattaaagaatgtgggtctcagagttccattcaaatcaygatactttatcttctatttacaaagataaaagtacaccagaaaatggttaatgtttaagcgctttcatatttggctctgtctttttagcagacraaaacmactttggtagtgccagtgtgactcatccacaatgatttctccagygctcatcttgttctcgagttttctctgccatgttgctattgcaggacggagtaagtactttttgcttttgaaaaaataattaatatatccaaccccttcgtatatgtcagggatcaataatgataagtaggccgggcgtgcttgctcacatctgtaatctcagcactttgggaggccaaggcaggtggatcacctgaggtcaggagttcgagaccagtctggccaacatggtgaaaccccgtctttatgaaaaatacaaaaattagctgggcatcatggccgaggtgggcgaatcagttgaggtcaggaattcgagcccagcctgggcaacatagtgaaaccctgtctttactaaaaacacaaaaattagccgggcgtgatggcaggcgcctgtaatcccagccactcgggaggctgaggcaggagaattgcttgaacctgggaggcagaggttgcagtgagccgaggtccccccattgcactccagtctgggcaacaagagcaaaactcagtcaacaataataataataagaagaagaataattaaattctttttttttttttttgagacagagtctcgctctgtcgccaggctgaagtgcagtggtgcgatctcggctcactgcaagctccgcctcctgggttcactccattctcctgcttcagcttcccgagtagctgggaccacaggcgcccgccaccacacccggctaattttttgtatttttagtagagacggggtttcaccgtgttagccaggttggtctctatctcctgacctcgtgatccacccgcctcagcctcccaaagtgctgggattacaggtgtgagcaactgcgcccagctgataactaaattctctttagagtggatgctggagggactggattgatactgattctttaatattgccatgtgtaaagctcctctgtaagatacgtagccaatttaagcctcagcatactgacctgtaaaatggggataattataatacctccttcaaatggttgttgaggggattagatgagatagtgtatatgaggtatttggcatgcaacttggtatgcttataattggtaacagtacacacatttttcatttgtgggcttagctgaactttaaaatgcaaatagagatttgttaaccatctgctttgtgccctctttcagcctgtcccaagccagatgatttaccattttccacagtggtcccrttaaaaacattctatgagccaggagaagagattacgtattcctgcaagccgggctatgtgtcccgaggagggatgagaaagtttatctgccctctcacaggactgtggcccatcaacactctgaaatgtacacgtaagtcagtaccttctctcacattctcttccctcatttggattctgggtattttggaggaataagctacctcgtcatgctcagagtgcagagggccagtagatgctgcagaaagccaggttggagagaaatgagaaggtcttggggagttctctctgtgcaaagagagtaagggtaataggtgctattgatagaagaggagaagatcatagcctgaaactagggtaggtttaaaaatgagatctggtgtggcaaaaggagaaagaaacactacagaagttaaaagaacagtggagaggctttgaaatgtcaactgatgccaaagagacatttggaaaaacaaaatttggggaatcatcatatctttggacttcacctgaaaatgaaagcggacttaatagttactgaaatgaatacaaatttcatctacattatgtatatattatattataatgaaatacaagaaaagaggtcaaattaaaataataatataacgtaaaatatatcaatctcactatggctttactgtaaatggttgcttttatttatttcttagaacatggttctatgatatcatgctagcattattctttacagtcaagtattatgcaatcaaccagattgaatttatggtacatttaattatatgtagaagttaagcagtaaaaatagatgtatggatctggtgattttggttatatgaacaggacctttgtcaaagttatgcatgttcatgcaagttgattttactatgcttttttgcttaaagagcctaaacataatttttagtaaaaagccaatgtaacatcattagggaaaatttttctttaaatcagggccaggtgcggtggctcacacctgtaatcccagcgctttgggaacctaaggtgggtggatcacctgaggtcaggagttcaagaccagcctggccagcatggtgaaacctcgtctctactaaaaataaaaaaaattagccgggcatgctggcatgcgcctgtagtcccagctactcaggaggctgaggcaggagaatcacctgggaggcagaggttgtagtgagctgagattgtgccactgcactccagcctgggcagcagagtgagactctgtctcaaaaaaaaaaataaataaataaataaaataaaaatcagctataactctggaacactaaaaatttcatttttttattttccatgcatatctttttgcattactgcagagagcaggtataattttgtatttttctgttttcatcagcatatcataaaaattgtatctccacatatttcacaattcatattttattggctacataatagttcaacttttgatttaccatgattaattaaaacagtcccctgatgaacccttagactatccaattttttttttttttttggagacggagtctcactctattgcccagtgcagtggtgccatcttggcaccctctgcctcctgggttcaagctattctcctgcctcagcatccagagtagctgggactacaggcacccaccatcatgcccagctaatttttgtatttttagtagagatggggtttcaccatgttcaggctggtctcaaattcctgacctcaagtgatccaccctcctctgcctcccaaagtgctgggattacaggcgtgagccactgctccccgcctgtccaaattctgttattaggagaaacagtataatgaacgcttttgtacatatatcacttgtcttattttgaattgctttcttagaatagttaccagtaaagttattgaaccaaaggatgaaaatgaatttatatgtttcatttaatgaaaaattctataaatagaaatttacctgtttatgtttttttttagcccaaagaaaagtaacattttttatctttgtatcacagccagagtatgtccttttgctggaatcttagraaatggagccgtacgctatacgacttttgaatatcccaacacgatcagtttttcttgtaacactgggtaagaactttcatggaactaagcagttaacagactgagcacatttttgtatccttaagctaaacatcaagactggtctatattttgttttcagcctttaggttggactttcaaatgcaaatcgattttagtcctgcttttttttttttttgagacggagtctcgctctgtcgcccaggctggagcgcagtggtgcagtctcggctcactgcaagctccacctcctgggttcacaccattctcctgcctcagcctcctgagtagctgggactactggcgcccgccaccacgcccggctaattttttgtgtttttagtagagacggggtttcactgtgttagccaggatggtcttgtagcattgagggtggggtaaggattggagaatataacaactagtgcaatacgtagtcaccactgtatctaatttttctgctcctgattaattatctcagaggaggtacattaaaatgattgaacctggatgataattccatatgatctctgggccaaatcttggatagggttaaaatactttaggaataagacttgggctttagttattaggctaatttgattgaccaacctggtagtctctagaagagaattctatggagaaggttgggagtgtgacagtggagaatgcaatgcagttccacatccccaggaagcaatcacttgtggtgggcacaggctcatctgggagcaaagggaggcagtcacttaacggtgggcatagactcataaggagcaaaggcacccctgtgacattattgagagcacattggctatccactagggtaagtttctactgggattggaggttaaggaatactacatgtgagagagaaatacacacctttcatctgaaacaccaatctaccaatgggtctggtaacaaatgaccttaagaaaattggcttcgaagacataatgttacatttttctttctttttttttttttcctttctttttgctctgtcacccaggctagagtgcagtggtgcgatctyggctcactgcaacctccacctcctgggttcaagcaattctcctgcctcagcttcccaagtagctgggattacaggcgcctaccaccacacccagataatttttgtatttttagtagagatggggtttcaccatcttggccaggctggtcttggactcctgaccttgtgatccaccctccttggcctcccaaagtgctgggattacaggtgtgagccaccatggcatcctgctcctttcctttcctttcctttcctttcctttcctttcctttcctttcctttcctttcctttcctttcctttcctttcctttcctttcctttcccttcccttcccttcccttcccttcccttcccttcccttcccttcccttcccttctcttcctttcttctttctttctttctttttctttctttctttctctttccctccctcccttccttccgtctttcttttcttttctttctttctttgtctgtctctctccttccttactttttccttcctttccttcttttcttttctttttttttttttttttttttacaggatcttcctctgttgctcagtctagagtgcagtggcacaatcatggctcactgcagcctcgacctcccaggttaaatccttttgaatccttccttccacctctacctctcgagtagcttggactataggcacacactaccacggcctggtgactttttgtagaaattgggcctttgccacattgcccaggctcaaactcttgggctcaagtgatccgcccatctcggcctcccaaagtgctgggattacaggcatgagccaaagtacccagtcagaatgctatattttcattggaaatagactgcattgcttttattcattggtgtcagtaggcygtaagaaaatgaataatgaagattactcagtttggttcacttttgtcatcctgaaaaagagatggttctttgctttatattagaaacagtcatcttggccaactctttaaagatgagggatttaagggtttggattctccactcaccagctgtggaascctgcagtgattcacctgcatcattggttgggaggctccatgagcyatagatgagtactaagtttgtcaggaagacagcattatacgatggaaaagaagtcaatagcattaacatgaarcaatgctcaatggagaagatatttgagatgtcagtgatggattattttactccttgatagaatgaattttccttttgcaggttttatctgaatggcgctgattctgccaagtgcactgaggaaggaaaatggagcccrgagcttcctgtctgtgctcgtaagtctgtgggcaaggtgatcagctggtttgcccagaacctttctggttttagcactcaaagtctcacatctggaatctcttcagtcacagctcaatgagatgaatggtcacccttgtgggggatattcatcctggtatcttgctctagaagatgaaacaaccactttggaatgacagaagggaagcattttactcacggacacattctgtattctccacctcgcggtcattactctatctaagccagtcatttctgggtgtgttgactccaatgctctcatagtgctttggaagtggcttggatatgtgtggcattggtatatcagggactgtcaccacttaactagaggaacttctgcaaacagtgagatcaaacaaacatcttcctcccactctggaattcattcattcatttattaacttattcaataaacatgaattgaggatctactgtatgctggatcctcttgttagcactgaggctgcaaggccaaaggaggcagctttgccttcagagagtaagcctagtgacttacgggacagacgaggaggaaagtcaccctcacagtaagccaacagcccatcaaaggggcttgcatcctaggagctgattggcattcctccaaaaagcactgttgttttttcagaggatcctcagccaagctgtcagagtcatctctgggctttgcttatgtagggaaggacgttcttatgttccccaacttgtgatttatacatctttgaccaggaggcccaggcatttcaatactaattatagttcttcaacatgtcagtgargtctgtctttagcaaaagcaagaggagggcaggtgcagtggttcacgcctgtaatgccagcactttgggagtccgaggagggtggctcacctgaggtcaggagttcgagaccagcctgaccaacatggagaaactccgtctctactaaaaatataaaatcagctgggcatggtggcgcatgcctctaatcccagccaattgggaggctgaggcaagagaatcacttgaacccgggaggcggaggttgcagtgagctgagatcgcaccattgcactccagcctgggcaacaagagtgaaactccatctcaaaaaaaaaaaaaaaaaaaaagcaagtggaaagtaaagcaatttcaaataaataattgtttaagaagacctgaacaagcaaaaacgaaagtttttaaagkacaaattaagtaaaattttcactcagcagtaggaatcacgatggttcctacagttttcacttaaaacagatttataccgattatgtaaatttgcttctttatttagaggtagggtcttgctctgttgcccaggccggagtgcagtggygtgatcacagctcactgtaacttcgatctcctggggccaagtgatcctctcagtctcctgagcagctgagactatagatgagcgccaccagatctggctagtttttaaaaattttggtggagacagggtcttgctctgttgcccagactggtcttgaactcttggtttcaagcaaccttacctgcctcagcctctcagggctctgggattacaggcgtgaaccacggtgcctagccataaactcactttccaaaagggttgtaaatagaaagactgcttgagctttaatctaatttaaatgagtatttctcatacttgaatgcacatatgagtctcctgggcaccttgttaaaatgtagattctgattcaggcacctgcagtggggtctgagcttctgcatttccaacaagctattttcccaggctatgcccgtgctgctagcccctggaccacattttgagcagcagggatctagggaaktcaaggtaaatcgcattttggtcagcactatcttcttttatgctagtataacttgttgaagctccatagtactcaggtcagggtgacaagccactactatctctctgggttcctgaagctacttgggtaagctccatccataccaagaatccaaaagcagggaggtattcagcagaaacagactgaactggtaatggaactcattcccaaactactatgtaccaagttgctgtcaccagccattatttcaggatggtccctcagcactgagggacaaattctgccttccagaagcatcttccaaggtagtatatgaataaaagattttataaaacctaaccattgtgttgttgcaaaaggcagtggcaagacttaaatttccttcatttttttggtgttttgactggtttggacatctgacttgagggcttccttccttcctttccttccttccttccttccttccttccttccttcctccctccctcccctcccctcccctcctctttctttctttcctttctttctttctttccttcctttcttccctccctccctcccttctgacttccttccttccttccttccttcctttctttctctctctctctttctttctgtctttatttatttatttatttatttccttccttctttctttctcttttctgagacagactcactctgttgcccaggctggagtgcagtggtgcgattttggctcactgcaacctccgcctcccaggttcaagcgattctcctgcctcagcctctggagtagctgggaccacagacacacacctccatgcctggctcatttttgtatttttggtagagacggggtttcaccatgttgaccaggctggtctgaaattcctgacttctagtgatctgcccacctcagcctcccaaagtgttgggattacaggcgtgagccaccgtgcccggcaggtcatattttcctattaggcatccacaattgacaatttttaccctgctaatttgatcagtttgcattttctcaagtttatccttagggttttttttttctttctggaaagagtatatttaaaagccttaactattttcatagaaatgatagttctttattttcccagccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcaggggtaagtgcaatgatcagacaaaatacgyatggtagggcamgatcccatttgtgaaaggtattgaaaattctgactatcatrgagtgtttccaatgaactcattcaacagctgtttattgagcatctaccatgtgccaggcagtgtgctgggcactgtggattcccgatgaatgagacctggcttctgacccaagggaattataaataatgcaattaactgtctggagctgcctgggacagcttcccataggtggtgacctttgaaatgggtcttggaggagcagtagagaatgaggagaaggcataccacacatgggggagacatgaaaggcaggatgtatccatggacagctggacatttcagcgaggctggtgaagttctcttctgggtgaagttcctgggttaaattggagagtcctaggagatgaaggttaagactgggttgctgtctgattgttacacattttaaaaatctttacccaagtttaagaatcacagaaatatttgatttttaagaaattatgaaaattatttcgtctctaacttgacctgtcattactatcttcaagtttgtcagctgcataacaaacagacaaattataaagtttatcatgtgcacaaatagtttgtttttttcttttttttgagatagtctcactctgtcactcaggctggagtgcagtggggtgattttggcttactgccacctgggttcaagcgattctcatgccttggcctcccaagtagccgggattacaggtgcccgtcaccatacttggctaatttttgtatttttagtagagacggagtttcaccatgatcatcyggctggtctgaaatgcctgacctcaagtaatctgcctgcctcagtctctcaaagtgctgggcttacaggtgtaagccactgctcctggccaagagttattctcgtgactattaacttctccagtggtagatattacagatatccagtgaacgattcaaaacataagtgattttcagcatggaggagctaccaataacagtagtaacttgtacctttctgggcactcaactatgggccaggcactggtctcctgctacatatgtgtcatctgacytcattctcccaagtcctaaaaagtaggttcctttttttttcaatttcacctagacgtatcaactgttaatatgttgtaacatttttctctctgtttctccatagaaagatcccttttatttcctgcatcatctgaaaataagttgtatatattacgatacttgcccataaagmcttcagcctgaatatactaagaacaaggacattttatatcatcacttcatatgttttggattattaacaataataatccaaaccattctaataacataacaacaacgatatcatgcaacatttatctcagatgcaaattttcccaattgacccagaagkatctcttatacatgagttttgttttatgcaggatctaatcaagaatcacacctttaatttagttgtcatgtctctctagtctcctataataataattattattattattttgaaatggtgtctcactctgtcacccaggctggagtgcastggtgcaattttggctcactgcaacatctayctcccaggtttgagcaattctcctgcctcagcctcccaagtagctgggaatataggcacctgccaccacgcccagctaatttttataattttagtagagatgggatttcactgtgttggccaggctggtctcaaactcccgaactaaaatgatccgcctgcctcagcctcccaaactgctgggattacaggcgtgagcctagtctcctataattaagaataagtccttgcctcttttgttgtctttcattgacatttttgaagagtacaggctagttgtcttgtagaatgttccataatctgaacttgattggttatttactcatgattagattcatgttaaatattactgttaagaatacattctgcactttgggaggccgaggcaggtggatcatggggtcaggagttcaagaccagcctggccaatatggtgaaaccccgtctctactaaaaatacaaaaattagctgggtgtggtggcgtgcgcctgtagtctcagctgctcaggaggttgaggcaggagaatcgcttgaaccaggagggggaggttgcagtgagccaagattgcaccactgcactccagcctgggcaacagagtgagactctgtgtcaaaaaaaaaaaatacattctgtcatatcaggaagcacatagtgtcagctgttccatcactggccatgcttagtttgatacttagtcagttgaggggtgctagatcaccttttggtaaaggcactgctttttctttggaatagtaagcaacctgtgggtgatactttgaaaccatgygaatatccactgttgggcagtcatggtagaatccaatgatgatccttgaatctgtcaattatgacattggaggctgaaaaatggtgactttctaattctatcttttccttctacatttattcactggcttccctctatagagaagagctttccctccatccaccaktttttagtattattatagacacatggattcttattttttttttgagttggagtctcactctgttgcccaggctggagcataatggtgcaatctcagctcactgcaagcttcacctcctgggtttgagtgattctcctgccttagcctcctgagtggctgggattacaggtgcaygccaccacacccggctaatttttgttagtagagatggggttttgtcatgttggccaggctggtcttgaacttctgacctcctcagcatccacctcagcctcccaaagtgccrggatgaccgaagtgagccactgtgcctggccacatgaattctgttttatttaatgtgtggtagaaccaaaattgagccaagcagtctgactctggagtttgtacccttaattacctccttaaactacctctgagaatattgtgctcctggctccagccttgctttctcgcactgcagctcataaggacgtgggtttgggcctctactgttgaggatcttaaggaggccaggaagcagcaccatttttctttgacgtatttcctgctggcttcttccatagtctgaattgaataacagtaagatttactattttaaagccaaataatggtgtactaagtgtgaatgggggggggggttcagtctttgcattttaattttatggtttgttagaaatagactttgcttttcttctttcaaacccaccatcttagactgtgtagagatgaagtttgcaataaataataccttatgattatatgtgaaaacccagagaacttagtgaagtctcattaatttactttcaaagtgtggttgtttcttttttaatatccagggtaccacagatataagaggagtggggacagaattaagcacaaggtaactataaattgcattccagttacaggaacacacagtgattcagtggtgtgacagagacaaggatgtaactatttcatgactattsgatagcactatttattactaatatgtctyattgaataaatgttttagaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaaggtatggaaatataggcgaggtcctgtaagatctctgaattgatacagtggatcacctttacttgctattttcttgttccaacacttttccacttgttgctcagacttgctaggaaactgctggcatgtgacttcaggactcacaggtgcatggggaagcctcatgcttaggaagtatccttgaccttaaacagtatgaaataaacagatcctttgtaagcattggtgatatggtgggagatcatgtgggctttctttatttgcttttaagtctttgcctctgagcactctttttttttttttgagatggagtcttgctctgtcgcccaggctggagtgcaatggcgtgatctcggctcactgccacctctgcctcccgggttcaagcaattctcctacctcagcctcccgagtagctgggattacaggcaccccaccaccacacctggctaatttttgtatttttaatagagatggggctttgccacgttggccaggctaatttcgaactcctgacctcaggtgatccgcccgcctcagcctctgtagagaagagcttttcttccatccatcattttttagtattattgtagacacatggagtctttttttttttttttgagatggagtctcactctgttgcctagctggagtgtaatggtggaatctcagttccctgcaacyttcacctcccaggttcgagtgattacagatgtgagccaccatgcccacccctttttgtgctctgtctagccaaggctcttctcattgcaaaaaccaaccacacattcgagtgagttcaaggaaattggggatattataaggaggcaacaggcaagtcgatcatgtgggcattgaagatgaagacatgaaatacaactgatactcctgaagattggaactgaaaggcaggaactattcctactttttcygtatctcaatggtctctcccatttccgtctctctgcttattcatcttgaacatggcttgatatacaccagaccctctcagttacaggattcatcaccaactggcatctttcctggagacactggttccttttgagttaggtgtctacccttgatcccatcagtgtcatgcataagtaaagaacaacaacagcctagcattagaactctgctcaggtcactatgggctggacagtttaagcagaaagaggaactctggggcagcaggcaagatgacaaataactagcatcttaggttacagttccctagaagcagagcctgagacggggattcgagtacagttgatttagtgaatgtctcaggagaagaaagagtgaggcagatttgcgagggtaaggcaccggttctcaaacttcgctgtggatcagcaacacctggaaggcttgttttaacacaggatttttgagctccactcttagagtttctgatttggtagatctgggatggggcctgacaatttgcatttatgccaggttccctggtgatgctaatgctgccgagccagggagaaatgtggtctctgctaaaatgaggttcagtttgatcccactgggagctctggagtgtgaattccacccttgagttaatcccactaagagccaaggggacckgctttttatattccctcatcagtcagtctttggctttgagctgctcccttccctgaccctgggggtggtttgcataaactcctgggagaggtggcttccctatggctgaaggcaatttttcagagtatttatgagctgttatcagccaacactcacaatggctggtggatagatgcacctgcttaatgaatgcaatctgagagggcagagtaggcttacatgaaatgtcaatatctgttagttgcttttttttttttttttcactgaaatggaggctctgatgcttctgttctgaccttctgtggctactgtaggggaagagaaggccatcttggaagctatgaataatggttctattgacagagaactgcaattagcaatcatattaccattacttactatatatattyttggatttttcttgccttgaccaatttgtgtaggtgtactcatctactgtttcaaatgctatactctctttcagaaagacttcctgaactcttaagtcctgattacaagtattctctctttcagcatcttgtaaaktacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcraagtccccaaakgcttcaagggtaagtctgcattggaacgtttagctaggactcccacttgccygtcatcataatcagagcctttgttctataatgattgtcaaaaaccagatgaggccaggtgcggtgggtcacgcctgtaatcccagcactttgggaggctgaggcgggtggatcacctgaggtcasgagtttgagagcagcctggccaaaaaggtgaaagtctgtctctactaaaaatacaaaaattaattgctgtggtgccgggtgcctgtaatcgcagctacttgggaggctgaggcaggagcatcacttgaacctgggaggtggaggttgcagtgagccgagatcgcgccattgcactccagcctgggcaacagagcgaaactccgtctcaaaacaaaaacaaacaaaacacagatgaatttggccactgggtttttaaaaagaggggtgagagggagaaacaatgatatgaagcagtgagctgcagatggcgtccccacttgcattttcctttccaattttttttttttttgagacaaggtctcactgtcacccaggctgaagtgcagtgktgcgatcacatctcattgcagcctctactttctgggctcaagtgaccctttcacctcagccttctgagtagctgagattacatgcacgcaccaccatgtccagctattttttatatttttattagagaagagattatgccatgttgccaaggctggttttgaacccttggactcaagcaatccacctgtctcagtctcccaaagtgccaggattacaggcatgagctacgcgcccagcctcttttctaagtcttttctgtaaaactcagggttgtggttatattcaatgaatgctgaggtgaatgatgccatcttgtataattccaagttgagcttgaataataatgaaccaaatattgaataataaaatatctacctcatcttggtcccacattatagagaactcaccccaagtgacaaaacaactcatggcaatgataattggtctaaagatctaacatttcccctttctcmagcaattcgtagagtttgaaaagtatccattagagcaaagtatccattagagcaaaatattttaaggagaatgataccaggtttgtgtgagataaagaagtgtgtaatggccagcgtttagagctgctaaccttttaaggtttcagatttagggttgaaatgtctctgatgccagaaagtaagaaccagccagaggctgaagctgtccttggctctaggtttagaaatctttcaaaaacattgacaatcttgttttagcagstgggagaggacagtagggagcagacaaagctaagaagagaggagtctgagaagtgtccagctagtgggagagaagggaatgataactgattaaaaatacccacctcatggggttggtttgattattagaaatatgcatgacatggaggaatataattttaattgtaaatagttacaaatgcactgaataaattgccattattcaaaagacagcagagccctggtgagatgttaaatacaaaacatgacaaaatacaataagcttaaataaaaatcagtagaaaaaatgtgagaaaagaataattgaaaaaagtcttagctttgttgatatatttcttcaggatcttctcccttatggtctttggacagatgcagtactgtaaagggccgatactgttttttcccctttaatcttgactgttatagaacagtcttcactgtatatagaacctttaattttatctcttgaaaatgaggatcttggccaggcgcagtggctcacacttgtaatcccagcactttgggaggccaaggcgggcggatcacttgaggtcaggaggccagcctggccaacatggtgaaacccagtctctactaaaaatacaaagattagccaggcatggtggcacgtgcctgtagtcccagctactcgggaggctgagacaggagaatcacttgaacctgggaggtagaggttgcagtgagctgagattgtgccactgcactccaacctgggcaacagggcgagactctgtcttaaaaaaaggaaaaagaaaaagaaaaagaaaatgagggtcttatcatttccctaatgttttctcccatcacttaaacctcacactaaatggtttcattcacataatcacatgtattctatatactygtaaaatgtatttggtttggcttagctatttacyacatttaagaaatgattgtttctcttagaatgtttatctttttctcccccaacagaacacagttctctggctttttsgaaaactgatgcatccgatgtaaagccatgctaaggtggttttcagattccacayaaaatgtcacacttgtttcttgttcatccaaggaacctaattgaaatttaaaaataaagctactgaatttattgccgcacccattgcagtgttagcttcatggtagcttacttttagttatgtcatttggttaagaaatgcaaatatttggaacgtcatcattctatggctgtgaagttggcagtataaacaattgtctgggtgtcccacttttcctgtgcgtaaccctgatctcggctgggtgcggtggctcacgcctgtaatcccagcactttgggaggcagaagcaggtggatcacctgaggtcaggagttcgagagcagcctgggcaacatggtgaaaccctgtctgtactaaaaatacaaaaattagctgggcatggtgatgtgggcctgtaatcccagctactcgggagactgaggtaagaaaattgcttgaatctgggaggtggaggttgcagtgagctgagatggtgccactgcattccagcctgggcgatagagtgagactgcatctcaataaataaayaaataaacaaacaaacaaacaaacaaacaaatcctactttcaagcactttcacgtaaaacacctgcaatacaatatttttcatagaatgggccacagaccccctccttccgttactattacctatctgcttatttcaaagaacaagtgttgtgccccagaattgttaagaatggcccagagttctgcatttatgacaaagtttccagatagttcttgcgcatcctcaagtttgagaagcattgccatacagaagtaagcatggacttccaggtcaataggactgaatttgcatccttgatgctgggtttacatagtgccaaaaaattttttctgtatccactacaattccatgacccatcattgacgtcgttcctttgcatatattcaactcccttgctcttctctcctttggtagtgtttgctggccaaactcatccctggcaccatctgccttccttatgcctgcacctaaggaactgaacgtggctggaaaaaaaagagaaactcacaaccatgccaataggtcccattttaaattcataaacacaaactttacatgggcctccagctctacccgacaatcctattatatttctctagtttgttcactcccttactctctaaagtggctatttcacttctcaacctttctcaagccaccttccttctcctcacccttagctgataacttggctccttatttcactgagaaaatggaaaagatcaaaagatcatttttttttaatctttccactcccgaatccatcattctaccagcatcggcaaccacagaatctgccttctgtcaggttacaatggatgaacatctaaggacaaaccctctctttatgtgctaggtcccattttctctctcctacttaaggattttactcctctaattaatgcttatccatgtttattttttcctttctattggaacacttcaatcagcatacagatatacagtaatatcacccattaaaaaaagaagccctgttacttcacatctttcttccagctactgctccaactctttagtccctgtttttacaaaagtcctggagttatttcctctgccatctgcactaggtactacccatcacttctccacaatctgcattctccataggatttccccacccatgcctctttctcagaacttaacccgattccgtgtgatgtggaccagatcttttctccaagatgcttctctgctcctcctccttttacagaaaccagagtggctcccctcccttctaggctttcattcaaaagctccaaattccctttacttaaccttaaaaaacaattttatgggcaggtgtggtggctcacacctgtaatcccagcacttttggaggccaaggcaagtggatcatctgaggtcaggaggtcgagaccagcctggccaacatggtgaaaccccgtctctagaaaaatacaaaaaattagctgggcatggtggcaggtgcctgtagccccagctacttgggtggctgaggcaggagaatcgcttgaacctggcaggtggaggttgcagtgagtcgagatggcgccattgcactttagcctgggcgacaagagcgaaactctgtctcaaaacaaacaaacaaacaaataacaacaacaacaaaattttactttttcttcctcaattctttccttcagactctgtgtatgtgtgtgtgtgtgcgtgtgtgtgtgtgtgtgtgtgtgtgtgtgtgtgtgtgtgtgtgtgtgtgaaggtggagtttgagaggttgtggtatttcccctttgtaaaccaaaagccctatttagggatttttgccaaacaaaaaaccatctgctctggtttcctcctctcaaagcacaaagctttagaaccattgttttctttaatttgttgcatgtcagtttaaaaatagacctctcttatcctacctaacagctctagacatggaaggagggcagtaagcatttagaatgtcttctcttgcccacacatagtcactgcattggctctgaaaaaggggagagaatatttttgtattatcccaccttttgttgcaaatgcttcataattcattttattgtttttaaatttaaaatatatgttggaactaataaacaaattcagtaaatttccaggatatgaaattaacatacaaaaatcatagcatttctatacactaatagcaaaccgtctgaaaaacaaattaagaaaactcccattcacatagctacaaaaatatataaatatacttaggaagaaatttagccaaggaggcgaaagacttgtatgctgaaaaatataaaatattgatgaaaggaatttaaaaagacacaaataaatggaataatattaatgttcatagattggaagaattaatattgttaaaatgtccatgttacccaaagtgatctacagatttagtgcaatccctatcaaaattccaatgacatttttcacagaaatagaaaaaacaatttgtatgaaactacaaaggcccctgaagagccaaagcgatcttgaatgaaaagaacaaagctacagtcatcacattatctaacttcaaaatatactacaaagctatagtaatcaaatcagctggtaaaaatacagacacatagaccaatgtaagagaataggcaggtcaaaaataaactcacacattatagtcaattgattttctacagaatgtcaggggttggccagggctgcagtcttatctgaagggtcaagtggaggaggattcacttccaagctcactcagtggttgttggcatgattcaattccctttgggctattggaagagagcctcaattttttactgtttacctgtgacttccctcaattcattgcccttcagtccttaaaggaaaattggatggcacagtacagtacccatgacaatacactcttttttttttttgcttgatccactgctttgtatgctttctgagaatagctcctccaggattctgatagacctcttttcttgggtgaaactcagtagagtaaggttagtgagataaactacaacacctgatgctgcagttggccttcgaactgcaactgatactcatcttcttcctccaccaccatccatttcgtattctcctcayccttggctggctcttctgttggtctcagtggctcttctggtggtgtgacaaagaccttcatccttgaggggtctgaaaggcctctatgcctttctgatgtttctatgatttttataatcaaaattgtatcaaggagtactgaggaggcagcagccctatttgctcctgatgatcagagtcaatgaccctttctaagatggtgagatctttgcttgctggttccttggcaaaaggagcccaaagttgccaggcaccatctgtagtttatagttcaataggacttgctgtgcccctagtggaagtgtttcccttttggaaacaaggccttttaaactatttatagatttcagatgtggaacaaaagcataagtgtccccaagtgagtcaaggggagagataataacttggccactgctgcttcaaatccttgattcccagacccatgtattgttcctactggggagacaatgaagatgtttgatttaaagtatatacttcatcatagaggatcatatctcaaagctggtgctttgattatgctttcaacaggccatttcaaggttctatcagctggcagcttctggatggtttggtaggtaatgtgatcagttggtcctgtggtcaggggcctattgtcatacctcctttactataaaatgggttatctggtctgatacaatgttatgtgggatcctgtatcagtggattcgaactccgtaagtcctcagatagtgatgcaggaaaaacaaatgcatatccaaataagtattgattcccagcataatggatctgtactccttcagtagaagtaggtccaatgcagtcaacttgataccttatgtgccagtggatctgcttgtgagatggtgtcatcttggaggctcaacattggcctctggtctctgttgcttgccaggttggacattcaaccaaggcagcatccagatcaatctatataagtaggagaccatgctgttgggcctatgaattatctccatccttgttaccatagccatttcagtcatgtggccattatgccagcactggggtggccagtgttagaggccagatgctgtcaactggctgagtctttttctctatctggttatgtagtaccttgctagtgggagttaacatgtgcatcaaagatcttcacactttgtgcccaccccatttattcattcacatgcctctactcctagtcctctttgtacctgatctacccatctttcttctcacctctcagactctgtcaagccactacctatgagttcatatatattctaatcataagccacttctttttccacacaaggaagatgaccatccaaaattcttcccatggggaggactttttctcaccactgtttttcaagatgctctttgaataagctgtattgtagctgtcatccttttttttacctacacacatgtacagaccttcatatccatgaaccaagctcaggctttttcctccgctctaagctggtcctacgggatcatatggggtcatatggctatagatgtgcacttaggaatgccattagtacaacagtgatggatgatgtggagttttgaccttctgatcacgtagcttcagggtatatccattatcatcttatcatgagttgttgctaggcacacttgacctcatgacttggtgggtatgacagaatatagctggtgatgggcagctgtaactgcctggtcacttggtgccaagcatctagtatattagaaattgtttctcaagtggcatctaattctccactgtagatgagatggccctgctttttagtcttcttagatctagaagagttcttccatttttcttcctcctttcttacaatctatatatatttgagatggagtcttgctctgttgtcctggctggagtacagtggtgtgatctcactcactgcaacttctcctgcctcagcttcccaagtagctgggattacaggtgcccaccaccatgcctatttaatttttttttttttttttagttgagacagggtttcaccatgttggccaggctagtcttgaactcatgacctcaagagatttgcccaccttggcctctcaaagtgctgggatgacaggggtgagacactgtgccccctcacaatcttaatatttttaaagagtagaggacaatcatttgggtttgtctgaagttatgttatgacgcgatttcagttgtattgttgccgggattacaagagaagtgagattgtaatcttcttagtgcatcatatcaggaagtacatgatatcaatttatgccattactattggtaatgttaactatgattacttggctagaaatctgatgtctgccagatttctacattgtaatcttactatattgtcctttgtaattaattaatcagtatctcatggggagatacttcacaactatgtggatatcctgtttttcatcaay

SEQ ID NO: 17638 - DNA, 21413 bp, Homo sapiens
ctgggactacaggtgcccaccaccacgcccagctaattttttgtatttttagtagggatggggtttcacagtgttagccaggatggtctcgatctcctgacctcatgatccgcccgcctcggcctcccaaagtgctgggattacaggcgggagccaccgcgcctggccccaataaaattttatttacagaaacaggaggtggctggacttggtgacccctgcactaagcggccccatccattcccacggcttgtgcacgcctctcagttcagcatctccgacctggacctctccgctacgtctgccatgaacatcactgggtggcagacgacatctcaagcctgctgtgctcacatcaggactcttgattttccactgtgctggatgtggtccattgtgttcagcttccattctcacctccttttgtttattttcctgtattttagaacctaaaatacaaatgcggcaatactgtgttttacagatccccttgcagccacagttccgggcgaggctgttggattcagtgcagttgtgtaagatgtgaaaggcagaaatgactcggaggcctccgccctgcgctgactgctggcagacagggctgtggacactcagccgtcgctgagggaggcctgggcagcaggggtgcggcatcaggattcccggcaggttcctgatctcagaatcacagctacccaagtttcctcttaagctcggtagtcccaaaggccacctctcagctattataccaccaactcatccagcgattctataatattccccataataaatccatttctacccctgcctgatacactcaccgaacctctctcatcttcccctccgaaaatctctatcacgacttagttccaaacagaagggaacagccacaccaggaatgtgaacaggaaaaacattaacatagcgaatcgttacctagtaagatgacgttaacagcggaagtcaagaaaagaggacacaaagggattcagaagcagcaaatgcagaaagatgccgcgatggctgggcttcaggagcaaggaaggggccgggaatgcacagagctgccaggggtgcgtggcccagccaacctggtgcatcaaattaactgtcgcatgcggttaatacctaagaacccttttattcttttcctgttttagaatttttttgacaattgaacacatttttgcatatgaactttaaatttgtgttttcctatttttaacattggaaatcttactggaattaaatatttatattcatttgaggagctgtttgtttgtttgtgacagagtctcgctctgtcccccaggctggagtgcagtggtgcagtcttggctcactgcaacctccacctcccaggttcaagcgattctcctgcctcagcctccctaagtagctaggattacaggtgcctgacaccaagtccggttaattttgtatttttagtagagatgggttttcactatgttggccaggctggtttccaactcctgaccgcaagtgatctacctgcctcggcctcccaaagtgccgcgattacaggcatgagccacagcgcccagtctcgtcttcccatcttgttcagaggattaccggtagggtaatgaaaatcgtaaagcgttagccatctgaacaggtaaccttaacctgttctgttttatcaaaaacataatttaaatccaactgtcctttcacacacccgtgaatttatatttttatgttttactgtttttgtttttgcttttgtttttgtttcgagacagagttttgctcttgttgcccaggctgaagtgaaatggtgcaatctcggctcactgaaacctccgcctcccggatttaagtgattctcctgcttcagcctcccgagtagctgggatgacaggcacgcaccaccacatctggctaatttttgtatttttagcaaagacagggtttctccatgttggtcaggttggtctcgaactcctgacctcaagtgatctgcccacctcggcctcccaaagtgctgggattacaggcatgagccaccgtgcctggcctactgttttataactaaaattttcaagtgaaaagccacaagatctttgtgttgtctatgtttttgtgtctttatgtctatatgtgattttaatttacaaagaactctatttaattggcataaagaaaaaaagcacttaaatcaagtaatctaagagcatacagtgtatactatttttatactatatttaagaaatatagggacaagcacagtggctcatgcctataatccctgaactttgggaggccaatgcaggaggattgtttgaagtcagtttgataccagcctgggcaacaaagtaagacctcttctctacaacaaaaacaaaaatagctgagtgtctctattaaagtatagatagatagatagatagaagaaaatacaaaaataaaatcattctgcaaactgagttcatcatattacttcactctgtgtcattcttttaaaaccctgcacctgcccaacctctgcaaaagtacaactgctaacaagtaatgctggcgcagcactttgacatgatagggaacacctgtgagactgatcaaatgaaaggccgacttaacccaatagctactccttccaaatttccttccagctgctcaaatgtggttcaaatggttttgacactgacttaaaattgctggccattctcccaacatggcaccaagtcaacctggacaggaagggataatcgaaacctaaccacaggataattgatcagtgatgtcttcagagaattttttttttttttttttggggactgagtctcactatcacccaggctggagtgcaatggcacggtctcagcttactgcaaactccgcctcccgggatcaagtgattctcctgcctcagcctcccaagtagctgggattacaggcacttgccaccatgcccagctaatttttgtatttttagaggaaacgtaaaaattgccaatatcaagatggagtcacttgtgtcgaacccaaacaaaataagaggttaagaaggggtgggggccttcatgcacacatgcctatgaaaagaaccatgacaaaactctctgagtggctggacgcggtggctcacgcctataatcccagcactttgggaggccgaggcgggcagatcacaaggtcaagagatcgagaccatcctggccaacatggtgaaaccccatctctactaaaaatacaaaaattagctgggcatggtggcgggcgcctgtaatcccagctattcgggaggataaggcagaagaattgcttgaatccgggaggcggaggttgcagtgagccgagattgtgccactgcactccagcctggcgacagagcgagactctgtctcaaaaatatacatatatagttattatattttatctactactttgtgttagttcctgtttcattcctttatgttacttattttttttccatttgtaagatatatactaagctttttgaatcgtttcttcattaataatgtagtcacgaggctgggtggcttacttctgtaatcccagcactttgggaagccaaggccggtggatctttcgagcccaggtgttcaaggccggcctgggcaacatggtgaaaccccacctctcccaaaaatacaaaacaagtagccgagtgtggtggtgcatgtctgtggtcccagctacttgggaggctgacaagggaagattgtttgagcctgggaggcagaggttgcagcgagctgagatgctccactgcaccccagcctggttgacagagtgagactctgtctaaaataataataatgaagtctttttttttttttttttgagatggagtcttgctctgtcgcccaggctggagtgcagtggtgcaatctccgctcactgcaagctccgcctcctgggttcacgccattctcctgcctcagcctcccgagtagctgagactacaggcgcccgccactatgactggctaatttttttttgtatttttagtagagacggggttccaccatgttagccaggatagtctcgatctcctgacctcgtgatccacccgcctcggcctcccaaagtgctgggattacaggcgtgagccaccgcacccagccataatgaagtcatcttaaaatgactataaattttcctcagaacatgtagggtccagccgtacggggcttagtgggtgttctccccgtgtgcggagatgagagattataataaataaagacacaagacaaagagataaagagaaaacagctgggcccgggggaccactaccatcaagaggaggagaccggtagtggccccaaacggctgatatttattgcatacaagacaaggggacagggtaaggagggtgaatcttctgagtgattgacaaggtgaagcatgtcacgtgatcacaggacaggggccccttcccttttaggtagctgaagcagagagggaaggcagcaaacgtcagcgttttcttctatgcatttctaagaaagatcaaatactttaagactttaactatttcttctaccgctatctactgtgaacttcaaagaggaaccaggagtatgggaggagcatgaaagtggacaaggagcgtgaccagtgaagcaccacagggagggggttaggcctccggatgactgcgggcaggcctggaaaatatccagcctcccacaagaagctggtggagcagagtgttccctgactccttcaaagaaaggagactgcctttcgcagtctgctaagtaacgggtgccttcccagacactggcgttaccgcttgaccaaggagccctcaaacggcccttatatgggcgtgacagacggctcacctcttgccttctaggtcacttctcacaatgtcccttcagcacctgaccctatacccgccggtgattcctaggttatattaatgatgcaacaaagagtaatattaaaagttaatgactaatgtctacactaatgattgataatgtccatggtcatctctatatctaatttgtatgataactattcttactgtaactattttctttattatactgaaacagtttgtgccttcagtctcttgcctcggcacctgggtaatcctccgcccacaagaacacagctttagctgcctcctgtaggagttcagtaggaagggaatctacctttgtagtgtttgatatgtagttttaaggaaggagaccacccctcatatatatgtcttatgcccaatttctgcctccaaagaaagaaaaagtaaaacctaaaagacagaaataaaatccacaggcagacagcccagtgccgcgccctgggcctggtagttaaagagggacccctgacctaaccggttatgttatctgtagattccagacattgcatggaaaagcactgtgaaaatccctgtcctgttctgttccgttctgattacccggtgcacgcagaccccagtcacgtaccccctgcttgctcaatcgatcatgacctctcacgcagacccccttagagttgtgagcccttaaaagggacaggaattgctcactcagggagctcggttcttgagacaggagtcttgccgatgcccccggccgaataaatcccttccttctttaacttggtgtctgaggagttttgtctgcggctcttcctgctacagtgtgtaaccagattatttctgacaagttttgatccagggttttttttaaaagatttgtcaatttcaaaatatttgtttgctcctgcttcctgttctctctctcccttttttttttcttttttttttttaagacaaggtctcactctgtcacccaggccggagtctagtggtgggatcactgctcactgcaggatccaactcccagactcaacagatcctgccgactcagccaccgaccccatagctgggactacagatgtacatcatcacacccagctaatttttaaagttttttgtcgagatgggtctcactgtattgcccaggctgagttttcttcttcttttttttacattttgtttgcctagaattgtatttgattgtaatcaaatcatgtgtcacatctttttttcaatttgtgtgattattttgtggcccaatacatgattttttttgcgaatatttcatggacttaaatagataagtcctctctctrcacataattaaatggagtgtgtgctttgcattattcagttcctttattcccatccttgcttttgtctgcagatttgtcctattccagaatgggtatactgaaacttgggtaagggtgaggccagcgttctgggtggcccaggctactatcccacccgtgccacagaatccacacagaggcccagcggcggcactgggtggtggggaagggggaggcggrcccaggttgggggggcaggcagtcagtgcggttgccaggaagcgggaaagggccacaatggggtctgggaggtgggcggggcggagcggggatgtccagccacgtcgctttgttttcccacgctaggagctaccacaacaggtcagtgcacctcggggcaccgggtcccccacgcaggcccttcccggggcaccctttcccaacagcacgaaaatctcctgcccccaccccacccccaggtgaytcccttcaccaagtctgggtctagacttggcccccgcgagttcacgtccctgcctaatgcgcctggagtccgggtgatggccctggatmcgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctractcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagscccccacacccttgatccgccccgcaggcaggtacttcccggagcgagcggggaacgcgacgtaccccagtgcgcctcggcacaccattgctccccgaaactggggtgtccaggcggaacagcagagcccaggtgaggtcagaacggcccatcccagaactgtgggccttcccactcgagaccggggaccgccctccgggagctgggaccaccctgcgcctgtccgcggagacccactacccccgagccctgcctcctccccaggtcccgcggcctatacggtgccctcgctcttgggtccgcgcgtcatcggcaaagtctccgccccaacttgctccatctacggccgcagagcggctggcagtttcttcgaggacctcagcaaggtgggggaggggccggggcggacgcagggggtccctggtccgcggcagtggaggcggcagccagcaccctctgccctctcgcagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcaggtggcctggagcccagggtcaagggtcagagtcaggagagtggggagggcctgaggtcsgagtgatgggatcagagtccccgggggtccaggggtcccggcgcggagaggatsccggccccgcgaggtcagcggtgtctccgggcccgcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggtacgggcggggctcaagtcgcgaggcggggaagcgggaggcagacacggacgagggcgacacagacacgggaccgaggggcggacaccggagagacacgggaaaggggtcgggacaggagcacgtggctcagacaccgacgccgggaggccgcagaccccggacgtgtcaggcatccccgcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatsaggggcttcgtggccgctgtggtgaatgggagcgcgcagggygcacagatcggtgcgtggggagggttgggcgttcctgaccccgactgggaggtcagcccgagagactttgggtccctgggggtgcgacggtgccccactaccagcaccggccccagggtgccccaccgctgtgggctgccaccctcacgcgtacccccacataccaggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggttagaaaccacctcctttccagacgggagcctataccgcacatgcagcaaccagtccatccacaggcagctcccaacctcaagcctggcccaaagcctccaagaccctaccaaggcttctccccaccctgctccccagcacagttctccccaccccgttccccagcacagcgcttggggcccctctggctccagaccaggccccttggagcaggaaaaagatccactgatggaattcagacccctttccccttgggtccccagacagctcccccaagggaggagctgaggacttycctccctctgcccsaagccttgtttccccaaggacaggtaccaacctcctcccctactgacacttctcaaccaagaaaacttcctttccattccctcaccagctgggcacccctatagctgcttaaatactttccaaatccagctgcactcctagccagggaaggtgaagggatgcacagaggtgggggaggggtactgtgcagggtactcagcatccctgaccaccaggtgccaatgatcagcrgacgtggtctggggcacacaggargcaccttggataagctggagtctattcctggattcaatgtcatccagagcccagagcaggtacggggcgccacggatcagtcattratccaggttgatgatssagaccctggccagaatcactaaaagatcactggtggatcattagggtcactaatgagaacactggtcaaggttactcatgagtcactgggcctgggccgaaatcatcagtggaactttgattaggatcataaaatgggaagttggtcaaaatcacagatggctggcggggcacggtggctcacacctgtagtcctagcacttggggaggccgaagagggcagatcccttgaacccaggagttcaaaaccagcctggataacamggcaaaaccccatctctacaaaatagttcgctgcgtgtggtggtgcacgcatgtggttccagctactcaggaggctgaggcaggaggaycacttgagcctgggaggtctaggctgcagtgagccgggacgatgccactgcactccagcctgggcaacagagtgagaccctgtcccagcactctgggaggcagaggagcccagttggagatcagcctgggtaatatagtgaaacttgatctctacaaaaaaaagaagaaaaaaaaaagccgcgtgtggtggtgcgcacctgtagtcccagctactgggaagctgaggtgggaggatcacttaagcccaggaggcagaggtcacaatgagccgaaattgtgccaactgcactccagcctgggcaacagaggaagactcttcacagaaaaaaaaaaaaaaaaaaaaaaagctgctaagtcatttaccataagtcactgagaacaggggatgtctgaccagakgcaagtgctgctggaccaggcgggctgctgtatcgtgggtcagagtgagcagctggttcctgcggacggaatcctatatgcagccagagatgtgacagccaccgtggacagcctgccactcatcacaggtgacctgactccatggcctgcttctgcatgttcacaggctcctgacctccaaactcaagtcaagggcctctcgttaggagttacccgtcacctgaccgtgtgcccccctacccccatcacaagatgcctgaccaccaccatgtggggtggcctgatactcaacccaccaggtgctgccacccccataataagggacttgaccctcaatgctcagggcccctgaccccaaagtcggcatccccgaactctcccaagaagctccaggttctccattgtctccaacctcctctgcctcccccaaagcctccattctcagtaagaractcgtggaggggctgtccgctctggtggtggacgttaagttcggaggggccgccgtcttccccaaccaggagcaggcccgggagctggcaaagacgctggtgagcggtgtggcctttccctgggcaagcgtcttgatgcgggcccagcctacccttcacccctcccgtccccactgcctccctccactcagcagtcctgcctaaccccagtcccaccctcttctgcccgaagtccctccctccttcacggcttcctaacctgctgtgactttagaggtcaaggctggcccggcctggacctggggaagccctctgtggcgttcctgccccagaccaagtacaagttcctcctggccccatggcgaggtgtcgcacttcactcgtgtctcttccccaccccaatccttccctgacttcatgctggggggctggcaacccagggtgcagcaggggctggagttcgaccaagaaccggctgcagaaggccccgccatggggggtccacgctgagcctcctctccgcaggttggcgtgggagccagcctagggcttcgggtcgcggcagcgctgaccgccatggacaagcccctgggtcgctgcgtgggccacgccctggaggtggagrmggcgctgctctgcatggacggcgcaggcccgccagacttaagggacctggtcaccacgctcggtgagggggacggggtgtaggggagcggaggcggcggggggtgcttcccgctggggccgccccgacccggccgcgcctaagacccgtccccgcccgcagggggcgccctgctctggctcagcggacacgcggggactcaggcycagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggtgagcgtcgggggagtccccgtccttccgcctccgccatccccttcccttcccgaggccccgccccttcccgagcccgcgcctctcagcccctctccccgcaggcaccgtggagctggtccgggcgctgccgctggcgctggtgctgcacgagctcggggccgggcgcagccgcgctggggagccgctccgcctgggggtgggcgcagagctgctggtcgacgtgggwcagaggctgcgccgtggtgagcgccgcccccgccctgctggccccgcacccccgcccagctccggccgcgcggcctctaacagcccctcgctctgcagggaccccctggctccgcgtgcaccgggacggccccgcgctcagcggcccgcagagccgcgccctgcaggaggcgctcgtactctccgaccgcrcgccattygccgccccctygcccttcgcagagctcgttctgccgccgcagcaataaagctcctttgccgcgaaaccttgtcagtgcttgggcgggagcggarggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcscagggagctggaggtcggcgcttcctctcgtgcttggtccactgacgcgcggccccgccgcgaggtgcggacgccggggctgggaggggaggaggtagccctgaggactcgctggactccggggtagtttcccagctccggctactgcgcggggctggcggggcacaccccagggcgcgctggaggccggagcgaggctggggcgcccgtgggaggctcccagcaggcaccggtgttctcgcggccaagcacagttataacgcgctcgcgcggcgcttcgagtggtcctggaacctttctggccacgagggcgctggccttgctggggagggcacaaacccagaaccgcccgggcgggggtgcagtgagtcctcgggagggtgccctcagcaggagggggcagtgaccgggagtcctgagacctscacctagcaaaccttctgcgggggcccgtgggaaaggctcaaaggtcaccaacgcaaaggcagggcgtcggctgtgagcccggaggagctgctgggaagcctggatgtgaggagggtggggttttgtggcgggtggaagtgtcgtgcgtctctgccaggagaggttaaacacagccggcgggsagagtctgagctccgggggtaggtcgtgcaggttttctgctgggagtgtggaggaaggccgcggttggttgaagtggctggaggtaacaggaaagtgttggaggaatcggttgctctcggggattgcaagccagagagttacccacctccttttaagaaaygggtttattgcaaatagataacgtggttagttcaggcaaggcatgcacttggaatgctttccgtcagcaagaggttcaccttgctgaggtgcaggtgcagggcagggtgcggtgacaggctggtgatcccaggtagaggacaggagtgacaggtgtggttgcccaggtgtggatgtttggtggaggtggagttctgagctcaggtgagcagctgcaaatgcctgttaagcctgaacgtgggctgggtccttcagatgggtggctggtctcaagtcgcaggggcagcccaggcactgtcctgggccttcccttctggctcctgacgcctgtgcttgtttccaggagcatcagatccatgctgctgctgactcggagccccacagcttggcacaggctctctcagctcaagcctcsggtcctccctgggaccctgggaggccaggccctgcatctgaggtcctggcttttgtcaaggcagggccctgcagagacaggtgggcagggccagcccyagggccctgggcttcgaacccggctgctgatcacaggcctgttcggggctggactcggtggggcctggctggccctgagggctgagaaggagaggctgcagcagcaaaagygaacagaagccctgcgccaggcagctgtgggccagggcgacttccacctgctggatcayagaggccgggctcgctgcaaggctgacttccggggccagtgggtgctgatgtactttggcttcactcactgccctgacatctgcccagacragctggagaagctggtgcaggtggtgcggcagctggaagcagagcctggtttgcctccagtgcagcctgtcttcatcactgtggaccccgagygggacgacgttgaagccatggcccgctacgtccaggacttccacccaagactgttgggtctgaccggctcyaccaaacaggttgcccaggctagtcacagttaccgcgtgtactacaatgcmggccccaaggatgaggaccaggactacatcgtggaccactycattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaatctgtgtgtgtgtgtgatctgtaccagcggcccagggaggccaggcagccctcttctctgcgcaggtgtacataaaagggtttttagggggaagatgagatggcaacactgctttattaggccgggccagccaggagcagacacacggctcctcagtacacattcccccacccctgcctcggtgctccccactcagggctgggccatggagggggcagcgtaggtctggaagcgcttgtgcgctcgctggtgcgtgagcagtctcagggacatggtgtccacggccatctccagcccgggctgctgggttatctccactgtgtagtcattggcctgcaggggtggcacatcagcagggtctggggaccgtctccccctcccacgtatcccaggctactcaccagctgcagggaggccagcatggaacgacacacctcgaaggccggctggccagccaccagctccgcaaagggacaccactcattgagctgggggaaccgtgagaccagctggtccccataggtgtggatgtcaaagggcacatgctgctcctgcacaggggaggggcatgttggctgcggagagaggcaaggccctggacagacccgtggcacacagctctggttcccagcggccccgcctcacctgctcctggagcagaggctgcactgtgtcctcccagtccctgatgcgctggctcagctctgtctcctggacaaacttctgggaggtggcgatgaagagctcctaggggaggatcagcaggagctactgcctcccaagcaggggcctgggcaccgctcacctgtccccctcccctccccgtctccctctaacccaggcctaccacattccttcgaaccagctcctcgtagctcagggacatcggcactgcgtctgggaaggggtagctgtgagctgggcagctaaggggccacgctctcccctgcccccagctccagtggcccctcagcactcctagcccgctgcccacctaccaaggtcagcggcttccctggggtctgctccctcgggctccatgtactcctcaggctctagaaagtcatctgctgggaggtgggagagtgaacagcacgcaggcagctagtcggcaggtgccaagccccaccccaccccctggcaggcacccacctgctgcccccaggtcttccagggaatcctccaggtggtcctcctctgcaggccgcagccactgctcagccacctgtccagagaaagcatctgtgaggggcactgtcacctcccatcagggccaccacggggtcctagatcacagctgaccagctgggacttgcctccctcctctgcagcttccggagagtttccaactgctccttcacgtgtgtccagtacaggacctccatgtctgcagacaaaggccttgtgagggctccctcgtccttcccaggccccgtgccagtccacccaaggctttgggtgacaccaggtgggggaagaggtaggggaaggagagtaaaactgtcttccccgaggacttcagcctcacctgcaaaggacggaccctttcgccgaagccgcctgctgtcggcatggtctgcatctgtgaaagaacatgctcagcaccagccaggccaagagctgcccacagcattgggaaaagggtgctgatcctcctccactggccctggcccagcccccagctcccagtggtccggagtgcacaccacacccactcacaggcagccaggtaccactggtggaagtcctgcagcttggcagcgcccttcctcttgcgcttctgtcccagagcctcctccacacaggggggcacagagtaaggcctacctgggggcaaacagggactgtcttagagccgctgggggatcagggtgcaaagcccactcccacccccccacctcatgccccaggaaacccagccaggggtacctgagtggaggtaccttccacccaattacctttcttgaagggcttagactccaaggagtcaaaggggtccaggctctgccaggggtctggagtctcctgggcacagagcacaagaaggcgctggagaagtagggggtgcacagccgtccctcccaaaggagtaggggatgcacagccaccctcccaaaggaagagtagggggtacacagccgcgctcccaaaggaggagtagggggtgcacagccaccctcccaaaggaggagtagggggttcacagccaccctcccaaaggagtagggggtacacagccaccctcccagaggagtagggggtgcacagccgccttcccaaagcccaggcaacaagtgcagtgacagcctggggcagagccgaccacactcaaatcctggatcacagaggggaacactagagagagggtgggagcccagagtcgcatgagggggtctttaagagagcaagtgcaaagggccacaggctgggaacaccacaggccagcaggagcaagagcatgatgggcaggcagccagtcctcgaatccgcccatccctccctgccgggggtcagggccccaacactcctaccttcacgcaggatgcaggctctggggccccctcccgctcccgcagcatgtacctcctgggcagggcagcactctgcaaagacagtcacagggtccccacttctcctctttctcccctcaaggctctgggtaccccaggaactccaccttgggttaacatcaagaaccctacaagggtcgggcgtggtggctcatgcctgtaatcccagcactttgggaggccaaggcgggcagatcacccgaggtcaagagtttgagaccagcctggccaacatggtgaaacccccgcctctactaaaaatgcaaaaaaaattagccgggtgtggtggcgcacacctgtaatcccacctactcgggaggccgaggcaggagaatcgcttgaacccaggaggcagaggttgcagtgagccgatatcacaccactgcactccagcctgggcaaaagaacaagactccgtccaaaaaaaaaaaaaaaacctacagggaccggacacagtggctcacgcctataatcccagtgctttgagaggccaaggcgggtagatcacttgagcccaggagttcaagaccagcctgggcaatgcagtgagaccccgtctctacaaaaaatacaaaaattagccgggtgtggtggtacacgcctgtagtcccagctactcgggaggctgaggtggaaggatcacctgagcctagagagagtcaaggctgcaatgagccaagatcaggccactgcactctagcctgggcaacagagcaagaccctgtctcaaaaataaataaataaaataagataaaaataaaccctgctagtactctctgggggtattaaaacaaaaaccctaagaaaaactttaaaacacaaacagtgggccgggcgtggtggctcacgcctgtaatcccagtgctttgggaggccaagacgggcagatcacgaagtcaggagattgagaccatcctggccaacatggtgaaaccccgtctctactaaaaatacaaaaaattagccaggcatggtggcgggcgcctgtagtcccagctacttgggaggctgagggaggagaatggcgtgaacccgggaggcggagcttgcagtgagccaagatcgcaccactgcactccagcctgggggacagagcaaaactccatctcaaaaaacaaacagaaaacacaaacagtggtcacggggtactcttcttcaaaactaggaaaaatgaatagaatatgacaaatatccatgccatctaccaactagagtgaagaaacgttaacatttcctctgtatgcatcaggttgattttgttttaatgaataaaaaggaaggatttcttggctctaggctgggtacagttgaccccgggggttgagggaggcagcaatggcctccagacactccctcctaccagcccgactgcagagaggcgccttggcaaccggcggccatcccaggttgccgtgagctcgacagggctcaaatccttggacgccagcccactactctgaggagcatcagttctgctcagagaggggaggaacacagaagctgctcttcaaaagggctggttgcaggacgggctgcaagacaggtgggcttctgccccagaccagtggtctggggccaaggccataccactgtcctccttgtgcaaggtgactcggccccagagccagggttgccagttcacagctcaggttctgcaggcctccatgtgggtcccacctgctgcgggctcctggactccttgggctccagagcggccttgggggccgaggcctcaggaagctctactgcctcctctgcatcctcgtcctcgcccccacccaggggcatcgggccttctggagaggggcctaggcagggagcaagagagtgatcagctccaaggagtgccgagaccagacggcaccaaagggaccctgatggctacttcctccctcagctttagtcatggagcccagaggatttggcgggtgccttgcaccatcctcgtcgtgctcctgtgctctatgctctgcttggttcattttatttcttagcaaatgttcctctttaaatgcagccatccacatctgcccagagaggagacccaggagggcagtcagagggcagtcagtgaaccaagatgggctgaggctcaccgggggctgtggctgcttccccggggcgaggcctcactcccatgggccacagaaggggcatgaggctggcagctgagagcagccccttggagccctgtccactgggtgctgcctccctggtcccctctttggctgccctgccagtcccaccggggagctctcttctcacctggctcctgggagaagccgagtgctgggacagggctcctgcacacggaaacttccattggctgctcctcagtcctcccggtgtctgggagagacagggatcagacaaggtcagcccagcccctctccaagatggtccctgcccggtgttcaacaagcctctccaaggggccagcaggagggcagagaccagcagactccaggccttgggctggggggagacagcagggccctgagccaggcaccaggtctctggcactgagaccatgttaacttgtaatcaaggcacagcagatgggtgggatgagcaccagccaacctgtctagactagagcaggcacccagagacagggagctcccaagaccagaggtggcaagcacagggcaccccacaagagtccaaccagaagaccctcccttccttcccaccaagccccccgcatccaagccctcacccttctgggtccctggcatgggggaaacgcccgctggttccatgggggacatgccctctggctccaacatgaaggcccctctggggtggggaacgcacgtgttcatcctgaaatccttccggctggccaggacctcaccctgacggctgtgctggcaaaaacacgcctgctgtagagacccttcccaggcaggcctccctccccgtcgctgggctcagatccctacctgtacaggggattgttgttcttctccatttcatcaggggccaccagggccatgggcaggagggggatgatgaggacctcctgcatggaggccaagggtgggtgagccaggcacccttccactccagtggagaacaggacccacatggggcaatgacaccttcccacaccccatcagctcaacacagccccagggaaagtgctgacctcaccccagcctaagaggggccaggccaggactcacactgggcgtctgatcattcttgagatccacgttagtccgggagtcagggaagtcatccagcgacaggaactggagggagacagagctcgtgggggcggagcccaggcaaacacacagtgggcggggaccacatgccaaagaaactcacctcattctctgcctcctgggggaccccggagctggcaaccccattggccctgtcctcctgcaccgaagagagctgcttggcccgcctgagagag

SEQ ID NO: 17639 - DNA, 57457 bp, Homo sapiens
caagataatttcctgtgcttcatgttgcctttattgggtttttgatcacttatgaaaactgagtccgctttattaaaaaatgtaatttacaactctgcaactctctgtatttgcctttgaagtctttaaattaccactctgattaaatgaatgattattgttcacagtgacttgtgatccttttttgatcaaatgttttaaacctttgatattttttataaactttccaaaataaaattctaaattaagtcttttcttgaaattgaattaactttgagattttccatatgcaccttcagaatatctcaaaaggatatctcttgttatagaaagagacatattaaagtaattggactgatctgatatattaaattatatggaaaggattataaaataataaataatactactttttttgaattatatttgtatagaatgtgttaatatgtatttcagaaattgtgtaaaattcatagaaatctaatagttctgctataaagctatcagtcataattctagtaattatcttaaaatgttgaatacaacagaagtaactgagtttccttgtcaattgtgtcattattgtaatgaactcttcccagatctttaaagtcatggccattttaagtcttgtcattcacagatagttaattgtttactctgatactttctgagaaaccataagcctaaagtgtacatcttcaaggagatttatggaaagaactctgagaattacaggtttctcataactttaaaatcacaccattgggttgggtaagaattcccagactctaatgaagaaattgactgattcataaaactgctaacctaatgtcacacagaataaaaataatacaaaggaaatgacttgggcagaatttcatgctaattaagccagtactgaaattaagatatacaacttgaatgaactatataatattgatccaagtcaaattacatttgataaaacctattcaataaatagtgctataagcacctgaattggggaaacaaagttggtatttaagagaattaaatccaatgttaagcctggatgcatgaagaacctggatggctgcctggttcttctggagtcttaaatcttccaatattaaaagctctgcactccatgactcattatggaggagataaaatgattcaaattatgaaaaaagattggtggggtgactgttataaaattgctaaaatagtttataaccaatgtctggtttgtcaaacccataattgtggtaagacaataaaaacttcaggtgatacatttcctgaacacctacaaatggctttcattcaatttccactttaaatgcatgttttctggttgtatagaagatttccaatgcaggaaggccaatgatataacaatagctaaaaggttattggaaaatatgtttcccttatggggcattgccggagaaatttctagcaacagagaggtatgcatttcactggacacgctgtaaaacagttaaacaggtattataaacacaatagcttaggaaaagctaactgaattgattggattgccttggtcaaaggtattactgattgatggcaataagatccattcccactgtaaaacataaattgacccctcataaaatagttactggaaggcttatgcccctaataataaagtctcatgtatcttcccctcttataaaccctgacatgacttaatagtgcaagccttgaatgcattctgccaaagcatatttttaccaagtgaaagaagtccttcatgacccaccaactgatgacaaccaagtgtttcataatatagaacctggaggtgggggtcttttggaaataactccagagaaagacattacttgaactcggttgaaagggaccataccaagttcttctctgcagcaaacttcaaggccttgaatcttggatctgcatttctcaacacaaaagaggtcctgtagacttctggaactataaacttgttggagaccttgaaataaagctgatcagggaagtttttccctagaagcatatggcatcctatatgtagacagctttcctaatattgcagatcaagagttctttgctatcatgaaagccttctctttttttccttttttctctatttcctgcaatactaattccttccctttctttaggaaaaccctaaataatgccagacttttttgaattatatatgtaaggatatgttattaatatgtatttcagaacttgtaagaaattaatagaaatctaatagtcctggtataaggctattaatcgtaattctagttgttatctcaaaatgttgtatgcaacagaaataactgaatttccttgtcaatttgggatgatactctgtggatggctttggcaaagtcttatggtctccaagaaaccagagtaactgttgggtttatgagctaatgcgcaaaaatctggaaacaatttcattaacgctaatgcctgtgttcctaatgagagtcaccctgcaaccccaaggaaagagaggaaggttatctttgatatgctacacatcactgctacctgccttcctatacttgctgaaaatagtatcttgatctttccagttaataaccaaactgttaccaaatataaaaaatctggatagaggggattggtcaatgggtgcaaagttacagttagacaggaagaataaaagctgctattctattacacagtagaatgactacagctaataataatgtattgtatatttcaagatagctagaagagatgattttgaatgttatccccaaaaagaaatgataaatgcttaaagtgacatattatttaataattatcctgatttgatcattgttcaacatatacatgcattgagacatcacactgtaccccataaatatgtacaattattatttgtcaattgtacataaaagtaaaaaaaaaaaactatcagaatgatgcctgcaaaaggtatcttgtgcttccgggcattgcatacttaagacgttggggactacctatgtgggtacaaataattgcttgtgtgatttcactggattaaatctagcaaagtctttttactagatccagtggtttgcacccttacaacatgctatatagggaccacagaagagtaagttcaccactggattttattcaggagctatgccaacttgtgggtggacaaatttaactgacctcggctcaaacaccactaagtggccctcttttcaagcccccaagggcctacattgggttggtggataatctgacctgccttctctgttgtttcctcactggttcagatcttgctatttggcctggctcgctcctacatcccaatagccttccctgaaagttcccataatacctttcataatcagaggttaaagcagtcaataaccaaagtaagcaccaacctaaaaataaatgaagacaagttagtttctactgaggaaaggttccaatggaggtgctggaactcactcttggcattagcagggtgcctgttgtatggaatttgaaactaatctataaattggggaaaatcttgaatttgtagccagtcagacctcctaggggttcacatggtagaagctactcaaatattctcagtggatcaaaacatttgtgttcaacaaacacacttcatggaacattacacaactttggatctcctctttgctcatgctgggggctcttgcatggtgctgaataaaactgaatgttgcacttatttttcctctaattttactactatagaaaacttaatttaaaaggtggcagatactgctgtttctctaaacactgccactgaatatattaaggaaacttctcaggggaaaggaacacatgatacatttatgggagcagctaatggttggtttgtaggcatcctgagtagtgaaaggcaagctaggctattccaaacttttctaatctttatgcttctttagtggctctccaggttattataacttgtgttaccaggctaattacaaaaatggatacctctttaaatcaggccataaggctgaatcaggtcattcagtgaactatggtccttgtaaaaagtaaagtagaggttccttttcaaagactttcctcctcatctgattaggaataaatagtaacctctcttagaagcaaaatttattcaaagacctgttaacattcttaaatatctgctagctgtaataaagaaatcaatgtactttatgttcttagctcccacaatttagcctaaatatttgccctggcatgcttatactggtccaagtgggcattaggtcatagcctgttcctcttccttatttagaggtgtttttcccttctcagcattccacaagttacttcctccttcctttgttctcctctgcctttgcctcttttaagaatttctaagttgctagccaatcaagacaaatacagaatgtgaagtcccgttctagccaatggaaaccagtcacaacagtaaggtggacgggtcaggttataaatgaccctgcctcctttgttcggtgtactcttgtggcaaaactgctggcgagtgtactctttccgcagaaagtaaaaatggccttgctaaagaaattaattttatgttcaagtgctatttctttacggcaccaagaaataagcatttctagcagtccttaaccgccataatgccctaaattagaccatgaccaattggactcaaatactttgaactatctttattgcctgaactttgaattgtttaattttgatcagttcagtttgtggagactcctgttaaggtgtgtacctcagtttattgctatactccttctcgtggccataatagtctccctgatgtgttgttgtcccctcgagagtcttcaatgtctctatgcagccatcctttgtacaccaaatggtgttattacagttagaataacaacatgaagaaagtataatcactcaactaatttgacattgtgacttccatactgagacaaaacaaggttctggtcaatctcgtaaaactgagaggctgacccaaaggaggaaactgttattaaattaaatctggcctaaagttgcctccctacctagcaaagcataatcaaacctaatatgtaaataaactgcaatgtaatttgagagtacgttcttctaacaagtggccaagtcttggccaatcaccgcagcggagcttttagcccattacaggctgcaaaaaatattgtctataaacgcggcttgcccactgttaggggctggagctctctgaacctttactggctcaggatactacatgattcatgctttctttgctcagataaactctgctaaacttgtttgaagtttttttgttaacaatatttaaacataaagcaaataaattaataagaatcctatatcactaagttacagtaattagaaagtattcacctgagtgagaagattggccaagctgctatccagtcttccattatttgacaagacatttctttcctatgctttctaatagtattcgttattccagaaaggttgctctatgaccttaaaccgtccacatgttcactgcactgatagacgtccaacgtcaagatgggtaactaaaggtcaactctctctttaccttccctgagcctgatttttgcattgtaactcatggtcactagacatttgttttgggtgttcgcagtctacatttatttcccttttaggggaaacaatcactgtccacgggattaaaataatcccgagttgattatttggtgacatcaaccaacggtgcacattttgggtccattaccaacacagccaagcagcacatatttcttcagagcctagatatgcacatgtcatcaaaggatagcattttacagagtcaacaccactcacttcatagaacaaggggccagtggcttttcagaagaagggtctgttctcggccccacaccagaacgccagccgccaggtcccgctgctcagcaggtctcaagcccgcgctcactcgggctccggctgctgacagctgcgagcccgcgcgtgtatacccgctcaacgctgggacrttacagccagggccaatgggcagagcgsgactcgaggccccgcccccgccttgtggcgtcacggggacgccgggggcgcgcgggctgcagggccgcgtaggtccccgcccccagagtctggytttccrcggctgcccgcctcgcgcgtcttcccygcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggtgagcggccctccctgcassgtgcccacgcgcttggccssccaccctgaggtggaagctctggcgcgaccggccgcgaggggcctgcacccgcccgacaccagggagttttcaccccgcgcctcccgggtgtagttgaaatatctcgcgtctgggcctgtgagggcccaagtctcactcccctcaaaattcagggttctgggccgatcctcagcttcctcgtttggaaaattctggctgcccccagggcccgctgaaggttccatggagagtggcggtgaatgcattttggaagcgggccgtgcaagagaagaaagaattgtatgtgcacaaggttcaggcataacgcgtttgttcctgctcggctcaaacgggagtttgctgccaaagacatgaactgcgatcagttttaattctatcagttatttttgatttttattctgtaattgtgcagyctttgtcaaagtagtttyctctcctaaacggcctcccggctctccccggtcttycctycgcttgctaggttgtaaagaatagtagtagtcatgacttttgtagcactttgtaaagtcacctaatggaagattgctgaggtcctggttttgacctttgaaatagtgccgtctgtgcagagttctgagcttgcgattttggcgctgcagcggaataagtctctctctttttttttttttttttttttttgagtcggagtctctttgacccaggctggagtggagtgcaatggcgcgatctcggttcactgcaacctccgcctcccgggttcaagcgattctcctgcctcagcctcccgagtagctgggattacaggcgccccgcccggctaattttrtatttttagtagagacagggtttcaccttgtgggtcaggctgatctcgaactcctgaccaaaggtgatccgcccgcctggcctcccgaagtgctgggattacaggcgttagccactgcacccagccggaacaagtcttttatccattgtacatcttcagggcttttccattgttctgctgagctgtggttcaggctcagttgtgcgagtgattgattacctggctactgtaatgcttgtactttttttttttaaaaattattccatttcagctcacattggagaaccatggttttcgtatcctagctgattatattcttagcatttcagtcctttgcaacttggtttgttggggaaggcggttatagtcatctaatttttcttggggacagtactactgtggctacagtcatgagagagtttactttttcaatgtcttgtttccaaccaagtccacgctttcatgcttgctttttaaaaacaaaaacaaaaaaaccttttactattaggtattatatatctcaattttcttctccttggcaagttttttacaacgtttttatttgattgcattttcttctaaaagctatatccctgtaatgttttatttatatgacttcttacagtctcccatttcctctgagaccataattttggacatacattgccctttttattgtgtggatcccctggctgctaggttatagtatccccataatctatgttgtatgtggactgggaggagtaactccctttaacctaaaagttccacaggttatactcaagagaaagtttagtttgagtacgtttgtattcccaggctccacccaaatctcccaaggctgtgagagtgagatttgttgtgagcaggaatagaacaatgtgttttttagaaacattttaacaacatcttagtaacaaaatattagggccttaagcagcctccaggaacattatgggaaatggatccagaaacttgtggctggtgtccttgaagacagcagtggaaaaagattagaaactaagtagaaagcgtcacttcaacttttgtagaaaatcagagtgcttagttctttgaatgctgcatccatcattggccaaaaatggatgttgtgttgcattaaaaggcagaggggcaatacctaaaattacaggtatggtgttggagctttcacctgacaaaggagtaaggagaaatgattgacattaatggagaacacaggcttgtgcttgtcaatcaaactcttaaataggtggaccagggagtgccttttgaaacttaagggaaaaaaaagctatttatgccataggctggacacataatggaactgtcattctgaaaggttataaagaccagaaatctataaagtggacgaccataagaaacagttccatccttatgtaacacagtttggaaaaacctcagttactttagttgacagctccaatcctctaaaacatttgtgagcaatgctttgcagtggtttagcttatctgcttttgcaccctaccctgtagcatgcagttctaggcagtattgcttcattctttatgctccttgaccaacagcttttggcatagggtaaatctgttttgcttattgagtgccagagacgaattagttgatgtgttttgagtacagatgggctacagttcaatataagaagttggatggtctgcatgctagctctgcctcatgcagtattaacatgggactttacctctgtgtctcggttttctcatctctaaagtagactaatgctagtactggcctcgtagggagagaattgaataaattcaatgaattcatgcatatgtcaagcagttacatatatcaagcatatgtcaagcacttacacagtgtctggcatgtaataagagttcacagaaagttagctgcctttataataattatcttcggcccggcatggtggctcaagcctgtaatcccagcactttgggaggctgaggggggcagatcatctgaggtcaggagttcaagaccagcctggccaatatggtgaaaccctgtctctactaaaaatacaaaaaaattagccagcatggtggcatgtgcctgtggtcccacctacttggaaggctgtggcagaatagtctcttgaacctgagaggtggaggttgcagtgagccgagatcgcaccactgcactgtagcctgggcaacagagcgagactccgtctcaaaaagataaataaaaagaataatcatcatcttcattgcagttgtcctgtccttttgcccttttcccctcatatccactcccatcctgatcacagctgctgaggtaggcctgtaaggtttagatggagaatattggtcatgattccctgtttcatcttgcttaatcttgaatgcatatacccgctgatgctgcagcgggtatgttttttcagggacctctgaaaggagggagaacactttttagttaccccccattttattgttaaactttagtaaagccataaaagtacaatcacaaactagtatygaggttatgttactgattttcattagcttaattttcttgaactttctgacgtggttttaatgttagtcaaggtgcagttctgcttataattttaatagttttgtcattttaaacacgtcagtttgtgctcagaaggatgaaaaaatatttaaatagattttgtgggagcctgatgcatttctcaagcaattaagcaatttaagacaagttcagtgcttaattacatttgatcagagcacaggccatttgtacatgtgtattttccgagagtatctactttgcctgtcatttcttttgtttgttttaaattaaaaaaacaaaaaatcccttagactgcaggttaatatttgaagttaacttgtttcatgtgtttgcttattacacacttctgacttggttttgattgctaatttatcttcactggatacttaggccaataaagaagcttataggattaaatgagccttgagtgggggacaggttgtttttttgctttataaagaggaaaacaagaaaggaagaaagctggtagctgtgtgcatttctccagtattgaatcctttctaggctttgcttcatacattgggttttttcatatgaggagcccagagagaatgcatagctttcattagattacttgtgaggagccagtgggctccctgggaacggggcacttcagatgtcccccttgagacactttacatgctctccgggtgcaaccttctttttagtgcactactcttctttgaggaagtgagaaagtttgcatcttaaagggggttggggataggttcttctctcccaaagcttgctttttttttttcctcctttttaaaaagcagaaagtgcatattttttctagagagagcttctttggctattaaaaacaaagtaagggcagggagagcctgctacgttgcagggattttgtgtgactctaccatgcttgataaggattcaggtagacctgaaagcttctccccagccactggatttgttctctcatctcttcttcttgcccccaaatctgcattttctgatgctgaaaaagagaatgatcagagttgtttcatatttttttagctttattctcttctactgtgagtacagctctgttgagctgtacagtacagtactgctttgcttgcaaagcagtacagatgcctaggagaagtttcaggatcacaggagaccagcagttacctggctgtaagctctccttttgactgttccttatggagggaatatttgtactcccagttgttaccttcctgctgaaggacatgagatgtgtctgtttgttatgaagttttccccctacttcccgagttgttgcttatctttgktgggctgttctctgctcttggttgaggtactgggatgtagaaccaccctctattagcatattagttattggactctgggtgaggttggagatactgtcattcctagagggtagaagaggtagggctcacaggcaacagaaaataatgctatgggatatgtttggacattttttagagcagaaatggcacttcagtcagtcaggttttggcattttcctgccatgttctgcctccagctttaatcacttgccccttgcttgagtttcttctttcttcccctctcccttctctcttatctgtggtaggcacacacacctcactctctagttctcctgggaccacaggaagataatgtggatgttctctgtggctccccctgttatattcatgatgttattatttctggtagtggtattctaatctcaaaagtacaggctatgaggtccctgccagggtttagatgctagccttcctatcctgcctttaggaaccttgggcaaatcacttaactcctctctgcctctttacttacctgggaataatgagactcacctgacagctgtgaaagttaratgaactaatatacaagctcctagaatagcattagtgtgtttgatagtaactgtctgataaatattagctgctttcacatagacccatcagacctgatctagtgaggatttctcttagattgtcttcactgtcggaagagttttgatatagggagttccagcaattctaaagatgttaagacttatttatgtgggttgttgagaaagahagtgtaccatttactggtttttgtagagctaaaaccactctacaaaatatgacactttattctgttcaaagaattttgatttatttaatttcatgtgaccattacaataatcacccctgcagagatggttcctggggtcaatggtcagaggcagagctggggttagaacttgagttctcttctgttctgctgcctgtaaatccccaagcctgaattcagttctgcctgcacctctggcaagtgctgtattgtggggagaagtgtggcatccatggcaggggatcctctgtggctctctggaatcagtacatcccaggttgacgtctccttggctctggactcaaagttagtctacctgctggtcgtctacatcagggtgctgtgctgccatccttctgcccatggtagactcaaactcacctgccaagatctaattcattattwcccctccagctttttccagagagcttgcccctcctgttgctgcagttgttcttccagccacatgtactctgaagatgggatcacaatcagtgtckccataccagaaaaggctctgtaactttttggtcatgggagagctctttcctctgccctctcctttgcagttcctagaccaggtgtgttaacctgaattgtcatgggagcctcttaattggtcctttcagcaaaaactaaaagaaaaaacccactcatcatggcaaacattgtcatattagtcttcctggagaggcatttggatttataactctcctctacccggaaagtgtccatcatagcaacatcttccagggattcttaaatataacgatgctgttgacatgtctggttatccctttaccttttcagaatttgtgggaggtgagaagtctgggagaggttatctgggttattatgaaacctacacacttactgaattaaaaaaaaactatgtaacacaattctagtctaaaaatgggcgcacactttctttgccttttagaaatactttttgaaatgtaaaattcgaagtctaataaaggagtctgtccaattaatttaactgtttgaagaaaaaaaccagtccaggcatggkggcttacgcctgtaatcccatcactttgggaggctgaggcgagcagatcacttgaagtcaggagttcgagactagcctggccaacaaagttaaaccctgtctctactaaaaatacaaaaattagctgagcatggtgacacatgcctgcagtcccagctattcaggagactgaggtggaagaattgcttgaacccaggaggcggaggatgcagtgagccaagatcacaccactacactgcagcctggccaacagagcaagactccttctcaaaaaaaaaawaaaaaagaacaraccagctggttgtggtggtggtggttgacatcctcaacagaacagcttttgctaattgttgaagtcagggaagacaacttgtgctgatggcagagttcaagacattacacaaccagagacaatcataaacccagaaatgccagccctgagagatgcaactgatgtatgacttttttcctctctggatcaaaccatgacaaccgtaaaaggcaggccttgctgttaaggcgctgcagcctctgaagcacagttggcctcagggagctctgactcagtctacttattctggggatctggagaaagtcagaaatcatgtgtggtagatagtttgcataactttgggattttccagagagaggatgaaaacggtggccctccttgtaatgtctaggcacatgggacatccagtggaactgttgagggaggagatgggagggagaccagtcaccagaccagttgatgtaggtctcatagactcaccactcaagttgtgcttcggagaaagctgcttcaaatcttcttgatacatttacaaagataaataaatccagtgtgcttctgcttggcatgtttacttggtcctgtggtcagagtgctctggggctttgacaaatgtgctagtcacttagcctatttttacaactctgaagcagccgtgtctaaaaatatttcctctctggctgagcctgccttccaccaggcctagaaaagtcatggagctgaggacatagccttcaaatatttttttttccattgcagactgcttgtcctcaaggtcttaccagcatgtaggtcactgtaatataaaacatgagttctcaatggattgatttaaattgtggtcactcaaactgccaggaagagtcctcctcatttgttgtaaaaataacagatgtctatgaaaggagaaraagaaggcctttctttttttgcagttcatttctccactgccttctccatcccagaaagttggcggtaacttgggtgttactgaattactcaggagaatgaattgtacttgtttctctgtagttattttctaaataagaggttacgttatcaggagaggccatcagctacagcagtggaaagagccaccaggtctcatcttgactttaccaacaaatgtctttattcagtcaacattccctgagggccagccacagccaggcagggtctaggttctcagtgtacaaagatgaatgacatttggtcaggagcctacagtagaggagttcagattactataacacagtttggtaggtgctgtggtacacagatgcagggatgttacagggcatatgggggacatctagcttagggctgagaggatcttggggagtaggcttactaactggaaatgattgttttgttttgttttgagacagagtctctctctatcacccaggctagagtgcagaggcgtgatcttggctcactgcagtgtccacctcccaggttcaagcaattcttctgcctcagcctcctgaggagctggcattgcaggcgtgcaccaccatgcctggctaatttttgtatttttagtagagacagggtttcaccatgttggtcaggctggtctctaactcccracctcatgatctgcccgccttagcctcccaaagtcctgkgattacaagtgtgagccaccgtgcccggctgatttttaggcttagttaataggtgaagttggggagaaggtgaggccaagagaagggctggagttgagaggcagatgtagggagctactggccttgtggtggtggtaagactgtcatgcatgaggcaatagttgtgttctttttgtttttttgtttttttttcttagtaatagccatcctaatgggtatgagatcagaggtttttaacattatactgtgatggacattagagatttcatgaatctccttcatggttcccgaaaggttggtaaagattccttctctgacctttgttgtacatattggtcttcaatatgcattstkatggaaaraggtgttcatggctaaaacatttgagagccaccacastgaatgatctctgggttgtcttcctcctctcaaaattgatgatcctgattatctgtagctaataagcctgaacaataaatgctttcgccaatctcttaaagtagttgagaagctaggtgtgttagtttcccttctgtgatagagaagaaacctgtgttggagagcagtgagcttatgtgtctgtggccatctctgacctgattcacacatgtgcccctcacagacaggcacagacacagggttggcatgcctctagccttacagcctcttggatgaaaggtataagacacattcacatgttggagtgaattaagcacacatccattttgaaatcacagggctggataccacttaaagaatattgatcttgcattgggcaacgcatagcaactgccctacatttccccttttacctagcgtcacaaccaccagtactagaaagcagttaatctgctcaccaaaataacagagagagactttagtggcattttttccacttggtaattgactagactctggctattagctccttttttttccttactatccttttcaaactaataacgtgacttctcataattttaaagtaacttgatgcttacacaaagtttatcataaaggtttctagcaacaaaaccagtcatgacttcttgagaacttatttctaaaataatttacaaattgagacttatgaaaaaatagctctgtcattcaagtgttcatttcatgagtatgaaatatctcccttgtgctagacatcaggccaggtaaaaagtaagatgtgattgctgctcttgagaaacctactgtctagtggaagaaatacaggtatgaacaactaattgtaatgaaggcacagacagcctacctgtcatatctgggatttgatctgaaacagatgaaagttataatagtttacataccttaccttaaagtatggtttttaaatacttaagatgtgatatgacatatagtgtgtatatatatcttatgctaaggaaaaagggacattaaaaaagcttatgttaaaagatatatgtatacattgtactgcctgtatgtttgtgaaatttgtatttactggaaattctcattggcctgtagataggagtgttcctaagcaccctatattgggatttgtggtaacagcagcttgacaacctgaagtggatgatgcaacagcacttttgaaaggtctctccgtactatcttgatttcatcatctaaagttggtgttggcaaagagaagataagtgtttagggtrttggatatcccagttaccctgatttgatcattacacattttaggcaggtatcaaaatgtcacatgtaccccaaaagtatgtacagctattacatatcagttttttaaagaagaaaaggttggtatggttagcttttctatttcaagtgtatcattcatctttcacatctgggatttctcctatgctctggttggttaataacttttattctgaaatcggtgagattcttatgacatgaaatagtctataaccagttaagtttttatttctctgttctgttcacatcctggggactgggctgccattacataactgagcagccattggtggttcacaccagcgccacacccarttattttctttcagtatttgaattcctgcacaaaagatctgctgtatctgcaaatcactagaggcacaaaagaagtgattacctctactaagggttgggagaagtttcactaaaggagagatggtgtccatgttagattatgaagggtaagttgaagtccatgaagcagcaatgagggagccggacatgtatggcagaggaaaccacatgaacarrggcacagagccatgagatagcacagaggagggagacgtgtggtgtggctggggaagactacagaatcgggttactaccgtccaaagcatttgttatttagcagttattgaccagctatcatattcaaggcatgtgataagtactaagggctacaaagaccaaatcaatttctgccattaagggattttaaatctaagagcagagattagacagagatctaaatgacacagtttactttggtgtaaagtagtacaataagagcagtaaaaatctagttctgaggtttcaaaatagaaagtacattcatttggaaaaaggcttcatggagagggtagcatttgaaatgggcctgaataatggatagaacatttctggacagcagttaatggttgggattaaggaaaaagtgttgtccagaaaatggtgacctacagaatagtggtaccagtaatgaaggccaaggagaattgattttagggtcaaggtgataactgcagcttagatagattattttggtttcaggcacagttggaagtatgagaacgattggaatttcagaaggaaattatattggaaacagaaccttgaaggaagtccttgtttataggcttagaagatcaagagaggtcaattaatatggctaaaaggaacagacagataagaaactgaagagtttcaaaaatgaaacttttattggcaatgtacagagctgttgtagaagatgaagccaaagaacaggcattgactttagcaatttagtagaccattgataagttacagtagtccccccttacgaggggagggagtacattcctagaccctcagtggatgcgtgaaactgcagatagtaccaaatcctatatatactatgtctttttgatctgataacccagtcaactaccaagtgactaatggattgggtagtatacagtgtggatatgctggaccaagggatgagtctcctcccagacaggacaatacaagattgcatcacactactcagaatgacatgcaatttaaaacatgcatcatttatttctataatttcccatttaatatttttggaccatagttgactgttggtaactgaaactacagaaagtaaaaccacagataaaggggggaccaactgtatctaatttcatgcagcagtggtggtggaagaagctactctgataggaatgtttgtgttccctccaaaatttatgtcgaagctgaatccccagtgcagcagtattaagagataaggcctttaggaggtgattaggtcatgagggttctgtattcatgaacagcttagtgccatttaaaggggcttgagagaccaactttgcctcttctcccttctgccatatgaggacacagtgctcgtcccctccagagcaggggtccccaacttctggtccgtggcccattaggaaccgggccacatagaaggatgtgagcagctagcaagacttcatttgtatttacagctgctccccatcacttgcattgctacctgagctctgcctcctgttggatcaagagttgcattagattctcataggagcatgaatcctattgtgaactgtgcatgtgagggatctaggtttcgtgtccttgtgagaatctaatgcctgatgatctgtcactgtctcccattatccccacatggcaccatctagatgcagcagaacaagctcagagctcccactaattctgtattgtggtgagatgtataattatttcattatatattacaatgtaataataatagaaataaagtgcacaatmaatgtaatgcacttgaatcatccctaaaccatcccctcttccctgcaagacggtagaaaaattgtcttccgtgaaattgtctcccatgtcttcctggtgccaaaaaaggttggggacctttgctccagagcatgcagcagcaaggcaccatcttggaagcagagaacagccctcaccagacactgaacatgctgatgatcttgatctctgttgtttatacattacccagtctttggtattttgttatagcagcactaacagactgaaataagccatattactagagtttaggaatttaatggctcaggagaaagtagaagcaccaagtgtagtgaataaaatagcagctaacaagctttgtgcaccttcacatgmctggcactggtctaagcatgttaaacacattaacttctttaatcctcacaacagttttatgaggtgggtacctttgttactaacctttatgacagatcaggaaaccaagacatagaggcttcatagctcacccaaagtcacacagtgagtgagtggctaaatcagtgtcttagtcttttttttttttttttttttgctgctattaacagaatacctgagactgggtaatttataaagaacagaaatttattttctcatagttctggaggctgggaagtccaagatcaaggtaccagctttggtgtctggtgcagacctactcgttgtgtcttgctgggggaagaaggctgtctgcacatggcagaaggtggaagaaagctagacgaactttctccgtcaagtccttttataaaaacctttaatcccattcatgagggaggagccctcatggcctaatctcctcttaaaggcygcacctctcaatactatcatattggcagtgcctgacttttgaagaggacacattcaaatcatagccaggttttaaacccaggaactccaactataggcttgtttctccacatatcaccatgccaccaagtaatttaaagactttggtggtaaagcaaaggccagcctcaggtgattaaggaggatccttttcttcctccctttttatatggagcaggatcccagcccgtttgtaaaaaaatagaaggacacagaagggaaaacttgaaaatgaaaactgaaaaacaagtcatgaaatcagaagatgtgagatcaaaagcaaaataaaatagtttaccttagaaggctgtgcctggatccaacaataggcctcagacccttgcagaaagaagaagggggcagcccagaattaaaaaaaaaaaacaaaaaaaaaccccgcaagctattgtgatgtgccaggcaccactgcaggtttttgacttgtattaacccatttaaccctcccaacaaccctgttgcccctgttttatagatgaggagacagcctgctgaggttaaggaatgttttccatccccaacttggcacacaggctctggagtctggcccttgcctgtctcagtactgtttcaggctgttgccctcagaccccgccatgccttccagggtcaagaaaggcatgtgagcaggcagcttgagctccctgtcacgtgtagacagtgagaataatgtgccttccccaaaggcagttatgaagatcagaggagataatttatgaaaagtgcaagctctcttgagagtaggggattttgtttgttcaccttacaaggcaggtgttgagtcaataggctgcagtcagtgaaggaatgaatgcagtggcatgcgcagcgtggtggtctaagtggtagttttggtccatccctaggggagcacaagtcttgggcagaggatcaaaagcacacacctctgagaagccaagtgtttttgtctgtaacctttgatcattcaaaaggaagcattttctaacctctgcatttttttacccaaactgtacaaaggcttccttgctgtccaagttgtggtatactccagtgcagctgcctggcttccaagagaaacttagcacttcttgttctgtttgtagcctcaaatcaacatgtaaccaaaagctgtgaatgaataatccaaacttgaagaaccccagattttattcaggaggagtaactggaagccataaccatgaacttccatatctgtcataggaaagaggttggcctcagcagcaatgagggataattctttcaagaaaggaatgaagagagaagttagatggaaaagagatttttaaggtcaaaagaagcagctgaagaacatgtgtaggacagccttaggagttactacacttcaagacctgggtgtctgctggaggaaggaacatgaccctgcggagatgttaagggttgggagagctgagcttggaggctggaagcccagctgggaggctattgttaaagaggtaagatgaccctaaactagtattcaggatgttatgtggtactaaaaggaatgttaaacgaagtgataatactgtattcagtttaaatgtttatttgatactgtaactcaccatatataccttctttttttctttctttctttattttctgtattggaaactcctaatcaagataccttctttcttaatatttgatcttatggttaccaaaaagattaaatcaagccattgtttttcaaactagggtctttggggatctaaaacttacattaaacaatcttaaaatttgcctttttttggatgatcctacaattaatacaagtgtattctggatgatttgaatgtttcatcactaacgagatctgagatatccatccccttatgtgcatttgtgttcatattattatttgtgccaagtgaagccacagtgtctcctccaaggacattttgccgtaagttgaagaaagaaaaatggtgggagaatggagcaattacaggcacttgataatgttggtgttaggacttcgaatgctaaagaatggggcctcacaatggtcagtacagtatttatgttgtaaatgtgtgtgttgcccggattcattctttggaagaataattagttataggcataatggtaactgtgaatgaattttcctcttccaaatatcaaatacagtcatatgctcatttaatccagattttaatatcataattatcttgtttcraaagaacaaactgcataactaaagtgatgcttcattaaaattgacatttgaccttggagaactgattaaataaaattaaatgagataggataggcctggtgtctggcatttggaacgcactctgtatgggagctgttattagggctggcaaacctcaatgggctctggtttcagttggttgtggagtctttcacggaatttcttctctaggagattcaagattttctcccagcattgtagcctgtggagaagaaaggaggatcaaagctcaaaggtggtggttagtcagccaggagcaggcaggtgaccatcaaggaatctgtacaggggatggtagatgcaagtgtggccagaggtcaaggctagaaaagtgctattgcagagaaaggggctagaacaaacatagtcaaggaagcaagtgcagggcctgaccttcaagaaaggaattaagcaagctttatgtaggactgatggagcaagaccctgatgtgaagagtcccaggcaggaggcctggtggggcttgacctttccttagggagtgtgtgggggaggagtcttcccaaaagtgtcttcagcatagcgtctggaactttcagagagcaacaggaagactttggaactcaattggtttagagcttctcagtggtttgaggagatagatggcaacctaggagtggctggtgtagacagggatagggatcagagccgacaggttattttagggcagtgctcagtatctgggggtgtttttaaaaatagcaatgactaggcaccaccccagactagaggaattagaatatctgtaggtggggcctggggtttgggctttttaaatattcccagttgtttctaatctgtgccagatcagagcacagatcttagagcagtggttctgaaaccttggtgagcatcagagtcacttggaaggcttgctaaaccayagctcactgagccctacccagagtttgattcattgggtctggagtggagtctgagaatttgtatttctaacaagtccccaggtgattgttgctgctggtccatgacccacactttgagaacccttgtcctagaaccacaaaagggttagggtgttctgtgttgcttttgagtctgtaatgctgacatggaaactgtcatttgtctggataggtgcacttgtttatcaggtaatttttgctattactgtgactttaatttgattgaagctgaaggattcttgttgagggtggtatgtgttagtttcacttactagccctggggccttagacacattatttaacctctctaagcctcagttttcctcatctataaaatggattagggttgttggattaatcagaaatagtcttggaaaacgcagattatgaacccggcacatagtagatgctcagtatgtggcacctcttatttttgctgcatttggcttttttctttttaaaggcttaagtttttgtttgtttgtttgtttgtttgtttttgagacagagtctcgctctgtccctcaggctggagtgcagtggtgcgatctcggctcactgcaagctccgcctcccacattcacaccattctcctgcctcagcctcccgagtagctgggactacaggcgcccgccaccacgcccggctaattttttgtattttttaatagagatggggtttcaccgtgttagccaggatggtcttgatctcctgatcttgtgatccgcctgcctcggcctcccaaagtactgggattacaggcatgagccactgtgcctggcaaggcttaagttctttctgagggtaggtagagattgacttctgttggctctctcagcccttggagatctcatagaagaaataagacaagtgtactaataattcagaaataaacaatgtggccttcaggtggcctatggctgctcacccatgcttaagagtaccatagcctgtcgaaccagtctggggataaaagttgtgcagtttttaatggtccaaatgagagaaaggaatagcctgcctaatatcttgagtccatctctgttatggcccatttagactaacgcaccagtaggagatgaacaccaactccatgtggatagattaatcaaagaacattggacctataatcctgtggatatcttattaagcatctaatatgtaccaggcatcaggttatatgtttttcatgcattgattgctcactgtgggtcatgggttgggcactggggtttgtaaagatgattaagacttgaagctgcccttagaagttgctaaccttgtgtctctagggtatgactgtaagaaatgatggcaaggaaccttgcacttttagattgggttgatctctgcacatgggtaaaatgaaaatgctactataatttgaaatcacttgaagttatgctatagtggtagtttattgcaacacaataaattgtgacctgcatcactgacttgaatcattggctagatgggccttggtccgttgccacttaggggaaaaccttggtttggattgatgagggttttgcttttgggacgttgttttactttgctgcctgcccgcagcctgtggaatgtttctgctgatgggctggtttcctgcttgcctctgtccttgtatcaagataattcattscacgttgccccggttgcccagtcctggttgtcaractttttggtcctgggagcgttttcatgccttggttcccagacggtgctgatgcagcctgcaggtccacaggctcagacatgagcccactgtgtgctgctttctcagggagccatgagtgcagttgaaataaccttgcacttaaaacctgtcttaccattttgaaaactgttctttggaaatcttgccttgggatttgaacgtctttgcctttaggttttgctcttttgtttctgtttcttttactcattggttttctgcttttgagttttggttgccttgcttcaaaaatcttatatcacgaccatggtttgggactatttctgtcatctccttgttcttctctgggcaagttcattccagataacttgcccctctcctgcacactgttggtgtcatcgargttccaaagcaatggttttgcagggggcttctcagatcctgagggatatctcagttctgctgtcctcttgcatcatttatgattatattaggtcatgcctgtcctcttgcttctggcctgaactaattcacttacacgtgcctataaggtgatcgaggtgacccaatgatcttcttttagccacaatacctattscatgatccttgctgaagctattgccagacagtgatgaaatagggattgatttgtcactcactgtgactaagctaagctggctgtgtgtgagcttgggcagtttcactaaacattcccyttaccctaggattcctccctcagccagggtggcatggtgaaggcagggaattgcccatcctaaattagctgatcccaaagacttcattttcttgggagtcttgtcaccaaatagcccttggggacaggagtctttttgccaccattattagagtttaaattcttacctattactgatttaagggctgtagaagagagaagggccaagaggccaagctgtacaaggggctccagctccaaggagaaaaggatggtggctggggagtgggtgctctgggaacagcctgctgagcactttgaaatatggctagtgccactgaggaactgaatatttaattttacttaattccaattaatttaaatagccacatgtagctagtggcccctgaatggaacagtgcagtgttaaaatcagtacagagaagtatttagagcttggccttcggggctttgattcagattccggctctgctgtctacccattgagtgaccatagggacacttcttaaccttctacagttgtttcaagaatttgttgtattcaatataaagggtttagaacagtgcctggcaagaagtgtgtgtttagttaatgttgacttatcatatgttcactcggtattttgaatggaatggtagtagaattcatgtggaatatgaaatgccactgttttttggggtggggtgtgtgcgcgtgcgtgttatgttttctttcttttaaaaagaaattgttcttttgttgctctaggttgctgcagcaactggtcacacagtagtgttggtagaccagacagaggacatcctggcaaaatccaaaaagggaattgaggaaagccttaggaaagtggcaaagaagaagtttgcagaaaaccytaaggtaatttcttattatcgatgtcttcaagacaagtcctctgactgctttacatttgcagggcaatgggggatttctggctttctttctttcttttttttttttttttttcagtttgttagtgtaaaactcatttttccataactttaaaccaatataataacataattactaaacattcagggggtactgattacaaaacaggagaagtaaataaccattttgttgggtgggatttgaggttgagaagaaagcttgtacatacaggtggtgaactcattctagaagaacatgagaatttggaattgaagaacacttgtttygctaaaaggatggaagaagaagaaacaggaagataatttttatactacaagttamgaagagaatgatataataaatatggtatttatagaaactaagagtgaatcattctacttgccaggagcagaagagatagaagaatttgaggaactctgtggaggctgggaatacaacagcatggtgggatgagwaggagttggtgactaagggccatgctgttttttcagcgcactttcacttaggagtttgcatttaattagaaatacagcacaaatcasccaaacaaattttaatttaccttttgtcatcttgttaaagttgcttaagattgatttccttggggcttggatagaatttctcgctgtatgcagccagagaaaagtacacataaggcatttgttgtttctcacttcaagtatccaaggtggtatatctagatgcttttaaaaatttttttattatggtagaatatataacataaaatttgccattttaaactatacaattcagtagcattaattacactcgcacattcatacttcatgtaagtggaatcatacaatatttgtcctgtgtctagcttatttcacttagcataaagttttcaaggttcatctatgttgtaacatgtgtcacaacttcattctttttttttttttttttttctgagacagagtctcactctgtcaccaggctggagtgcagtggcacaatctcagctcaccgcaacctccacctcctgggttcaagcagttctccttcagcctcccaagtagctgggattacaggcgcacgccaccacgtccagctaatttttgtagttttagtagagatggggtttcaccatgttggccaggatggtttcaatctcttgaccttgttatccacccacctcggtctcccaaagtgctgggattacaggcgtgagccaccactcccggccaacttcattcctttttatggcttaatattccactggattattatcatattccaatttaatattccattggatttataccacttttttttaacccattgtattagtctgttctcatgacattgctaatgaagacatgcctgagactgggtaatttataaaggaaagaggtttaattgactcatagctccacatggctgggaaggccttacaatcatggtagaaggcgaaggaagaacaaagtcatgtcttacatggcagcaggcaagagggagagcatgtgcaggggaactgtcctttataaattaccccccactgggcccctcccacaacacgtggggattattacaattcagggtgagatctgggtggggacacagagccaaaccatatcactcattcatctgttaatggaattgggttgttttcaccttttggctattttgaataatgctgcagtgaacattggtatgctattggtttggagtctctgttttcaattctttgggttatatacctacaagtagaattgctgggttgtatggtaatcctatatttagctttctgaggaaccaccaaattgttttctgtagtgactgcactattttacattcccaccagcaatgtacgaaggttccaatttccccacatcctggccaacacttgctattttccatgtttgttttgttttgtttcttattgtagccatcttaggtgtgaagtagtatctcattgtggtgtttttgttttttgtttttttgttttggaaatgaggtcttgctctgctacccaggctggagagcagtggcatgatcatagttcactatagccttgaactcctaggctcaagccattctctcacctcagcctcccgagtagytaggactatagatgtgagccaccacacccagctaattaaaaaaaaaatttttttttagagacagagttgtactgtgttgcccaggctgctctcaarctcctggcctcaagtgatcctcccaccttggccactcaaagtgctgggattacaagcataagccaccgagtcctgctatcattgtggttttgatatgcattttttccccaatgtctaggtggcctttagatgatggtggagataattttaccttctctaggatgaaattcaaataataaatatcacaggcagattaatgttagaaatgcttgttctttggtgctgtraagaaatagcacttgaaataaatttaatttcctcagcaagaccatttttactttctgcagaaagggtacactcgccagsatttttgccacaagagtacaccgaacaaaggagacagggtcatttataacctgacacgtccatcttactgctgtgtccggtttctattggctgggacgggacttcacattcaaatgtatttgtcttgattggctagcaacttagaactttttgaaagaggcaaaggcagatgagaacaaaggaaggaggaagtaacttgtggaatgctgagaaaggtaaaaacacctctaaataaggaagaggaacaggctatgacctaatgcccacttggaccagtataagcatgccagggcaaatatttaggctaaattgtgggagctaagaacataaagtacattgatttctttattacagctagcagatattgaagaatgttaacaggtcttagaataaattttgcttctaagaaaagttactatttattcttaattagatggggaggagagtctctttgaagaggaacttctactttactttttacattaagatattcttcacctgtcccttatattcttttttgttgagacggaggagtcttgctctgtagccaaggctggagtgcagttgcgcgatgtcggctcactgcaagctccacctcccgggttcacgccattctcctgcctcagccttttgcgtagctgggactgcaggcgcccgctaccacgcccagcaaatttttgtatttttagtggagacggggtttcaccatgttatcccggatggtctcgatctcctaacctcgtgatccgcctgcctcggcctcccgaagtgctgggattacaggtgtgagccactgcgcccggaccatctgtcccttatattcttaattgtagtgggaccccatgcaggggatgttatgaggagggtccagacagatgagattataagagccctgggctgagggttggagtctaggacagagtgagtttgacccagatagcctgcattttctgcttgtttacagactttcagctaattgtctccttgggctgagtttctgagccacaccctaaagataaaaggatggcccctatgctcaagttgctcagctctggctagctactcctcagaagtctatactcctgaggtttctctcctctgccagggacaccactgaggagggaggtgtcagtttctctgcctagttgacatactatgcttatctagctctatactgaccaccaatataatagctactcacaagtggctactgagtgcttgaaatgtggctagtctagatagaaatgtgctctgagtgtaaaatagacactagattttaaagctataataggggaaaaatatataaaacatctcaatatctttaaatattgagtacctgttaaagtgatggcatcttagatatattgggttaaataacattaatttcacctgcgaatgtcttttccctttttttaatgtggctagtagaatatttctgtataacagctgagatctagctgcttattccatgatgattttggatgcctttgctgattatgactattttgatgccctgtggacaaattacactatgaaataaaatggcggcttatagaggcaccatctccaattctgtccttattgaggtctgtggaaacctggagtcacaggagaaaaatgaggaaacgatgaaaactacaggctctttggcagcagaggctgtgtctagcttgtttcggaaacaacagtttcaggcatatgacagacaataattatttgataaatgctaagtcggctttcttaccctggctcttgcccttgctctaataggagctagtctctgcttttattagagaggaatagtcagcaccacctcaagactaatggatggcagggagctatggaaggataaattacaggcttcgtggacactttgagaacagatagggtaggccaatacaggtgctctgaacacccagtttgctaactggagcagagstaagaacttgaaagataatttccagtgagcccrgtgaatgttctcttcttcctcccactgcattaggccggcgatgaatktgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgagtatgtaacctctggacaatcttctctttttttttttttaaccttatttttgtttttcatttttattttttgtttttatagatttgtgagtacaagtgcagttttgttccatgcctatattgtgtaatggtgaagtctgggcttttagtatacccatcacccacatagtgaacactgtacccaataggtaatttttcaaccctcgccaccctcccaccttttgaagtctccagtgtctgttatttccctctgtacatccatgggtacctgttatttagctatcacttatatgtgagaacatatggtatttgactgagttgtttcacttaagataatggccttcactcctgttcatgttgcttcaaaagacatgattttattcttttttatagctgagtagtattccatggtgtatatatgccacattttctttaatcagccattgatggacacttaggttgatttcgtgtctttgctattgtgaatagtgctgcaataaacatatgagtgcaggtatctttttgatagaatgagttttttwcctttgaatatatacccaatagtggggctgctggatcgcatggtagttctgtttttagttttttgagaaatctccatactgttttccttaaaggttgtactaatttacattgccaccaccagcatgcaggggttccctttctccagattctcaccaacatctgttggttttgactttttaataaaagccattctgactggtatcaggtgctaaactcattgtggttttaatttccatttctctgttgattagtgatgctgagcattttctcatatgtttattgaccactagtgtgtctttttttgaaaaatatctgttcatgacccctggacattcttgacagattctgaggggtccctccctgggccttgaactttcctccttgtttattgctttctcccaggaagggatcctttgaccaagtttatccacctccctctctcctaccccacagctatttcaagaaaagccaatatggtttccgttgttctccatcttcccactcccagtttgcttctgaagcttgggctgctgtgatctgwwccttgtcccagatgcgtgtagaattacccatggtracatggaggggtccatccagggacaggcctatgtttcwtgaagtgtgtaggtcatggatactcctatgccagaagctgctctgacgttccttggttcatttcacacyggcatctagaggctgcagagacatctgacagcagacagttaaggacatgtagggtacttctgtgctccactctcgggcataggagtaccctacgtgtccttaactgtctgccaaggaccctcagagcagttctgtgtttcctccttttttggatggagcaaacagaatggtgtaattgaagggaatgcctatagacagagaggactttcctgttttgagcttcatctgggttcaatcgaagtactcttgggagtgttaaaggagcattgacttcttagctggctggcttcctggtggaattcttcctggcagaatgtaccttgggatccagagccttcgagtgtgtgacacctgacccactgatcagtgctcttctagtgacttgtttgactatattttcatgcttcttggttggaattgaatggcagaataagattatatgacaaaagcaattctcagggcacttccggtgggcagtggctaaagagagwcacttgcataccagcttgtcggaatgttaaccttcagagatgggtggccttgtggccagagaggccctgcccctgacaaagagaagagacttgsctttctgtcatctgtccatcactgccaatcagtgtcctcgtgcatttcacactggcatctagaggctacagagacatctgacaaaaacagaatatacttgtggtaccgggactggctcccaggccagcagggagccctctgggataataaacagccaccccaaaaaagggagttttgtcaagcagtttgatctttattgaaaagattggtcgctcttggtgacagtgaaaggcctgactgccctccattgtccatgtctggtacagaagaaggatcactggagaaagtcaggaggcctgggcctggtgctgaccccctcaccacctccagccttggaaaggtcctcagtytcgtcatctgtaatgcaagttgaggtgattggggtaaataatttcctagacctytctggctctaactctctaagactagcttcccccatttgtwaaataggagcagcagcactggtacctattgtacagagttgtttaggaaactcatttcatttagctcacatttcctgagtgcctgctgtgtatcaggcmmtacactaggctctttaacctgaattgatgcaaaacagatatgaggtgtgaaaagaaggcatgacccatagtcataccaaagatgtgactttgctgctgaccttctccacctttcttggcactgtttgtttttgttttagatcaccaccattattgaatgcttgctacaatttttaagccagccgtatttgagagggtacttttctgacaaattttacagggttcagtcctataatgggagaaggaaaatatagtcaagtgatacatttcgggttggaagccctgatgaaacagttgcatcctggagagaacatgacttctctagcagcagcctaagacacacaaatgaaaagtatgaccagacgcacaggcagccagatcgaagtcctgactttcccctttagacaaaatacagactcttgaatcctttgccatccccaccacccctcttgtcttctttatactagggtctggggccattgctaataatcactgtgcttgtgttgtcgattttcttttagaacatttaagagaaaagtagtttttttggtacctgagtgtccgaatgaaaaaaacaaaagatggttcaagacaagtgtttccaggaacatgtaagagtactttttttttttttttgagacggagtctcgctctgtcgcccaggctggagtgcagtggcatgatcttaagctcactgaaacctctgccccccaggttcaagcaattctcctgcctcagcctccctagtagctgggattacaggcatgcgctaccatgcccagctaatttttgtatttttagtagagacggggcatgttggccaggctcgyctcgaactcctgacttcaagtgatccacctgcctcggyctcctaaagtgctggtattacaagtgtgagccaccgtgcccagcccagagtacattttgtttgtggatgaaaagactgtcctatgtgtttagtattctctgaagacagtgtgagacttttaggaacaaagtcagcctgaccctgttgggagaggcagaagcagaggtctgctggggagagatcatttcctccttctgataaaatgtgccagagtgccctggactggtgatacctggaactgggctctgatgtcactttattttaccaaatgtgcccaagtttcccctttttgcaggtgaatggcccttcaaacattctacmaaaaggggtattacgattgtaatactaatctttaaaataacactttcttttcttaaggggagtgtggagccacagctggcacagccttgggcccaggctgtccctgctctgtttttgtggttccaggtgcttgtggtgcaggttgtgtggttgaacagtgcttgtgttggccacacacattgttattggaagaggatctttttttcattaccttctgtaatggggaatagtttatattattttccccaatgaccaaaagcaagaaactttgaaaactgaaattttaagaccttaaaacaatgtcattttttttttaaaaaggaaaccctggcatttaaatggcctaccttggaagctgttggagaaggtggatkkgctcatacctggaaagagaaggctctccgctgcctaccmacactagtctcgccttttacctcttttccctcctttccaaataactggtttcttctcccttctcttcctcctctcctcccacccgcccctgatttgagcagattatagtattgcctgttaggtaagcagaaacccccaagcctggtcagtaagggatcctttcctttcctgccctgttacagtccatcttggttggaatcagcaccaggcctgtttgtatgtttttatccgcaaggtggcgctgcaggaaagcctggaagtcaacctgtttaaagcttttcctctcatgcttttggcacgccactttactgtggccttaaagaactaaatttggkttaagtcagtatggattttttttaatgaataagttaatgtcttatatatgcatatgcctatatcctcttttccccatatctacccatgtaaccttaaaatttttttgaaccatgttggtgttcttgttttcattttaattcccattcaattgaaaaataaagcttttcacttcagggaaaatatcttaattcaygtttattatcatatgtttctgattgaggatttatgtgttcatttagaattttgttgcttttaggtgtctttctttcattattttttgatcactgagtttcgtttgtgactggggttggttaagtagcttgatcaattagccacctcttgttatctcacataccttggaagttaactaatacaagtaggtaggggaaattttgttctggaaaatcaaggaaggattggtgaaggttaaatacctcttcggaacaggaaattccaattttatttcaaatttaaaaatttttaaaaagctgaagtcacttgatttcagcctcttatatgaagatgtgtcttctccctcattcccccaatgggtcaggacaacagatgtggcagtaagcagtcaccttgtgcattgcatccaagagtcatgctgttttgaaagaagagattcactctgatactcccactatattttctcttcacagacatacaatctttgccagcaacacttcctccttgcakattacaagcatagctaatgccaccaccagacaagaccgattcgctggcctccatttcttcaacccagtgcctgtcatgaaacttgtggaggtcagtgggtgtcagcttgtgtgtgtctgcccgctctgccagctctctcagtcctgcttttctgtgttacaccagccctgccaccagttgcctaggatgggttttaacctgagggtagaaggttgtccctgagcctcatatctaggagggcttctatgctttgtttcttcacagccctgtgtcttgcttagtgatatccagaaaggctgttaactttgtggaatgtcatttacttatttgtgccagagctgatgggcagtgctgagaggcatcagaatgggaaggcagcactagaaaccgtgggctggwwgggaccacacagagggcagctacatgtgttcatattatctcatcgaggtcagcttgcccatgctgtaaatgcagttctcattagatacactatactagcttgtccacagttcctggggttaattctgaccccatgtaatggtgccttagcattgtccccagatgaggtacatctcctgtgcattgtgatcagagctattaaaaccagctcccattgggtgcggcggctcatgcctgtaatcctagaacttttggaggtggaagttagtggattgcttgagacccaggggttcaagaacagcctaggcaacatggcaagaccccatttctacaaaaaataaaaaatcagccaggggttttggtgcacgcatgtagtctccagtacttggaaggctgaagtgggaggattgattgagcctgggaggttgaggctgcagtgagctgtgattgcaccactgcactccagcctggatgacagagcaagatcctatatcgaataaaaaaaccctaaaagtaaaaaaataaaaccagcttctgatagccttgagcctcctgaccataaacctggaaggtggagcggggaggcagggagggcttccccagcatcctgtttggaatgcttggagactccaatatgttggagttggagtcacagtaggcaatttgcacctgaaatgggacaacttgccttttacagggtcctaattacagggtctgaggagcagccgctattaaagtagcatttgttctgaggttgaggagttattgccctgcgaagtgtgggggacgctgatgctgccatgtgggtgatgtggggccaggcaaacctacacacactggctgtggcctctctgggagtgtgtatcgtctgttttcttcattattgccttttccaactaccttttccttcctttatcctcctcattccctcaccactactcagcataagcatttttaataagtcataataatgaccattttttttagcattttctctcaagtgacaactttgaccatctwgcaatgggactttttctgtcttactaacattgcttctcagcttcctcctattttctcctatcccctaaggctgattttttgaagaaattgaagaatgaaggggagggatttggggaacagaagaaacagcatttaacagctcttatctcatgcagattaagagcamagaagtggcatgcatttccaacatttcagtacttagggactagttgatttctttagttattatattgtatatataagtgttttggagataggcacattctgtagatttactttaataatgttttcamctgcatttatctggtaatgtatgcttttgtctttggaaatgtagtgtgttggktgttaacagctgatgtttagcamatgctactattttttagaaagtattttgtaaaagtgttcttctctattcagtttttattgtttaactttagctcttccttgtgttgctggtggtgtacaccaaaataacttgtataataagctaagtggctcctttacttaggactgggctcatttaaatgtatatatatatgtattttttttcagactctgttggaactaggagcagcgtatctgtacaaattactgttcgttgaatgaatgaatgagtgaataaacatccatctctcctgtttaaaaagaaacaaaccttcactattattaactcccttaaaccaaaaacttaatttgaaaactccatagtcagcagtgtttgtcccccagctcagtctgtggttttgatggagactttttagacctcctttcaaacagctctgggattctgtttgatttgtggtacccgcagggtggcttctggtctttctcgtcctgctcctcttctccatcttcactgtgtcttttcctgtttccatccattcacttctcttgatgtcacgacatgacaccatggcccaggctgtgatcacacgaaaacaggagtgagaactcttctttgtttatatagcacctttcatccctgcacagacactagctcattagttcaccgagtcagacggccctcttgcacagggaagacatgcccatgatccccattccagagaagagaggtgaggcagttgcctaagatcccatgaagggtctaaagtaaaccctttgactccgattgaagttctttactggcctttacattttacatatatatgtgtgtgtgtgtgtgtgtgtgtgtatgtgtgtgtgtgtgtgtgtgtgtgtgtgtatagttgaatgaatgcgtgaataaacacgcatctctcctgtttaaaaatatatatatatacttcatctggttctttccatttaccattacacatgagttctctaactgcttactgagggctgactgtgccgggcatcgtgcttggtgccgtcccctacagatgccagtagggcagcccttgtgcccttgcctgtacctcacagaggtcaggagggctgctggagcaggtggcagsccccrcttgctgtaaatgaaagccttccccagaaggatgagtctgttctgaagccaaggggccactggcctctagagcatctgtgtggcagagggtggagtcatgggagaaatactcaggaatccaggagaactgtcacttgggcaaattactcactttcctggggctcctcctcctctataatagaagatcaggtcccatgtagaagactttaagggcaaccatcatatacttccagacttctaataattaaataatggaagtcagcatttattgagcatttgtgcttaggctttgtgctttactcccaatgtaatttcattctcacctcaacttcctgaggtgaacagagtgatttcagtgtcatttcagtttcaagaaacatactcagggtcacacagccagtaagtggtgcaactgaacccaggcttgtctcaacaacaaagcctgtaaaactgtcctatacacacacgtacacacatatacttgtattttaagccgtgattttgtacattctacagtacactgttgtcttttttttttttttttgagacggtgtcttgctytgtcacccaggctggagtgcagtggcatgatctcggctcactgcaacctccacctcccaggttcaagcaattcttctgcctgggcctcccaagtagctgggactacaggcacatgccaccatgcccaactaatttttgtatttttagtagagatagggtttcaccatgttagccaggatggtctcgatctcttgacttcatgatctgcccgcttcagcctcccaaagtgctgggattacaggcatgagccaccacatttggcctctgttttaaaatagtcattttgggaaatacattgtttctggcttgagattcctacttctatgctgaaactcaaactatttttgttgcctatatggagccttttgatcaatcattccttgaaccattctacygaagttgcttgctgacactctggtcataattctctgctttgcatttccaggtcattaaaacaccaatgaccagccagaagacatttgaatctttggtagactttagcaaagccctaggaaagcatcctgtttcttgcaaggtaagagtatggrtagcttgggaaggaggtagttcttttcttcttggaccctgacttgttmctggtagaattcttctcatagaatgatgtgaaagaaggagyattgtatactgcaagcttgtccacrtgctgtaaagagcaatccgtgcctcctgttctagtttgtagacagggaaactggactcctaagccatgcctaaggccattatgtggatagtctgagacctgaatggagctcaggacaccagctgagtagaagacacgggactgctctctgtcctggcttttgtctcctgatgaatggctgcattttcataaatgattttaggtacagcttggtaaacacatacmtccctaacagaaaatgagggctttacttttgcargaaatactacagatggtgaaataaatgataagacagtgagagagcaacctgccaaaatagcaataaggaacctgtttctcaccgggaagttgcattatgtttttattgkttgttgttttgtttttcaagaagcagcatggtttagtgggaagcctgcttgacctccatcttttttttcccctttcttaagctgcccagttattgtatataaaataatcccagttgctgaaatgataacctacctgaaggtaattattttgattaccttcagtttctccatttgctttagttcctctttagttcccccaaaactcggggactatacttatgcatgactttgcagtttttcttaaggggtagttgtgtcacaaaatgctacaccattacraagatttacatataagtcatctactttttttttaactgtaatcctttgtatcattatagttctcatagcaaacttttgctttctaaaatattctcgagtttgaacttacagtactgtactaacccatgaaaaatcatgytgttcatgaatcacctgaagaagccatctgttgaggtggactccagcagccaaagagagcaggcttgtgtgtcctgctcctccccgtccatgggtaaagtgttgttagggagtctcatgctttaacacccattttttgtttgtttggttctgtagttttaagtcatctagatttctaaactcatattaataattggatgttatgattgtactttcttacgcagttatgctttgttagtggaagaaagtagtaatggtattgaaaagamcatctgtgcaagacaaaaagatatggaaacagaagtacagggaaaagctaatgattatctycagcagcataataattaatctacaaagtaatgattcagtcttccatcagagtggccacggcagctgcagagatgggaactctttgttctcattaaattatcttgttaggtcattccagaactctctctgtgtggtattctaagggctttcagagggtctttctgggtcagttattgaagctctttatgaggcatctggacaatatatggcaactacataggacaagggtcagcaaacttctgtaaaggaccagatagtgaatattttcagccatacagtctctgttgcaagtagtcagttctattgttgtagcatgaaaacagccatagacagtatatgcaatatgagtgtggctgtgctccagtaaaacttgacttacaaaaacaggctgtgggctacagtattgtactttaccaayacttgacatagaagaggggcattaatgtgcctggaatgtgccttcctagtgagacttcatgaggggattgtggtatataggttaagggtatgaactagcccaactgggtttaaatcctggtgccggcacttattagctgtgtaaccttaggcaagctacttaacctcgctgtgcctcagtgtcctcatgcttcacataaggataattatagtacctctgtcacagggttattatgaggaatgaataaattaatatttttaaagtatttagaacagtacctggcacacagtaagtacagtaaataaaatgtgtttaataaataatctgaaaaatatgaatttgattacataaaataaaattactttatttaaagattgtgtctcctgctaggcacggtgcctcacgcctataatcccagcacttcgggaggccaaggctggtggatcacttgagcccaggagttcgagaccagcctaggcaacatggcaaaaaccctctctacagaaaaatagctgggcatggtggtgtgcacctgtggtcccagctacttgggaggctgaggtgggagggtcgcttgagcccaggatgtggaggctgcagtgagctgagatcatgccactgcactccagcctgggcaacagagcaagaccctgccaagagaaaaaaaagactgtgtcttttcacattccaccaatatactgatagcatctgtctctctgcattctcaatagcatcaaatattatyacagkgggggaaaaaccttysataatcttgttggcaaaaatgcgtattyttttgattactagtgagtttatttatttatttttttatttttcgagatggagtcttgcagtgtctcccaggttggattgcagtggcgcaatctcagctcactgcaacctccatctcccgggttcaagcgattctcctgcctcagccttctgagtagctgggaccacaggcgcgtgccaccacacccggctaattttgtatttttagtagagacggggtttcactgtgttggccaggctggtcttgaactcctgacctcatgatcctcccgccttggcctcccaaagtgctgggattacaggtgtgagccactgcgactggccagtgagtttaaatatttaatgagtcttggcactttttccttattgagctctatgagctttttctgtagaagatattaactgttggagcttcatgttctcaggtaccctatcttgagtctatagtgaaccttttgaagttgaaaagagtatttttgcctcaattataaaatctgtattgttccataatcttaattaagctgataaaacttgtttgtgcatctttgtgctcatgtggcaatagatggggttagggcttggtttcagtttgcctagggttaaaggaggttcacatcctttgtgttactgtccagtttccccgcatgcagtcaggttagctctgtgaggagtgcctggtcatctgtaattcagacattaaggaagtacctggtgtgtgctagaaacagaatgcagagttcaggccagggtgaggatttctgccctcaggaagatcacagccttttgacaaaagaggaggcaccatttgcctagtggaaatcagcttcaacaaaaaaatcacctgcttttctctacaagtcccyggaagagatcagtagataaaatccaaatcccacacctgtcctccagagagatgattawtgttagttactgagaagggaaatggatgaaaggcatatgtggcacaggggtcaccgcaggatgcagaggtcttagggggtgtgccgtgaaaggccagctctctgtcagaggctctgctcctttgtcggagcacgtgccctcaagtcagctccactgcagtgtgcgctggaacctgagaagttgctgagtagccgaggagtggctccaaggagcctggaaagcagtcctcctttgaggaccattcaaggtggagtgtgacgttttgtcgattcttgaaagggaattgggaggaaagaggaggaataaagggatgggtgtagggctgtgtgtacagcattttatgtgttttctgatttatcttcacaactttgagacaaactgtcacccccagttcacagatgatgaaacagattcagagtgacagaaggaccaagagagtattcaagattgaacccaaatctgtctctcccaaagccatgctcttccaggtcacacctgtgccttgatctgtctttatgtcaggatctgtgcagtggggcatctgggtttgaatgtttttttaagtactatgattgttggataaattgtcatatgagatagaaataaggccatgctgcaaattttgaaaatgtacagcttgataaatgggggcaaacatgatccagggtaagaaggggcaatttggtgacttcacaaaagataccatttaatgaaaatttactagttttttgtttttctgtctcccaaaacaggacactcctgggtttattgtgaaccgcctcctggttccatacctcatggaagcaatcaggctgtatgaacgaggtatccttctgacccaggccaggagcagcagacctcagctcctggcgccactgtctggaattctcagtgtctctaggaggggtcgggccgtgcacaatggaggaagcagtgtctgttttctagctttgtgagctcagctgcaccctgagccctggtacctttttcactgttttcccagggcctcctggcttccctgtgggcctctgagaaaggtttctggaactcccaccacccccactacagtcccagccagagcaattgcatggccggcccagattgatatcctggatctctgcttttgattaaaaggtttactgcttttaaaaataatcataatgtaaaaatcactaggctaggagatcttgaaagttccttaaggttctaaaacttgtgactgacaggtgattagaaatatgtgacaaggccgatatgtggtaaggacagtttttagtagtctgtccttactgagtgatgtcatgatgtactttttgtaaccttaagaatggtgtaaacagttttcctcagtacttgattgacaaagaatgcttttctctgctgtagaaatatcagatttgggacagggtccaggcctctaaattgatctgcattctcctgcctgctttccctccctggtttctggaaaggtagctctcatgtctgcttcaaaggcaaacaagccttaataggactggataaaaagcaagtgtaattgttttcaattacttcattcataaatgctcactcctgagagtgtcattttttaaacaaaacatttacaccagctcttccagagagatgaaagcacatttgsttcctcaaaatctgctttaaatattaaaacttttctctatggtttatggaagcaattgcctcacttttgctccaagatcaaaccaacagttctggtttatctatcaacaaatatgcctaattacacctcaaagaaagcacagagcattttaccctaccttgaaaggcagktgtatgtctttttttttttttkaacaaaatgtaatgttttagaatgtagcatgtgagagatccaccttttaatggtgttttcctcactgtccatttgatgcattctccaatgcaccaagtatcagatggtaagttgaaagccctcttcttgtctgtggtccctttctgcataggtgcatgccctttagccctcaccatccctggccgcctgtgggctgaagctggaagagcaggacctggcctcaggacatgctcttagcttgctctgggcatgggcttcaacagcctatcattgctggtccctctgcttctttttccaccaccttctcagaatctgcttctgaagttgctgggtgtcctgcctggggtgggtgctgcttccctactgcacactacagtcacaccctaggcctcttaccatgtccccccgcccaccacstgctccctcctctcagccaacacagaggagtgctcagagcatgcccaccgtgccatctccgttcatacagttccaccttgaagcttcaagcatctggaggctccttctcgtctgccacatctgttcatcacttttgattccttcctgtcatgcctgttccacctcttcatcccaccttttccccatcccagtcaggctgccttcatgaggttccttaggtagcagagtaattcacgctactcatgtcttttcctgactggtccccgctactgcacttactgagaaagtatcatattgtccaggaagttgagacaccgcctactgcatctgcccacacaccccctgcacagcctcggcaggagctctgtgactgtttctgaactcatgcaaggagaaattttctgtaccccactgttgatacacctggggttccaggcacatggtttggccaatgctgccttgagtggtgcaggctctctggaaggatgtgtgtgctgttgtaggtcaggcctcctggatgaccgggcctctgccactaacacttcttgccagtccccatgggatctcgtggaggctcacgcccttttgctctgctgtttgtccactcattttggcttccatgttgggccttctttcccagtatcccagctccgtcctcactcttcctattgctcttgttcgttcacactgtgactgaggcctgatgcatgccccagtcactstcactcctgtgagtcagagggacagaggctggataggctgtgtctgacagtggactgctgcccttgccaggcacccactcctaatggccagtgtgggcaggatggtggggccaaatggtcagctcttctcaggagggctctgctggcaacaggcctgggagcaccatgagcctgccccccagtcaccatgtgacatcttgctcacattgtcgcccctgctcaagacaggctcagtggttctctggtttcctgccatctacaagctctgccagagagccttccttctggccaacctctgcccctgctgttatcaccgccaactactcctgccattcccacgttgccccacctgagtgtctgcagagctcccagctggacatcatctctgtcatcacaactcttcttgctttggctctcccttgggtcacttgtcactgtcttccctgtggcatggcaggtgttttctttcccttactatactctcttttctggggcactctggctcctcctcatcttcatatgtcccaaggtgctgtgtagggcgggcacataggcagctgctgatgagtaaaaatgctgtttctgagttgttgctaagtgcctctgttgttcatgctaagaatggttggcaggtggtgctgctgagccagacaaagaagcagatgttgggcaagtcccaggccctcagctgtgctgatctggagttcactgaggaagctttcctttgctgtcttgtctggagttaggggctcttaactggagggaggtaggagagggtgtccaatgaacctcctaaagttgacgcagaatttggggtatatgtgcattttttatggaaagggtgtctgattgtcagaagtacttgattctaaagaagtttaagaattattagtttaaaacatgattccacatctaactgtcacttggcacaccaatctctgtattttgtttctctgtttctgaaagtttgcctcttttgctctgcattattgagaacacgatctttagagttgggctgactttgtagagttatttagatatttttctatcatgtgctgtatcttcatattatttcttgaaataaaacagtcctcaagtgagtctctgaatatggaattacagcgttgcttctagggttaattgtcctgtccttgaatatagatttcattaaatggctttagctgagttgcaaccattatgctgtcagatttctgtcccagggagactgccagtaacaaatgaaccagtacataagcatgttaggttgtgatgagtaattgtggagaagaagatagtaaggggtggcaagagtcttgtcctagtgtcctggccttttctttagtgcagggagttgctttttttatatatgcagggaggagaagaggctgtcagaagtatgacacctgagcagaggcctggaggaagtgagagactgagctccgaagctgtctgagggcagcacctaggcacagggagcatatcccaagcctgaggagcctgtgaggccggcacttccagcattccagggctctaccagcacagaagctgcggggcttcctaatgaaatcctctgagtagaacccacttttaagcttcatagccacaccccaaatatgctgtgttccttcccattcctgcctctgcatgtgctgttctctctacctagaatgcccttcctggtctgctcatctcaggattatcttcaccttccaggacccaggcatgggggtggttttggtgaagccctggcagtgtgagtaaatctctccatctttactcacacagagctgtgtgagtcatgaatcttcaggtcttattatgttgaagtttttggcttacacatctgagttctcccattatgtcatgagtaccttgagtgcttgtctggtttatcttkgtctcattcwacatctctggtgcctgctacataatgaatagaagttgaatgaatgaatgaatgaatgacgctgcctatatgattatttttgtttctttgctttcttatggcctaacactcaaatcatgatttctcaggcgtctctaatcctaattagtgtagttattagtaatgtcaaccataataaataattgtggtgtattttagtcaccttaaaatgccttgaaatcctttggaattactttagtaatttatttgcttttaaaaatatatcttctttatcgatgtttaagtagtttctctctgagtgtcttaacatttttccctctttagctttgatctgattgacttcttaatgctttggaacaaaattctagatagccacctgttgcagactattctacttttctgatttcaaagaaagggaacagattgttctccataaaggcctcttggggccaaaggacatagtaaatttccaagggaaaagcacattgatccttgtcgtagtctactcaacagacttccaaacgtgtggtgattctaactcgggtttgggcttttctttaaaaggtatcttgactaaaaggtttgtgtgaaatgtgatgccaggggaatactccttacttgtaaaacccaaaaaactgggggaaagaatacatacaataactatacatacaaaagcagaaagcttagttttctttttaagaaagttwatttataaatcaaaaatatgctgtagcattaaattatactttaataaatgattccagagttggaaaatcccaatgtatttgaaagtagctgaagtttcaggcatggagacttctgtctccatgaacagggtatcagtactccaaaattcacctcagtggtgcgtagctttgaaaatcttgggccacacactgtggcttacacctgtaatcttagcactttgggaagctgagacgggaggatcacttgaggttgggagtttgagcccagactggccaaatggtgaaaccctatctctactaaaaatataaatattagccttgtgtgggggcgcacacstgtagtctcagccactagggaggctgaggcaggagaatcacttgaacccaggaggcggaggttgcagcgagccaagatcgtgccattgcacttcagcttgggtgacagagcaagactctgtctcaaaaaaaacaaagtcttatgacctctttggcatgtactttagagaggaaatcttacccaagccagaaagtctcagtctaggcattttttttattgtgcaagcatataaaattctagtaattctggggctaatcctgtgatagggagaattcaaggaaaggtggtggtgacccagtgctgccgttttctccttaggtgacgcatccaaagaagacattgacactgctatgaaattaggagccggttaccccatgggccyatttgagcttctagattatgtcggactggatactacgaagttcatcgtggatggtaggaattggaattttttgttgtctttaattgaggtagtttttctgaactgtaaattataatgcctttttaaaaaaagttagcaggggtcttaataaagaccttccaaaatcctgcctcaccaggttgagaattcatgaacagatgtcaggagaaggaagaatgtgactgtctagtgtctctttaacagggtgaccttgaagaaaaaaaaacctttatggattcacaggaagttacaaatatagcacagacaggtcttgtgtgtgtgcccttcacccagtttccaccagtggttatatagccatagtacaatattaaatcccaggaaattgacactggtacactgtgttatcacatcaatagatttgtgtaacctccattgcaagcaagatacacatccattttaaaaaatatatccattgtaatgtaaaagctctgaagacagggtaaaaataataattaaaactggactactgaagttgaatgtagctatctgttcccaagtttcacagaatgctagttgaagaattaaattttgaatcttatgtggatgcaaaataccaatggcaggaatgcagattttttaacgtgtattctgaaagttaactgtgccagtgatgaatccaaccagcaaattaatggcttctgtcagtgtacttgggcctttggccktagtgatttctgagaagacactggataagyaggaggaccatagtagggccaggcttcaggcagcacaggtgggtggcagtgcagcagctttggggctgatgtggctgcaccagcacagccttccttggtgcctctgcagtggtggccggaggggcgccatgcctggggggctctcccacatcagaggcaggcctccagacttgtccttggaaatgccaagatgtaaamataaacccagcacttcatcctgagttctcttccctccgctcaatagggtggcatgaaatggatgcagagaacccattacatcagcccagcccatccttaartaagctggtagcagagaacaagttcggcaagaagactggagaaggattttacaaatacaagtgatgtgcagcttctccggctctgagaagaacacctgagagcgctttccagccagtgccccgartgcctgtgggaatgctctttggtcagacattccctcacacagtacagwttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgccwagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaagctatttctcctcttctttgacctgctgttaatttttaaagtgggagtgacggggagggaatggcaggacaaggcatttgtgtaaaacctgcctggggccgtcgctgccagatttcttaccaggaaagcagtaataagggcacagagaacaatttttaaggaacatctgtttcttctttgccaacaaagtgaagtagtgtaacgtaagcttcttttaatcattggcttaagaaagtgtcttccaagatagaattttggagttggaaagacayyagaaatcctgaggtccaatagcctcattagcagaaassttaagggatgtgcccaaagtcactagatattttgtcacatagcctagactagaactaggttttgataaaattaagtacaaaatagcccatttgaaaatctccgatccaaaatttcagacaggactctccctaaaatgggcatccttgtttggtgttctgggtcataggtctaatagtcaagagattttttttcttcattttatgactgataaaagggagcttattaattttaaaaattttgaatctataacatagtgggaaaataaatacatcggtgcatttgtaccgcacatagaacctgggtaggacacttttaggttattcttataaaatgctgcctaacgaaccaaaggaagcacctgtgaggccacccgcatttccatcgctaaaggttacccttgtggtctgacagctccctgctctctcaggctggctcttgacctttggcatgagccctgggcctaagtgggggcttcacttccttactgtctcaccagagtccccataggatgcaggcccttgtcctggaaatggcagggttctttcttgaccactgaattccaggaaagatgtaactcagcaatgcaactatcagactgccgggatgagaaggtaggagctgcagcagtctttctggctggcattttaaaatacactttaagcctaccaaatagtcaaaaggcctagcctctcaatatccttttatcgttttcaaaaaatattttccatgcaccgtgtttgggaccaggaaggaattttgaacatccttcctttagacatgggaggtgagggagtagctttttctttcccaactccatgtctctgcgttctcaggtgaacgtagctgcttgccacggagagctcttggggcggggggagggaaggtcatgtcagtcaggttctctgcttccaaatataggcccgctgctgctgtttgcttcagtctgtggttaagaactgagcctcagtgagagccccaggtgccttgcatcatcctccactgtgttttggcagcacttgttcaagagggagggtgggtcctggcagtgctgctgggcctggtgtcactgctcttggttctcctcacctccccaaacttgcctcctaaccgtcatgaatcttttatgacacttgaaagtaaagaccaagttttaggtcaagaggatactttttttttttttttgagatggagtcttgctctgtcgcccagtctggagtgcagtgttacaatcttggctcactgcaacctccacctgccaggttcaagcaattctcctgcctcagcctcccgagtaggtgggactacaggcgtgtgccatcatgcctggctaattttttatagttttaatagagacggggtttcaccattgctggccagtttggtcttgaactcctgacctcatgatttgcctgcctcagcctcccaaagtgctgggattacaggcgtgagccaccgtacttggccactttttttcctctctcctatgcttccccttagtgatatttttatttatttatttgttttttgagacggagtctcgctctgtcgcctaggctgaagtgcagtggcgcaatctcagctcactgcaacctccgcctcctgagttcaagcgattctcctgcctcagcctcccgagtagctgagattacaggcatacatcaccacgcccagctaatttttatatttttagtagagacggggtttcaccacgttggtcaggctggtctcaaactcctgacctcgtgacccacccacctcagcctcctgaagtgctgggattacaggcgtgggctactgcacccggccagtgatatttttatttacctataatacaagtgaaagtttgagattaagaagaaaaccaggcaacttatgagatgacttgctgaaaaagatggtgagcctctgatagccatcacctagacttcaattctgtttagtaaaatggagttctctgaaggatcgttttaactcaagatatctttgtaaaatgaaaatcatggccctttcatgttcttaagattcactgttaatagtagtttttctggggaaaatggttaactttttctgacatcaattgtaaagcgtatttccactttgggaacttcaatgacacagcgtgggggtaggtggaaccatgtcttggaactcggaaactactatgaacaaatccggtgttagaaaatactctcagctgggtgcagtggctcatgcctgtaatcccagcactttgggaggccgaggggggcagatcatgaggtcaggagtttgagaccagcctggtcaacatagtgaaaccctgtctctactgaaaatacaaaaaattagccaggcgttgtggcgggcacctgtaatcccagctactcagaaggctgaggcaggagaatcgcttgaacccaggaggcagaggttgcagtgagctgagatggcaccatggcactccagcctggacaacagagcaagactctgtctcaaaaataagaaaaaaaaaaaaaaaaaaaaagaaaatgactctccactgggttccgttaatagtaagtgttttgactaacacatcagctttcagaaacccatttgagattcaactagtcatcattggagaggttacagccactatgttagtcacagcttatacaacaacatacactaattatgctttctttgtgagttataccgttcacatatttgaaacaagcttttgtcttgtccccaccttgattttaatccctttaacatttcaacctaagtaactcattaagtctaccaaaagtataaggtgtggctataattttatgagactaattttcttataaacaggcattgatgctacataaatagtaatcgaaaaaatgctttgaacaatgaaatcatggctgtgctttcagtactatactttgaaagaatccatttggctgtgtaaattctattttttaaattggtctcactgtttcatcatcacagttttaatgtctattttagcattttttttcttgctaccatttgacatggcataacagactttaactcctgaaagacagagaaccctgtcattgatactgatgttattcaatgttttagtgaaaatcaccaactgtagttgctgctacaggattaaccagcacaactacttgacagcatgggctttgcaattaaaccaacttgggttctagttctcagttccactgcctttacctgtgtaacctagagaagttatttgttttctgggtatatctggtagaatgggcataaggatggaacctatgccatagggttgctggggaccaagcgaagtaggtttcaggtgttgagcacactgcctagcatctataggccaattgtgaaggaagccccagtaacctatgttcatcgggttacagatgacagccctgaacatgtgacagcagcagggagtaggcttaagattcagagcaggcctgagtcttggaaaagtgagtctcagaaattaagcagttgggctacctggcaaaaagaccagtgctggggctctgcactccaccccacagctcctctggaaggtcttcccacactttcagagaggtgctggtcggggctagtcagaaaggggttgctgtcactcaggtaggctacatgttatgtgtgagcagtagactggatgatttaagaccccagacaaacagcaggtgtgtagaagagacgttcccaagattctcctaacacatggtaattagagaagtggtggcatatgaacaggagcataatgatgcttcattctatcataatgtaattttatttttatttatttatttatttatttatttatttattttgttgagacagagtcttgctctgtaacccaggctggagtacagtggcacgatctcggctcactgcaacctctgcctcccaggttcaagcgattctcctgcctcagcctccctagtagctgggattataggcactcactagcacacctagctaattttttcatttttagtagagacggggtttcatcatgttggccaggctggtctcaaactcctgacctcaagtgatccacctgccttggcctcccaaagtgctaggattatagtggccagtagttttaaatgacattaggttactcctaaagatttattcagaacaaaattgtgggaggccctagtaggtctattaattatttagccaagggagcaataggatggcccctagggtttaaacaaattcaagctgctcttgattcatcatcaaggaggggagaggataccatagctaacttgaacatcagtttgtcaagctgggtggggtggtgcacacctgtaataccagcttcttgggaggctgaggtggaggattgtgtgagcccaggagattgagtccagcctgggcaacatagcgagaccccatctcctaaaataaattagtctgtcgaggtagaatccctttggatgacagagtggcaatggagcccttcatgatgtcaataaacttcatggagacacctcagtttcacttctacagatgcagttactggaatattctatgagaaaatgtagtctgttctcaggcaagcaggtattagaagagaaaacctcctggaataagaactctacccttgctacctgctcttgaacatccacttcaccactcagattgcaggtgtagaagacaggaaattgggatgcctccaaaactagtagggagtgaggatggcatttttgaaactgaatttcctacttgaggcagtttgagtggtttccaactgcctcattctatgtggaggttttggtatatgctgctgggaaggtagttttctggagccctttagcgtcaatattcaagttgcagggaagggtgggagtggagagaaatctatccttccaccacaccaatttgtagtaggaccaaggagggtgaaatggaaaagctctgtccaacccgaaaatctccatatctaggcagagactttatttttatttatttatttatttttgttattattatactttaagttttagggtatatgtgcacaatgtgctggttagttacatatgtatacatgtgacatcctggtgcgctgcacccactaactcgtcatctagcattaggtatatctcccagtgctatccctccccccwccccccaccccacaacagtccccagagtgtgatgttccccttcttgtgtccctgtgttctcattgttcaattcccacctatgagtgagaatatgcggtgcttggttttttgttcttgtgatagtttactgagaatgatgatttccaatttcatccatgtccctacaaaggacatgaactcatcattttttatggctgcatagtattccttggtctatatgtgccacattttcttaatccagtctatcattgttggacatttgggttggttccaagtctttgctattgtgaatagtgccgcaatcaacatacgtgtgcatgtgtctttatagcagcatgatttatagtcctttgggtatatacccagtaatgggatggctgggtccaatggtatttctagttctagatccctgaggaatcgccacactgacttccacaatggttgaactagattacagtcccaccaacagtgtaaaagtgttcctattgctccacatcctctccagcacctgttgtttcctgactttttaatgattgccattctaactggtgtgagatgatatctcattgtggttttg

SEQ ID NO: 17640 - DNA, 22157 bp, Homo sapiens
  misc_feature (1)...(22157): n = A,T,C or G, or insertion/deletion polymorphism (see Tables 1-2)
tttaagtactcaagaactatatatacttttatgtggctgaacattagggcctctatttactggtaagaacttacagaaaaaggagacattataaagatctcccagagaaatatttaagttttttctgggaatgaaggagcatggtgactactaatctagaggctgggggaagagctgtctctggaaatatcccaggcatcactacggaaccagaagtagagacaagcagaggtgtgttggaaagagtgacatgtgtaggttagctcctggtagtttaatcaccagtggtccaactgaggcgatgcgtggatgaggagattgacagaaggaaggaacctgaaaatatagatcaggaaacaaagcttcattgtacagcatatccactgcaggcagtttggtttttgttccagtcttctgtcttcaagggctattttcatagagcatgaggagccatgggactggtgaggtctgggcttctgtgccaagatcacccacattcctcatatcccctcaaatgtcccaaatgtcctgtatcacctgattttctatcttcctgctaaagcttttcccatactcctaccccttcactctccatcatcctccaattcttacccgacttccaccctggagtttcaccatggccacttgcttgtgggaggcactgtctgaacacagcccctgaatgctactgatttggtgctttcttcagattctctagactgagattttaaagagataactttgtgccaagagaaaggacctagtttatatgtgccacaaaaaattgttatatatagctggttacctagaagttgatataaaagaaatatgtaagtggcttcacaaagattttgaaaaatttagggataattgcttgataaattttaattaaaagaaaacaatattctgggagcagcatttctagttatattaccattggcattaaggaggccacagaacctttcagaatatacagtgattcttgattcctgaagtaaatgcagggtaaggtcttggatggtccttctggtgacagggtggctcctatgttcacattcaattccactgaccaagcacagattccaagagatgctgactagggaagatgatttctcccttgattttcacaaagaaggagtccacgactttttcttctgccctgaaggaagagagaatgtcccttgaagtgagtctccctagtgtaaccctgaccatccctactaatggcagtggctttttagcccatttacccacatggggtaaatgctctaattgctctgcctccacagaggctgggcaggcgattcaggtgagacactcggaataaggatgcttgacctagtttctttcttctctggcctttttctgcctgaatgccctgaataatgcagcagggatagggccagggtagtcaactgtagagaaggctgggccaggcagacacaactggcagaagcccaaagcaaaacctttccagtgaggttttagccaatcagaaaaaggctctaaagtgacacttgttgctagctgaaaagtctgtgcaaagaggcctgtgagactggggaatccccaggtatgacgcagcctttgcctcagaataaacctgcgggaagtttttcccttagacaggaaggaaaggatggattagaggcctctattctgaggcgcactgatgtgggggctgaggaaggacattgagggcaccttcaggtctctctgcctactcttccttgccccaactccattccaggtgtgcgtttggttcctcctttatgcgtccatcacagcagtggagaccctccttagactgggtttaccctgatcctgagtacaccactgctgctggaygcccagtggcaactttcccagtctcaggtgctctagaattatgcactgaataatacagaatattgaagtggctcaacgctttcatgtgccactattgcaaacctcttgctgttgcctcttccctgcttctttttatctgataaacttatattctgattttagattgtattctctactttaaaagcagaacctaacattttgggaaaagaaagagagaaagggagagaagaagagaagtggagatatttattgtcttggttgaggtcagaagtaatgtttgccaggcgttgttctaattgctttataaccattagtactgcccctagtcactgccaagaggagcctgataagttatgttcatttataaaaacacattgatgtagatatgtccatgaggaactgttaaaaaaatagaattgaaaaaaaacacattgatacctctgccatttgggatttgatgtttaggcctggcacagtacactctgtgactctaaacactttctccatcattagtactattcaggacccaggaaatgcttctccacaggttttgtgctctctcttcaaaacgaaacatgactgcatccgaatactgtaaaattctgtgtattgtgcctttgctgatatcagatgcatcatttcatggttcagggaggatttaaacagctgaagaacttaaaaaagaaatgtcaacttaattaacttttcaaatactttcactagaagagcataaatacaatatgttcttgcataatgaagaatcatttaccagcaggggtgggtatcaattttttttttttggcttgttttcttgttccacatattaacctgatagttacacataacagttgaggagacttttgtaatattaaacaagacaaattaatcttaaatttgtacatgtgaagatctagatgtaaaatgcatgaaacatgacccacattttataaagagaagcctggggcaaaaataaattcagtaatttgttgactcttctaaagcacattagtggtggaactgcaacttaccattatttccttctaagaactttgctcttctccccaggacttaaggctcttcagcgtgtctaagacaacagcagtaaaaatttctgtgacagcaattttctctcccctgaaatatgatccccacctaattnnnnnnnnnnnnnnnnnnnntaatgcagcagggatagggccagggtagataactgtagagaaggctgggtcaggcagacacagctggcagaagcccaaagcaaaacctttccagtgaggttttagccaatcagaaaaaggctctgaagtgacaattgttgctagctgaaaagtctgtgcaaagaggcctgtgagactggggaatccccaggtctgatgcagcctttgcctcagaataaacctgcgggaagtttttcccttaaacaggaaggataggatgcattagaggcctctatcctgagggacactgatgtgggggctgaggacggacattgagggcaccttcatgtctctctgcctattattccttgtgccaactccattccaggtgtgcgtatggttcctcctttatgcgttcatcacagcagtggagaccctccttagactgggtttaccctgaccctgagtacaccactgctgctggatgcccagtggcaactttcccagtctcaggtgctctagaattatgcattgaataatacagaatattggagtggctcaacgctttcatgtgccactattgcaaacctcttgctgttgcctcttgcctgcttctttttacctggtaaacttatattctgattttagattgtattctctactttaaaagcagaacctaaaatttcgggaagagaaagagagaaagggagagaagaagagaggtggagatatttattgtcttggttgaggtcagaagtaatgtttgccagtctgtaggggccagccctacagggtctgtgggtctttctccctgtgtgcggagacgagggatcgtagaaataaagacacaagacaaagagatagaagaaaagacagctgggcccgggggaccactaccaccaagaggcggagactgttagtggccccgaatgccaggctgcgctattatatattggatacaagacaagggggcagggtaaggagtgtgagccatctccaatgataggtaaggtcacgtgggtcatgtgtccactggacagggggcccttccctgtctagcagccgaggcggagagagagaggagacagcttacgttattatttctgcatttcagagacttttagtactttcactaattctgctactgctatctagaaggcagagccaggtgtacagggtggaacatgaaagcggaccaggaacgtgaccgctgaagcatagcatcacagggagactgttaggcctccggataacggcgggcgggcctgactgatgtcaggccctccacaagaggtggtggagcagaggcttctctaactccccccggggaaagggagactccctttcccggtctgctaagtaacgggtgctttttctaggtactgatgctaccgctagaccaaggtccgctaggcaacgggcgtcttcccaggtgctggcgttaccgctagaccaagtagccctctagtggccctgtctgggcatcacagaaggctcacacttgtcttctggtcacttctcaccatatcccttcagctcctatctctgtatggcctggtttttcctagattatgattgtagagcgaagattattataatattggaatgaagagtaattgctacaaactaatgattaatgatattcatatataatcatatatatgatctatatctagtataactattcttattttatatattttctttattatactggaacagctcgtgccctcggtctgttgcctcggcacctgggtggcttgctgcccacaccaggcattgttctaattgctttataaccattagtactgcccctagtcactggcaagaggaacctgatttcgtttatttataaaaacacattgatgtggatatgtccataaggaactgttaaataaatttttaaaaatggaaaaaaaaccacattgatacctctgccatttgggatttgatatttagggctggcacagtacaatctgtgactaaacattttctccatcattaatactattcaggacctaggaaatgcttctctacagcttttgctctctctcttcaaaactaaacatgactgtgtctgaatactgtaaaggtttgtgtactgtgcctttgctgatatcagatgcacccatttcatggttcagggacgatttaaacagctgaagaacttaaaacagaaatgtcaacttaataaacttttcaaatacttttactcgaagagcataaatacaatatattcttgcataatgaagaatcatttaccagcagaggtgggtatcaattttttttggcttgtyttcttgttccacatattaatctgatagttacacataacagttgaggagccttttgtaatattaaacaagtcatattaatcttaaatttgtatatgtgaagatctagctgtaaaatgcatgaaacatgacccatattttacaaagagaatcctggggcaaaaataaattcagttatttgttgactctcctaaagcacattagtggtggaactgcaactcaccattatttccttctaagaactttgctcttctcaccaaaacttaaggctcctcagggtgtgtctaagacaacagcagtaaaaatgtctatgacagcaattttctctcccctgaaatatgatccccacttaatttgccctactgaaagaatcccaagtataaaaacaaccagtttttaatcaatattacaaagatgtttactgttgaatcgcattttttttggcttcttaaaatcccttaggcattcaatcttcagctcttctataattgagaggaaattttcacctcaaatgttcatccagtgcaatttgaagacgtcacagtgccagggactggattgagaaccttcacaaaaaaaaatctgcccagagacagattaggtccttcagctccagtgctgattggttcctttccaagggaccatccaatcctgccacgcatggaaacatccacaggtttttattctttctgccaggtacatcagatccatcaggtccragctgwgttgactaccactacttttcccttcgtctcarttatgtcttggaaraagkctttgcggatcccyggagrccttcgggyagcaactgtsaccttgatgctggcgatgctgagcaccccrgtggctgagggcagagactctcccggtaagtgcagggcmactgctctccagagccgcyactctgggaacaggctctccttgggctggggtagggggatggtgatctccatgatctcrgacacaatctttatcaacatttcctctctttggggaaagagaacgatgttgcattcccatttatcttttagtgatgaggtgagcacagtcggatccccatcctacagrcttaagcctggaagagaaggagagaggagaggaaagaggagacaaagtgtacatttactaccagtgacaggacaaagtgagcatggggttatttttgaagataygaatttctccagagacacagcaggatttgtcatttaggcgtgccccaagactttgcctggactaaatattatgggatcctgcattgggaaatgtaaggcagcaatggtgtctgtagtctccgtatttgaggaaaagttgtctgtattcctgactgactggagcgtttgtggaggcaaaatcttggtactgaaggaagctgactggatgaccacagacagggagtcttcaggtttcactgatttatgggcaaatggtgacttgagtgggattcagagacccgagttggtggactgaatttagcagaaaggaggatgtaaagaagggaaataacatatattgtgaaaccactcatttcagacacagcacaatactttacataaattctctctcactccttctaacatcctgtgtgtagatatcatgattttcttttacacaattatacttgtgatatggatattctgttacatacctgccctagctggtgactgccacagcttaattggaatctagtttatcaaattcaaaagcttgtgctctttccatgaataaatgtttctttctaggactcggaggtgtaggtcctttctaacataaaagtgagtgaacctcacatggcattcggaagggtaaatccaggcatgggaagggaggtattttaccgagggaccaagagaatacgcatatcagaacgaggacaggcttaatttctggacccgtctcatcattcccttgaactcccaggtttatgtggataattttatctctgaggtttccaggagctcaatggaaaatgggatttcatgcgagagcgccctgattccctctaagtgcagaggtctatgtaaaatcagcccgactgcctcttccctcggttcacaggctccggcagggacagggctttccgccctttcctgcctgcaggaaggcggattccggaagcccccagagagggcgggcagggctgggcagggctgggcagagccgccgggcggatcacaagtctggagcgccaggcacgggcgggcgggaactggaggtcgcgcgggcggttccacagctccgggccgggtcagggcggcggctgcgggggcggccgggctggggccgggccggggcctgactgaccggccggtgattccccgcagaggatttcgtgttccagtttaagggcatgtgctacttcaccaacgggaccgagcgcgtgcgkgktgtgaccagatacatctataaccgagaggagtacgyrcgcttcgacagcgacgtggrggtgtaycgsgcrgtgacgccgcwggggcsgcctghygccgagtactggaayagccagaaggaagtcctggagaggacccgggcgtmggtggacacggtgtgcagacacaactaccagttggagctccgcacgaccttgcagcggcgaggtgagcgtcgtcgcccgtctgcgaggcccatccttggcaggggcccagagtctctgcgccaggaggggcgaagggggcgcggcctctggaacctgagccttgttcgttccaccccggctgacaggaggcggcggtgggggtgctgggggctggtgcatcggaggggcagggacctagggcagagcagggggacaggcagagttggtcaagctgcctagtttcgccccatcctccccgtccgtcggcctcgccctctgctctgcacgttcttgcctcgtgccttatgcgtttgcctcctcgtgccttacctttactaagcagttctctctgcccccaatttccgccctcttcccctgcccgcccgcccggctagcactgccgcacccggcaaggtccacctacacagctcatgcagtgggaagcttcagacttggcctgatggagttagggctgccccacaactgcgcgcagggcatccagcaattacagttgtcaaataagatattttgayttttgacttcaaattattattcatcgtaattctgttttcttaaatggctctcattcatggcggagctctttgagatgagagtgttttaatcattgcatgcctggtatctgacacattgactggcatgtggtatgagctcaatgatcttctgttaaattaatgaataaatgtgctcagctgccaatccacttaggctcaagggaaagcagaggataaatagagccttaaaaatggacttttattaattattttctgtcattttgcttaattctttaaagtaaactcttattgacttgratcttaatagagtttgtgaatacaaagtctgaggaaaaaagtgtttgctaaaaataaaaacaacacttgaatgatgtttgtaaggcagttttaatttcttagaaaagctgaacaaatggcacaatgcaaagagcagaagttttggaataaatagattgaagcaattaaattattggataaaaatagtttcaggttgcttttggcttaggttctcccctccccccatcactatccacttcaggaataaacattctgaaagtcaattttacccatttagtgagcacttatttctagacagttaccttatcaaataccgtctatgttacgtcatttaatctcacagttgcctgtgcattagagattagcatcaccactttatatatcctaatattagtacatgacaaacactttaagtaatcagcccacaagtactcaccaagaccttaagcctcccaaagtacacaatattctttatgttcttcactacacatctatagagtcaaagggacataaagccttgttaaagcnnnnnnnnnnnnnnnnnnnntgtgatatggatattctgttacataacctgcccgggctggtgactgccacagtttaatgggaatctagtttatcaaattcaaaagcttgtgctctttcggtgaataaatgtttctttctaggactcagagatctaggactcccttctttctaacacagaagtgagtgaacctcacagggcacttgggagggtaaatccaggcatgggaaggaaggtattttacccagggaccaagagaataggcgtatcggaagaggacaggtttaattcctggacctgtctcgtcattcccttgaactgtcaggtttatgtggataactttatctctgaggtacccaggagctccatggaaaatgagatttcatgcgagaacgccctgatccctctaagtgcagaggtccatgtaaaatcagcccgactgcctcttcacttggttcacaggccgagacagggacagggctttcctccctttcctgcctgtaggaaggcggattcccgaagacccccgagagggcgggcagggctgggcagagccgccgggaggatcccaggtctgcagcgcgaggcacgggccggcgggaacttgtggtcgcgcgggctgttccacasstccgggccgggtcagggtggcggctgcgggggcggacgggctgggccgcactgactggccggtgattcctcgcagaggatttcgtgtaccagtttaagggcatgtgctacttcaccaacgggacagagcgcgtgcgtcktgtragcagaygcatctataaccgagaagagatcgtgcgcttcgacagcgacgtgggggagttycgggcggtgacgctgctggggctgcctghcgccgagtactggaacagccagaaggacatcctggagrggaaacgggcggcggtggacagggtgtgcagacacaactaccagttggagctccgcacgaccttgcagcggcgaggtgagcggcgtcgcccctctgcgaggcccacccttggccccaagtctctgcgccaggaggggcgaagggtcgtggcctctggaacctgagccccgtttgttccaccccagaggacaggaggcagcggcgagagtggtgggggcaggkkcatcggaggtgcggggacctagggcagagcagggggacaggcagagttggccaggctgcctagtgtcgccccagcctacccgttcgtcggccttgtcctctgctctgcatgttcttgcctcgtgccttatgcatttgcctccttttgccttacctttgctaagcagctctctctgctcagaatgcccgccctcttcccctgcccgcccgcccgccccactagcactgccccacccagcaaggcccacgtgcacagctcttgcagcaggaagcttcaggcttagcctggtggagttagggctgttccacaactgcgcgcaggacattcagcaattacagttgtgaaataagatattttaacttttggcttcaaatcattattcatcgtaattctgttttcttaaatggctctcattcatggcagagatctttgaggtgagggtgttttaatcattgcatgcctagtacctgacacattgactggtatgtggtgtgagctcaatgatcttctgttaaattaatgaataaatgtactcagctgcccatccacttaggctcaagaaaaaaaaagaggtaaacagagccttaaaaatggactttattaattattttctataattttgcttaatgctttaaagtaaactcttattgacttggatcttaatagagtttgtgaatacaaaatctgaggaaaaaagtttttgctaaaaataaaaacaacgcttgaaagatattgtaaggcagtttaaatttcttttcttttcttttttttttttttttgagacggattctcactctgtcgcccaggccggagtgcagtggcgcgatctcggctcactgcaagctccgcctcccgggttcacgccattctcctgcctcagcctcctgagtaggtgggattacaggcgcgtgccaccacgcccggctaatttttttgtatttttagtagaggcggggtttcaccgtgttagccaggatggtctggatctcctgacctcatgatccgcccgcctcggcctcccaaagtgctgggattacaggtgtgagccacagtgcccggccggcacttttaatttcttagaaaagctgaacaaatggcacaatgcaaagagcaaaagttttggaataaatagattgaagccattaaattattggataaaaatagtttcgggttgcttttggcctaggttctcccctccccccatgactatccacttcaggaataaacattctgaaagtcaattttacccatttagtgagcatttatttctagacagttgccttatcaaataccatctatgttacgtcatttaatctcacagttacttgtgcatcagagattagcatcaccactttatatattggtacatgataaacactttattggtcatggatggggagatggtcactgtaggctaatattggtacatgataaacactttaagtaatcagcccataattgctcaccaagaccttaagcctcccaaagtacacaacattctttgtgttcttcactacacatccatagagtctaagggacgtaaagcctcgttaaagccagttttgaccagaagcagcaatgagtctattcctgtgtgttttccatgttaatgggacaaaatgatactttcaaggcattgaaaattcatgattaatcaatccctagtctgaccccagtgttatctatgcaggtttgcaaaacctttagttyacttaatactcccttgccttcttttgattcacatcctaatgccagcaaatacttaygtttttgctatttcagttccatttccataaaatttattttatcatcttttctcataaatttatgccctctatttttactcccaatctgttyaagatgaacaaatcttataaggccacatagctgactgttatttctgttggactccaggaaggagaacctaaagaaaagttcaagtccaagcagaaaccgtgatttcttccagatgatggctcatgagtgccatttaattggggtgccacctggtgacctcagcaaatcccagctatatttatgtgttcacattacaggatcattaacccagaccgaccactgcacagatctcagaatattttctatggagaacatacataataatgcctgatttcagaagaagaaagtaattctcaatagcaaggggatggagtagggtagacagctgtaattaaactcacttgtgtgataaaaagaaattaaggraaaaagaaaatgagagaacatattactaaataaagaaagcatacattaaatatttactatagtttcacactaagagaataaaggaaatgcaataaagtggcctgaaaggtaaaggatgagatgtgtaaaggggtgtagtatttttmmtatgagcagcaatctgagaagataaaggaatcgagttacgggcaaacatgatgtttgatcagtgttatttgttttcaaggcctgcctaaatttttttcaaatattacaaacttttgaaataacattctttttgttttttgctgtctgttactaggttgcacatttyataaaggcagggaccatggtatgttgtttgtctttggattctcagtgattgttatatttatatttgttgaaggaaccttaatccaagacttggactccaagtatctttccactctggttccaaggagggaccttcctcacagcaggcatgctgtgtggtctcacatctcactcctatatctttccctgtctgttactgccctcagtggagcccacagtgaccatctccccatccaggacagaggccctcaaccaccacaacctgctgrtctgctcrgtgacagatttctatccagsccagatcaaagtccggtggtttcggaatgrycaggaggagacarcyggcgttgtgtccaccccccttattaggaayggtgactggacyttccagatcctggtgatgctggaaatgactccccagcgtggagacgtctacacctgccacgtggagcaccccagcctccagarccccatcaycgtggagtggcgtaaggrgatattgagtttctgttaytrtgggccccacaagacaaaggacagagctccttctgacccatyccttcccatctcttatccctgatgtcactgctgagctgggaatcacaggagactagagcacctctagttccatggcgagtgcatcagaagaatcctgatctcatcacctttccagatgctagggaaattactctacatactgttgctctggatcccagtcctgattgctctgaggaactgattattagggctggtgactgggatcttagggtctaagtttatggatgagttcctgaggagtggagatctgcttccccactctgtcacctactcactgtatccaaggacctattggctggcctttccctcccttaggggtggtctgaatggagaactaggttcctttgatgccttcacctcctgcatctcagactggacttcagctcctcatcagggaaactatggggtatggggacaaacactgacactcaggctctgcttctcaggggctcaatctgaatctgcccagagcaagatgctgagtggcattggaggcttcgtgctggggctgatcttcctcgggctgggccttatcatccatcacaggagtcagaaaggtgaggaaccccaggggaaaaggggaagatggcctgtgacccagaccctctgttcagagaggtcctgtctctagatgtagctctttcctcctgaccctgagaggaagaaagctgagctggaagtggaaggagacaggacaaggttggaggaggcattggaatctgattttactagytgaarggtagccctgtcacagagctgactgatagagcttattccagggcrtccttaccattcatcattgtctcactggctcctttccaaaaacttcctccattaagagggtcagagcctcggcctccttrccttctagtgacaatttccttyattttaggggatttyaaattagggtgctyaaggactygaagaacatgaatgggaagagaatataactctaattaagtcacatgtgtcattttcctttggggtgagagagtgrctgttcatgtaatgagacctttctctgcataacttccttttgtaagacctcaagggcctccaccagcaggtaatatttcagccgtgatccagtgtggggagggcacaggtgtaagagggaagagcatgagctgagtgtacctgacagtagtggtctctgttcatggtatatttgctgctatgaggatcaagacttaggggtgaagtttgccagtttctaggaatctccagaggttgttccccagaaccaagccttaactttggtggtatcttcctgtkaaatgtggagccagaaccacggcttaaatgttagacactaggatgatgcccactttgtgccacatgatggtggctactgcctgtaggcattttccagtgactgaaagaggctgctagtggtagggatgaggtatcatccaatttcctaaaaagattgaacccttcatattcaccagaagagtaacagctgttcccccacctcccacacatctgcatcaagctgaagttctgtgtcttcatgagctgatttcwcctttgcacagatcttgggggaggtgatgayaatacactctggacctcagctttgtctgtctgaagctgcaggaggcccctgaggggtggggragatggcaggcccaccagcgtaccctgtgctgatcatccctcttctctcttctycagggctcctgcactgactcctgagactattttaactgggattggttatcactyttctgtraygcctgcttrtscctgcccagaattcccagctgtctgtgtcagcytgtccccctgagatcagagtcctacagtggctgtcacgcagccaccaggtcatctcctttcatccccaccttgaggcggatggctgtgaccctacttcctgcactkacccacagccyctgcctgtgcacrgccagctgcrtctactsaggccccaaggggtttctgtttctrttctytcctcagactgctcaagagaagcacatgaaaacyattacctgactttagagcttttttacataattaaacatgatcctgagttatctgtattctsaacttccttaattgagcagaggcaggaaatcactgcagaatgaaggaacataccttgaggtgacccagccaacctgtgcccagaaggagggttgtaccttgaaaagacactgaaagaatttkgggtgcaaagtcakggtgggcagaggaggtagaaratcaactcagttgtygcatcattcatggttctttcatattgatgytcagtgcagtggcctgagaatatcccagcctctcttctggtttggtgagtgctatataagtaarcatggtggaattgtttgggggcagatatagtgacccttggtcactggtgtttcaaacattctggcaagtcacatcaatcaagaataatttttacttttaagaaagcataaccagcaataaaagtattatttttgattctaaatgatagaaacccaaatatattttgttcatggtgcaaaggaagcctagagtcaagttgatttcagaagtgactagttccagatacacaatgagatcttcacctctctttctgttrtatctctatctgtgaatctgcctctctttctgtgtctctttgtccctgtatagttctttctgcgtgtctctctgcatctttgtctctgcccccttgttgtgtctttcactacattgttgcctttctatttttctaatccatggtcactgtttatctgcattttttctatctccgtgtttctttttgcatctatttttctgcatttctcttccttatcacttcatatcttatctcatctctctctcttgctgtgtgtgtgtgtgtgtgtctgtttgtctgtctctgttaatatatgtttctagaatgtctaccagagttttaacaactttaggaaagattctgattggccaagcctgggtaacatgcacacctctcaaacacattgtcctgtgcacgggatgctgacagccagcattgtgtccatcgctcttattaggaaggaggactggattttccagatccttgtggtcctggaaatgacttccagtgtgcagatgtctacaccagccatgtggagcacctcagcctccacagcctcctcacagtggaggggtataaggggcagtttgtttcttgtggagcccacaggacaaatggcagagctccctctggttctagggtccctcattgggggtgcctgttcatagtcattccactccttgtctgagctccctttgtcatagacgttgtaacctgttgattcctgatgacactcttttcccggttatgagggaggtcactacacactgtggcccctttgatgtgggcccagccctgaagctggtctacatctcagtctctgagtttcgtcatgaagccagagtctgggagcttctgcgaggttatgtaaggccatgaccctgaaagcagacatcccatcttcctttctccctcacccacacactgggcgtgaggagtctttggcaggctcttccttcttatggatgaggtcagagtggagaactaggtctccttgggaccttcatctcctgtactccaggctgtcatgcaggtcctcagacagggacactggcgcacaaagaggcaccaacacttgagattctgctccccagggttatagtctgaattttccccaagcaaaattctgaatggagtcaaaagttttgtgccgattttgtcctcttcctcagggtgggcactgtcattcaccatagggatcaaaagggagtaacacttttggggaaatggggaaggcatgtgctgggttgtccagcgtgtcctcagtctctgtgtgtagctcctggcttttgrccctgcaaagggaagaggcagggctagggattgaacaagactcaaagtttaggggaacatcgagatctgatttttctagttgaagcataagccctataattggggtgggtgatagattatattctaggacattcttacagttcaacattgtcacactgagcacacatgctggaagattctttattaacgagagggtcaaaatcgtcttctctttcttccattgacagtttcatagaaacaactatgttttgcacccagatttcattggatagtataatctttaatggataattaattaaaataataagtacatcgtctataaataagtttgctaacacaaagaactgagtcttactcagcatataacttggaggaaagcgtgtgggtgttctagaggacaacctaccagtcttgagcatttgtccttaccttagataataacagtataacttttggagacagtgatgctcgccagtattccaaagctcctgtacatttctcagtcttttctgctgttaggttggggacatttgactaacagtaaccaatggaacttgcaagtaggtgcatggtggtgtatgagatgctggaaactccataatctgagtcatttgaataactgtggaattaagtctccttattgagttaagccactgagatctactttttactgtgggttaagatctactttttactgtgggttaagatcttattgcaacataaccttgcccttcctgattatcatgaaatgtttaacttaaggaagaagagagtccttaagttaatagggtgaatcaactgagttaatggaagttaagagatgactttttaaaacaaattaaaaaaataaaaaaacagaaaactttatttgaacaagaaaaagttaaggatgttacacttcaaaagaattttgaactcattaattatttttaattgataaatcactgtggatttacagggtactgtgtgatttttttgatacatgtgattaaaccaggctaattaacatatccatcacttcactttttggtggtatgaatatttaaaatctctctctgcaattttcaaatatacaatacagttggccctctatatctgtgggtttcacatcctctcattcattcaactgtgggttgaaaatatttagaaaaaaatgaaaactaacaatataactataaaaataattccgattcaaaaacaataaagcataacaactattttcatagcatttacattacattgggtattctaagtataatctggagatgatttaaagcatacaggaggataggcttagtttatatgcaaaaactaagacatttttaataagggacctgagcattctcagattttggtatacagagagggtactggaacaaatccctcgtgggtgccgagggacgactgtacattattattaaccgtagtcaccatgctgtacaatcgatcttcagtacttattcctcctgcctaactgaaactttgtactttttttctgaaacggggtctaggtctggctggggtgcagtggtacgatcacagctcactgcagccttcacttcccgggctcaatccatcctcccacctcagtctctggagtagccgggactactggcatgtgtgaccatgcctggctagtttttgtattttttgtaaagatagggtttcaccatgctgcccagctggtcttgaactcctgtgctcaaccaatctacctgcctcagcctcccaaagtggtgggattataggcatgagccaccacaccctgcccttctttgtaccttttgaccaacatcttctcattcctccttgtccccctccctgctacccccactccccgacctgccatgattttgacttttttagattccacaggtaagtgaggtcatgcagtatttgtctttctgtgcctggcttatttcacttaacataatgtcttccaggttcatccatgttgtaaaaaatgtaaaagatttccttcttttacaaggctgaatagtattccattgtgtatatggaccacagtttccttatacactcatctgctgattgagacttaggttgttaacatctcctggccattgtgagtagtgctgcgatgaacatgggagtacagatacctctttgatacactgatttcattttctttgcagatgtacccagcagtggaattgctggatgatgtggtagttctatttttattttttaaatagatgatgaattaaaaaaaaaacatttatttgggtggggcgccgtggctcacgcctgtaatcccagtactttggaaggccgaggtgggcggatcactaggtcaggagttcaagacaaacctagccaacatagtgaaaccccgtctctactaaaaatacaaaaattagccgggcatggtggcattctcctgtagtcccagctatttgggaggctgaggtgggagaattgctcgaacccaggaggcggaggttgcagtgagccgagaccacaccatttcactccagcctgggtgacagagcgagactgcaaaataaaactatatatatattttgtttgtttgtttgttttcttctacatgaatatatacgtattcccaggaactagaacaccgtttctgttgtggatgctgttctgttctacctaaactcctccctttgggactgaaggatttattctctcactgctgggaatgttgctggctgacagcccttagctgtcagtcatcccccagaattgctttaggtgatgaaagcagcctcatcagattttactccacttcccaggaagaacccacctataatgactggtcagtgttggggtataaatgtcctaaaccctttccctaaattaagccaaatctgaagggatcctacagcttcagaactccctgggggttaggatgaagactttttgactgaatgatagtccaatttctaaaaccctgctttaattcatgagccatcttacataattcttttggtacaaatgtaatttaaatgtagtgatctttgtgatttcttccttaactatgggcaatgtctcttttctgcttcttgggagatgaagttattggcattgatacccttcctttcccctaccctttatgcttccacttgccaaaatgagatacaggcacccttttttcaatattgtcaaagctgacaattttgacattctgctgtaacaataagcatacttgggctttgctcgtagcttaattctaaaaattgaaaaaaatagtttatcattttctaaatatcactcatgtatcagacgttctttgcttgccaaggaactgctgtaataggatcccttttcagtgaggtcctgggttaaattcagttttctggattccttatcttcccatttcctgattaacaattccactttactaagtaatatccttagtcaacttctaataaaactatgtgtggtaggtacaatttttgccttttcatatttcttgacttagttttccaaccttcctattaaattttccaattgtttatagcattctattattactcttacagattaagaattctaattagaaagactttaaacttgtttgctgttacatgagctttccatattaaatctgtgataattttcatgttattttattctcatcttctctttcgtgttgtaagagtttctcaaacatttgctctgactgcctcaaccttgtcctttacctactgtataccatcttatttcatctcaagatacacttcttcgagccacctctaatctcccccaaattatacctggttcctgtgcaacactctctcactttaccttgttctcttttcctttataaattattcagagtttgtaattatatgtttgtggaattatgtaatatatgtatatttcttcccactagagtgtaagttctatgaagacaatgaatgtatctcttttcacattattttaatgatacgtataacaaagtatggtacttattgctataatggtactcaaagaccatttttgcagttttgatgaattaaggaatatataaacaagtctgggggcttagtacagccaataataaaggaaaaagtactttgctttcctttgctattattagttcttgcatacacattctttagagttgcatttttgagaggttcctatagtcttaggcaggatttggatacttaggatttcccaactgtgataaaaatgagaaaagcctaaaaactaacataacttcaaacagaatgtttctctgcctatgtttatgggactttcctggaatgcattttttaaaaaactttgtattacagaaaacttcaacagtgttagagagaagagtgccatgttttaacagccaagctttaacaatgatcaattcatgggcaattttgtaaacccacccaattaatcatacatgcacactgggttattctgaagatactttcagataccatacttcattcataattattttattatgaaaatctaaagtataatgactttttagaaacataacagcaatgctattaccacactaaaattagctatttccttaatacagtcggtgtcaatttttctgattgcctcatatcaatatggttcatatatttcttcagccttttaaaaatgtatagcttctcttctcttcccttcccttctcttctcttctcttctttctctctctctgtctgtctttgaattgttgctgaaaaaattgagttatctagtggaagttcccatattctggatcttgttggtttcatccctgtggtgtcattcgctatgggatttgttagttggactccagaaaataacaataacactaattgttaacacctactgactacttactatgtgccagtacagactgtaagtaaaataaaatgtttaattctt

SEQ ID NO: 17641 - DNA, 31533 bp, Homo sapiens
tttcaggggcaggggtgagtggaaggtgggcttcctcccttgccacctggggggcgggcccaggacagatgctccgtgagagcacttcccaacctaggcccagctgtggggaaggagggagcaggcggctgggctccaggcagggggaagagttgcctgagaactcagggagagagggagggctggggcaccccatgccagctccagctgcagcaccagagctcagagcagaggaggcaggagccagcaggctgggaggcttcctggaggaggtgtcccaggcccctgccagcactgcagccttgagcacgaggccacgctgggctcctgcttccagggccgcagacccagcccagcactgcccatgctgcccttgccagggacccttacagagctagcacctgggtccctccccctggctgggcatgggctggtctcgacaacaaagaaggggtagctgtggcctcaaggtctacaacaggttgtgatctgtgggtgccaagaagtcatgggccctcagcatcctcagggccagtgagtgtccacctgggccagtgtggggctgaagggtgagagctgagaggcggggctgacatcctggctctgctgccagtggctgtgtggccttgggaaagtcacttagcatctctgggccttggtttcctcatccatcagaagggaaccaaagaaggccctgcctgcctcagctgctggatggtgtagctcagtgttgtctgtgagaggcaggcccttcggcagccgcgcctctggcttcagtacacccgtgagctgctttctgtgcccaggccttcaaatcacggggacagccccgtgggtgtggttcaggtctgggcaccacaggcaaggggaagctgacatgtcctccgtgggaagtggcagtccccatggctaccgggcatgcacagggcgtgtggaagggaccttggagggaggagcagctcctcgagggaggagcccggggctggggtacggaggcctctgcacatcttagagtaaaacaagcaggagaggctgggtgcggtggctcatgcctataatcccagcactttaggaggctgaggcgggcagatcacctgaggtcgggagttcaagaccagcctgaccaacagggagaaaccccatctttactaaaactacaaaattagctgggtgtggtggcacatgcctgtaatcccagatattcgggaggctgaggcaggagaatcgcttgaacctgggaagcagaggttgcgctgagccgagatggcaccattgcactccagcctgggcaacgagagcgaaactccgtctcaaaaaaacaaaaacaaaaaaatcaaaacaatcaaaaaaacaagcaggaggggctctgaggtgcctgcaacacccaggtacaatccgtggccctgaggcccatcacagggaaggggtctttgcagctctttcaacccccagcccagcatccaaggaagcccagggcagggagaaacctcagctgcaccatcagagctcagaacagagaaggcagaaattagcagggagtggggctggggaggcttcctggaagacgtgtctcccgccttgctggcactgaggccttgaggatgggtccatactgggcccccactgccagggatgcagatccggcccactgctgaaatctgtgctcctggagcctccctcctgttcatgggccacaggctgtgaaaaccccagagtcctcccaggcagcaagttttgttttgttttttgtttgtttgcttgtttgttttttgagagtcttgctctgtcatccaggctggagtccaatggtgcgatctcagctcactgcaacccctgccagccagcaagttttgctggagcaggtggaggagtctttgcagcgagctcccgagctgcctaggcctgccgaagagttgctgagcacatgaccaccaaaaaaggtttcggcacctgtggacctgtgggtaggggaggcaggggcaaatgtcactttacgtcagggggaggataaaatcgaacgtttattaacattgattttgtgccagaggtggctacccagacccatccactgtagccgtgaggttggaagggagaggggaggcatgaactggtttgtccaaggtcgttggcagagcgcggctgtgaactgggttagcccccaggcccctcctgcccatccgtcctccaagcactgatgtgcgagtggcacagtggtccccttggccctgccagcccctcgggctgtggccctatagcctttgaaggacggcctcacttccccagcagaggcagcctggccttccagtacctcgatggtgtagggctctggggccacagtctggtgttttcaggactaggttgtgggttacttcctcctcttctctcaattcccaaggtttgttaagcggccctgtagctccggtcatggcaatatggatttactggcggtgctttctgaagctgtggatgcaattctcacaagtggccacatggtgtcaggctcgggccagattaggaaatctccgctttacaggtggagccgggtggggctggggaagcgagttaagaacgaaattcagcccatctgggctcatcctagggacgctgtctctgaaagggggtctcaacgttctgccccgggcctctcagtaatagatctcattttatgttcatgctaatgtggtggtttcctctcttagaacaaaacggatgcttcagaaaggtgttccagacctatcctgtggcttaggccctaagctttaggatgctcaccaggccacagccccctcgggttaggagacacccgaagggaggaattccctcagcgccccctctcagtcctgtaatgccgggacagaagcagataagagccccggttccaaacacaaaggtgcaggacccatggcaccctgacactgtagggaggcgtcctgactttgcccccagagtccccctccagagtgccccaaattgcggcgcccaagacctttgggttatgccactgtaattctagaaatggccgccaggtgtcagcagaaggccacttaagaagctaaatggcgaaagcttggtgtagcagatttctgggggttcccaagactctcatgcatgaacaggggtgggctgagcctctcccaggcctaagaggcagtggagcaaggaggtttttctatgtcgtgtccctcaatcctgcaccccagtttttgtccattttgcggtccctctcacctgtctccataaagcatgtgtcccccagacccttgcgtggaaaatctgtggaatgtagtgctgtggggccacagccctcacaccccaactcactgatccccaatgcctctagtcctgcctcggtggcaccatggcttagctgctccccgggggccctttctatcctgaccgcttctccctgctctccttctcctgtttacacaccctgggttccaagatcctgatgggataaaatagccttggagactagagtgagctcctcctgggcccatccagagatggaattccagtccagggcagagtttggattcaagacaccattgtgggcctgggaggctccaggtttccaggagtttgacctgtgggctgcttccctttcagccccatagctgcccacctcctcaacctggggactgttcatttgggggggcatcccatggaatcacttcatctggctgggtgtcagcccgtcactctctctaggtccatctgcagcttggaaagtcccagccaagtgtctccagagggctctggcagtcgctgtttgcaacatttgggcatcttgcagcagacactgggaccagcacatgctacggggtctctaagccatagagccccggagcaagggctgcttcatgctgacctccttgtatctttgttttgtttctttccctgagtctttgttttgtgccttctcttcctgcaggcttgaggaggaggtgtcaaattcccagtaagacttgatctaatccaatgggtgattctatctgagccctccctgagctgctgccagctctgagtctgtgctttagctggaaagactgtgaacccattcagtgctctggacctgacagggccattaacatccctccccacccaaaagccgagtgaaaaatcccattttccctcctcccatgggagggcatggctctggggcatctacgtcttatttgagacatcccccaacacatgccagatttgaatccccttcaagtctaactctcttccctgctgaaatccttgttgtccccactagatgtcctattcctccagctaatgaagggatttaagacgagggcttgaaagaaaaagggagaggggacaattaaatcccaacacaggctagtaaaactaatcacactgaaggtggttggggtgcgtgggtgttggagggggggactggtggctctctggaaagtacacgtctttgcctcttcctgagtctttgctagcttggggaagaggttagaaatttccagtgtgatttagtccaatctggtggatgcttctatatgaaccctcacccagctgctgtcagctttgagtctgtgctttaattagaaaggctgcgaacctgtccaatcgcccaatccagaaatgcctgcaagtgccccctgcagcagtgtcattagagcttagtaccacacagggagtgtctgaggtcagatcagacgtgaccagtgaagtgaaaaaccccccagctgagtaccttgctcatggaagatggaaggacataactgcacagtacataactgtaccgggagcacctaaaatccaatttttctgctgattcttgaaccctgctttgtcccccttattccccccccccccccgccattttaccagtgccacgtccaccaacattccagggtgtcaagtaactgccaagtgtcactctaagtaaagctacacccactccccaccacctccacatagcccccacctcctagctggcagggagcttctggcttatgcccacgcccacaggcgcctttctgccaggtcaggggtgggccaaacctccacccgctaatgtaccatgccctggtgctggaaagtgcctgagccagctgccccagcggcctcggcactaccaagttggcacaaagctccccaaattcggaggggctcagggaaacgagtggaggggatgaggaggtgaggggtaaacccatcatttcagttggcatttgagcaggtgccatgctcagcggagatgaggctctcccatctgtaggggccgtattaacatgcacactctaaaagtgcccttcgtttctccagcctcagctttgtccctctcctcctccacgtcaacctggccagagggtctggacgccacagccagggcaccccctgctttggtggtgactgctaatattggccaggccggcggatcatcgtccaggcagtttcggcagagagccttgggcaccagtgactccccggtcctctttatccactgtccaggagctgcggggactgcgcagggactagagtacaggtaactgggctcccatcccttgagtgtgagagaaaagctgcactttaagtgttcaggcgtgggtgggccgggagcttggggcagctgccaggatcctggtttctgaaggaggggaagaacttctgctgctggagggtgcagggaagcctcctgagagcagcctcaacttcagggatggggtgtgcaggaaaggccattgtggagagggttctcctttagggctgcacaaagccactgaggcttttgcaaggaaaataggttttccttgactaattcaccaagcaaaatgggaggggtaggggaggagggctaggccgctcttcccagcgggaacacacagctgtcttcacaagtgtgaaaggaagagtctttctgtgtgaaaagtttcctcccgttgcatcccccatcccattcccagagacaaacaggagactttgcagaggagccgggggcccgagattctggcgcagatattttatttatacatatatacaccattttacaggtaaagcttccttccctcctgcctccctatgcctgctgaccaccagcaagaaattggacaggagactgaggagaaaygccgggagaggcaacaaccgccctccatgtcccccctaggtttagcttctctcctcctgatggcgcacctggtcccccttgctgctctcccagcctccctggcacagagaggcgccctggggccaaggcagtttccctgggaatgctcattcatgcatgaagtttttctctgttgcaccctggacccagactcctcaatccacccagggtggtgtctgtggggagggggttcacttccccaggaagcacagccacgccgtccctcactggcctcgtcaagcagagctgtgtgtccagtggcttttgctggggccccctccttatctccttccaaggtgggggtgtttggaggtggaggaggctttcatattccgtgccatgacccctcaaggcgggccattcgtgtgcaccctccacccccagtgccaggcagaagcccatcctcacccaggaacagggcagcctgtccaacagaagggtctcggcctctccatcagcaccgggaagccctttctaggcaaacttctcaccacttcttccctcccttatactttgaaagagggagctctaggcaggggaggggctagagggggaagccgctgcccagatcctgacaaggtgacctgaaggaacccggggagggggatgggacagggctcaggcttggggtgtatggggaggggggctttgcttttaaaagaggtcatctcagcaatatctttttgtttttccccaggggccgaagagtcaccaccgagcytgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagaggtgagtgtctcaggcaccctgaggcctggcagagagggccacaggctctgcgcgggagtcttcgaactgggatctcccccttctgcaagcagctttggctcagagaggctggcgtggattcagtcacacagctgggatctggagttccgtggttggctccaggtgcttccgtctaggggccagagcaggtgtgggcagagcaggttccccgcagtctccacggcaccgaggtcctggcaggggagctcctgggagacgaaagagggcaaagaaggggagaggggcagggagagagcgggcagccaaaggggagaagatggggggcagaaagtgggtagagagggaaaaagggaaaatatcattggggaagaacctaaaaacccaaggaaagctgggctctgctgggggctgtgagacccccgggttctccccgccccaggctgctggccatggggtcttgcaccaatggcctgacctttctgtcggtctgtatttatcaaagtgggtgacagtctcaggcctcctggctgttcagaattgaggtaataaccagaggccttctgagcaaagggcctaaggggctccggcgtcaggatcccattgtggtcaggagcctgcggggcttcccgtgtgcaagaggggtgaaaggtggctagaaaggcccagccagtggcctctgcctcagccagagggagctctgtagtgggggcagcacccattcactggtcaggcactggggtgacaggggaggctccaggacttggggagcgttggagctggaggcacatggattggagtccctgtacctgccccaygacagggcctgcagggagggatccagcaggtgactcttcaggctgatttgcccatcccagatagaagccgggagtgttctttcaaaggtgtctttaccttagacactcaataaaatggtaacacagtggcgccgcctcagtcctttggagtgtgcaccgtctgaacccctctcccagggccctctcccaagcaccccaacctggacccatatcccccacgtacttttggctttgggcagattgagcagccttggggtggtctgtgctgtctggtgtggagggttgcagttcgggtccttagtcctacttcccaggccggccgggctgacgccagcgagtgtgtccttccccagcgaggggagygagcgcaaggtcagcgcctcgtctgcggcgccctgcagggggtgacggaggggcgctctgaggacccttggagamaggagctgggtttgtaaaatgctgggcttggtcccacggacggcggagcggtgagctcagagccagagctggggaggaaatgggaatgagaaaggcccacttcagggctggtgagcgaggggatggggagcagccacaggccgaggctggggcatgggccaggctccatggggtgagtctgagtccttgaggggatgttcatcctctgtggaatgtgggtttgccagtggagaggagaccagcgttgccctggtgaggtgctggttcagggctggggggcggacgctgcttggggctaaagttcctgccggccaagctctgggtgggaggagaccctggccccctcccaacacccytggactgctggcgggacccttcctacctccgggggctggaagtagtgggggaggagccagtcttgaggaagaaccccgatgctggtcttgactagaggggagccggtgtgcttttcgagcctcagggtgacccgcgtctgccccagcctccagcctgccctggtcacttctgactaaataaggagagcactcagcaggcagccccacgagggagggggaacatgtgtgcacccccactcccccacctgctcctccctccctacagggccactacaccctgctgtgggcaccccaaggtgaccctcagccttcttcctaccttaaaaagtccaggcatgcgttttcaagcatgagcggtggccccctgggggaaggcacctcggcagggcagaacaaagggaagggacccccaaacaggtcactggtgtaattgtccccagcacccccaaagaggaggagaacccacaactcggaactggggctcacccccgatgcccaacctgtccccagcctgggaagcaggcgtggaggagaaggtggggggagcctagagctggccctgggggccctggttttgtccatgacgggagcctcggcaacctagtccgctctcccggggaccaggtttgcagacaggcacctttcaaatgctcctcacccccaaatttacaagtcaccctgcagaggaaaacatcaacacagccaggggttctctgctggaggctcccccttctataggcacagccggagaggccagagagctggggacacggggaggctgcaraaggctggtgggaaggggggcagtgatgggtggggagagatgggccagatgttcttggaatgggacatgggggtgattgatgcagacagaaatttgaaggggacattcccacgtgtcttgttctgtgggtggaaaatgggctgtttttcatggtgggggcgggttctccctgtcttgccaagctaatgtgaaagagatgcctcatcctgcccagctccccacacctgtccaaggccattaacttctgcctccccagtgtcaggctttgagatgccccccttctagccggggtcctcctatggggtgacaatggggacaagcaatgcccactgtagttgccccaggatcccccaccattctgctggtccccagcggtgccccctctctggcagtacccccacccaccccacaggtccccttagggccactgccccatcgcccgacattgcccaacgccaaggggtgaccttgttcctgccgacagggccgttgggcgcctgcatgcgggtttaatatttgcctataaggaactgggctttccccagccggagtggacagactttccctgaaaattcgcttggagagaacgaaaagagacccctggcaccccagcggcgtgcagccctgcacccccctcctcccgggccccgtgtttctcattttcctccccacttcctctgctcttcagtgttacccaaacaaaactggtttcacccttgtttggtgctggcgaaggcccgaacggcgcgcgcaaagctccggggcaggccggaggtggccaccggggtgctccgggcccccaagccaagccggggactagcctgcccccggtggcggctcggccgcggcttcgcctaggctcgcagcgcggaggcgagtggggcgcagtggcgagggggagcctgcggacctcccacgcggggaccgagcaggtatctgggagtcccgggagcgcccgggaagcagcgtcctggtcgctccctcgcggcccttgggtttcttccttacacccggacgcccgctaagctcgggctgccgccacaaacgcgctctccgtgtggagaaggcaaagaaaaaaaaaataaaagcaaaaggaagaaaaaccccaaagaacgaaaagcagaatttcagccggccgtgcgcgccagggcgctccgcgctacctgcccgcgccgcccgcgctcgggttcccggggagggcgccagtgctccgcgcgcgccccagccmaggtgaatccccggcagcgccttccttccgctgcccgggaagcttgagctcaacaattagcccttgatcctcgggggattccaatccacggaacaacttccctgctttccccgaactcggacattttactttttctgggatcctctaaatttaagcattgcttcccaagtcttctaaatataytcaccatttcgacgggtcacaataattttcttggacgttaatttccggggacgtcaaaacacatcagtcccggcgggcttttccagacttacactatgtggcctggggccccagatgtgctttctcccaggctctggacagttttatacaccccctccaggtcccacagatttacaggccactaacccggsttccctaattttaaagacgaagcccttggtccgtggtggtcgcgctgaccaatttgcctggctccccaggatgtggacagtgccttttccacatttaggcattgtttccaaaacaagtggaactttcccgcataattttgaatattaactccagggtctcctaagcttactgtttcccgcacacgtccgccccattccgcgcccccccaccccacccccgcgccccttcccgttcacctcagcatgggacatttgctgttgggtcccgcaaatctattcacactaacctgggttccctaaactttacacgttgaatcccaagtccctcatgacactcagcagggctggaaggttggaaccctcagagtatgaaaattgcttcccataccttcccccaaattcggtcattacacccagagcatgttgaatccttttctgaatcataaacgacctgccctctgattgcctgagtttcataaaatggagggatttccccagtgattccccaaagctattgagaatgttgtgggtgtgtgagtcacaaagctttggggcattaacgtctatggctctatatgctgcctggccasgaatcaggtcccttaagatgtagacagtgccacccaggtccctggagcacactgagcagttaccaggaggtgctcaagtgtgacccaggattctccaggtccccccaaatcacacagggtctcccgggtccctctgggctacaccaagcacaaaaggaccccttgggcagagcctacttttatttctgttatgccaggtgttgctaacggccccagttcccaaacattccgagcactttctctgcatcacaacatattgactattaaacaattctcwgggtcccaggagcttcataacaagaatcttgcttttctaaaattcaggcattggtctgaaaccccaacggccaggatcacactggacccttttcctggtcccccatacttggatgttctggacgctgccctccaggccctctaggaacattcagcattgccctcggatcacaggacagcactgatttcttgggctccaaacaacccactgagtcatctcaaagttaagcaatatttccttcaaacacactgcacactccctatcacaaaatctgaaaattcctaagtcctaagacctaggaattctgaatcccctttctttaaaatgtacatatggacccccaagtcctccaaggactctgagcaacttccctagatctttagattcaaaaacgattttcctggagcccccaaattgcggtattgtctcccagccttccaaagcaaattgagatttttttcccttcacaaaacaattgaggtttttttttttttaatactgatttatgagtctcctgactttatggtccctgccctgggtccccctacatttagaaaatgttccatggacccccaaagcacactaaaaaatgtccctgggtcccaagaaatcccaggcatggaaaaacctgcgacctataagtttcctagctactaactaggtttccagaaatttagatatcaaatctccattgggtaatttccatgtgtcccaaaaacttgaaatgtgtttcactggggctcccccaaatgcagacgacatccaggaaaatatatagtctttttcttatttaccaaaaataagctaatggaaatcatttamaaattagcatagaaaaataatactgattttttatttttttattttttattttgctttccccaaatgtactgatcacactccaggctcccccaaaatctagacagtgctttcttccatctctgaagggtgttaaaacctttccctgaagccacagtaattatgaaggttattttttccccggctgctgccagcgtccaggccactaacttatattcttaagatgtgaaaattaatctcagcttccccctaacacaccaagaatgtgtttggatccccaaaatgtgttccttgctttcatctgccaattttacgtaatatggctctacggcaaaattcccaatttcatatggagaattttctttaactacccctcctcacaaattggtcccccaagctagctggcccctatttgagacctctttctctatgttcccaattgcatggagcaacttctctcatcccccaaacctgtaatctatttttctggagtctcgagtttagtcattaatcacggttcccacattaacggagtccccggggtcccctcctccaggacacccattcgctaagcccgcaaggcagaaagaactctgccttgcgttccccaaaatttgggcattgttcccggctcgccggccacccactgcagcttccccaaccccgcgcacagcgggcactggtttcgggcctctctgtctcctacgaagtccccagagcaactcggatttgggaaatttctctctagcgttgcccaaacacacttgggtcggccgcgcgccctcaggacgtggacagggagggcttccccgtgtccaggaaagcgaccgggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcggtgagctccccgccgcgccgatcccctccgcctctgcgcccctgaccggctctcggcccgcatctgctgctgtcccgccggtgctggcgctcgtctccggctgccgccggggaggccggcgtggggcgcggracacggctgcggacttgcggctggcggctgcgctcgctcctgctgggcgccccgaaatccgcgccactttcgtttgctcattgcaaagatctcattcgtggggaaagcggctggagggtcccaaagtggggcgggcagggggctggggcgagggacgcggaggagaggcgctcccgccgggcggtaaagtgcctctagcccgcgggcctaggactccgccgggaggcgcgcgcggagcgcgggcgaagtgattgatggcggagcgaggggggcgaggggggccaggggggcgcgagattccgccggcggccccttccccttggctaggcttaggcggcggggggctggcggggtgcgggattttgtgcgtggtttttgacttggtaaaaatcacagtgctttcttacatcgttcaaactctccaggagatggtttccccagacccccaaattatcgtggtggcccccgagaccgaactcgcgtctatgcaagtccaacgcactgaggacggggtaaccattatccagatattttgggtgggccgcaaaggcgagctacttagacgcaccccggtgagctcggccatgcaggtaggatttgagctgtgtttcccgccctgatcctctctcctctggcggccggagcctccgtaggctccaagcctggcccagattcggcccggcgcagccggccttccgcgcgtcccgcacctggcgggggctccggggctccggcgcggcaccggggggcgctcgggatctggctgaggctccaagcgccgcgtggccggctcctcctgctggggcaggtggcggctgcgcgccccgcccgagcccaggggccccctcagccgcaacaaccagcaaggaccccccgactcagccccaagccacctgcatctgcactcagacggggcgcacccgcagtgcagcctcctggtggggcgctgggagcccgcctgcccctgcctgcccggagaccccagctcacgagcacaggccgcccgggcaccccagaaacccgggatggggcccctgaattctctagaacgggcattcagcatggccttggcgctctgcggctccctgccccccacccagcctcgcccccgcgcaccccccagcccctgcgaccgccgcccccccccccggggccccagggcccccagcccgcaccccccgccccgctcttggctcgggttgcgggggcgggccgggggcggggcgagggctccgcgggcgcccattggcgcgggcgcgaggccagcgaggcccgcgcgggccctgggccgcgggctggcgcgactataagagccgggcgtgggcgcccgcagttcgcctgctctccggcggagctgcgtgaggcccggccggccccggccccccccttccggccgcccccgcctcctggcccacgcctgcccgcgctctgcccaccagcgcctccatcgggcaaggcggccccgcgtcgacgccgcccgctgcctcgctgctgactcccgtcccgggcgccgtccgcggggtcgcgctccgccgggcctgcggattccccgccgcctcctcttcatctacctcaactccccccatccccgcttcgcccgaggaggcggttccccccgcaggcagtccggctcgcaggccgccggcgttgtcaccccccccgcgctccccctccagccctccccccggcgcgcagcctcgggccgctcccctttccgcgctgcgtcccggagcggccccggtgccgccaccgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccaggtaagcggcgtgtgcgggccgggccggggccggggctggggcggcgcgggcttgcgccggacgcccggcccttcctccgcccgctcccggcccggggcctgcggggctcggcggggcggctgagcccgggggggaggaggaggaggaggaggaggacggacggctgcgggtcccgttccctgcgcggagccccgcgctcaccctggcggctgagctgggggtggggtgggggcgtcgggaagggccgagggaggtgtgaggtgtctgcaggggcgacttcccggtcggtctgtgggtgcagggggtgccgcctcacatgtgtgattcgtgccttgcgggccctggcctccggggtgctgggtaacgaggaggggcgcggagccgcagaagcccaccctggtatgttgacgcggtgccagcgagaccgcgagaggaagacgggggtgggcggggccaggatggagaggggccgagttggcaggagtcatggcagacgccacattcgcgacatctcccccacaccccctctggctctgtccgcaacatttccaaacaggagtcccgggagagggggagaggggctgctggtctgaggctaagaagggcagagccttcgacccggagagaggccgcggcccctgcccagtgggcagcgtggaagtttccatacaaggaggtgggaaggagacccccccccccttcactgccctgtgcagagatgagccgggggtgcaggatgggagcccatggcacttcgctacgggatggtccagggctcccggttgggggtgcaggagagaagagactggctgggaggagggagagggcgggagcaaaggcgcgggggagtggtcagcagggagaggggtggggggtagggtggagcccgggctgggaggagtcggctcacacataaaagctgaggcactgaccagcctgcaaactggacattagcttctcctgtgaaagagacttccagcttcctcctcctcctcttcctcctcctcctcctgccccagcgagccttctgctgagctgtaggtaaccagggctgtggagtgaggacccccgctgccatcccactccagcctgaggcagggcagcagggggcacggcccacgcctgggcctcgggccctgcagccgccagcccgctgcctctcggacagcacccccctcccctcttttcctctgcccctgcccccacctggtctctgctccctcacctgctccttccctttctgttccttcccttcggccccctccttgcccagctcaggrcttttcctgggccctcacctgctccgcaccgctgcatgcttcctgtcctgctttctgccggtcccctgacccggacctccaagttcagagtggtggggcttgttgcggaagcgcggcgagggctagagtggccagctggcggagtgtgctcttagaatttggaagggggtggcagagggggcggtgagaggactggccagggtccagtcaaggagatgaccaaggaggctttcagatcctcggcgcagctgcccactagtctttagagagggcatgcaaagttgtgcttctgtcccactgcctgctcagtcgctcacataatttattgcatcaaaaactcccctgggtctgcggagcgaaggctggggctgcccgcctggagggtwccaccttctgcaggggcagggccaacttgctgtggtggctcccggcctcccacccccgagtgggttaacccggccctgtggccctgcagcctgtggagggggtgtgtcctaagactggcctccccttccagattgtagtctggggaacctggtgtcggacttcccaggtggcctgagctggtctctccagctcccacggggagagtttggtagcgcaaatagggagatgttctggaggcccctggccttactggttcgatttgaggcctggwaaggaggctctgggcgtgtgtgtgtgtgtttgggggtacccaaggcagactggagttggagaactgggtgactgggaaaacaaggtttctagagcatgggtggcgtggttgtgttaaccattggagtccttgacccaggcctggctcagctgcagactggaaaggtggaaaagccagggggaggggcggggctggcccagcaggactggcctgctgctttgagggcgatggtcctcctggaccccccctgctcagctgggggttgtggggaggaagggactggtcctcctggatgcacatgctctgtaggggtggggctgtctgccatcttggctggcgctggaggcctgagaagtggcgatgtgacgctgggctggccctgcccccatggtgtcataggacggaggccaggtcgggtgtccagcctgggcccctgcagctgtggatgccgctgagctcctgcaataatgaccgtgcagatggtcacccctcgtgtaaaattactagtgcttcttgcaaatggaaggaactgggccttttctgtgtgcttctggacgcttcattctgcacatggccctgcgccctcacctcggcattatgacctgtgtgttacttttgtaataaaaataatgtttataggaaagccgtgctttcaattttcaactgaatttgtaggttggcaaatttggtttgggaggggcacctctggcctggggcttggcctggctgccccgctcacgccacttctctcccgcccccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagtaagtagctgggaggggcttcctcagacctggtcaggcccctagagtgaccggtgaggatygcccaacctcaagccaggggagcacactcctaggtcagcagcccagccgcttgctctgagactttgaccttcccgccgcgtttctgagcacgtgcggtgtcccagggcatccacaccagctgcctttcccatcacacgcctccttcgaagggtgggccagaggtgccccctagacgtcaggggcactcacaggggtctccctgggcatcagaatttctgttgggggccgtgaggctcctgctcctgaggcaccgcacgcctagtgcagggcttcaggctctggaggaagagcctgcctttcttcctgcaccttttggacattytgacaagggacgtgcgttcggtgaatgatcagaattaaaatcaataaagtgatttatataattaaaatcaataagacaagtgcagttggtgggtggcaggggtgagcggtgcatgcgcctccttgggccccaaggctgscgtggggggtgcccacctgctgacctcaaggacgcttcagcctttcctcatgtttctctcttggttctccagcctgggggctggcaggtgggtgcatggcccattgtccttgagaccccacccccagataggggggctgggtggatgcagaggcaggcatggtgcctgggcatgcctgatggggcaggggaggggccgctccttactggcagaggccgcacggcttattccacctgacactcaccacgtgacatctttaccaccactgcttactcacgctgtgaaatgggctcacaggatgcaaatgcacttcaaagcttctctctgaaaagttcctgctgcttgactctggaagcccctgcccgccctggcctctcctgtgccctctctcttgcctgccccatttgggggtaggaagtggcactgcagggcctggtgccagccagtccttgcccagggagaagcttccctgcaccaggctttcctgagaggaggggagggccaagcccccacttgggggacccccgtgatggggctcctgctccctcctccggctgatggcacctgccctttggcaccccaaggtggagcccccagcgaccttccccttccagctgagcattgctgtgggggagagggggaagacgggaggaaagaagggagtggttccatcacgcctcctcactcctctcctcccgtcttctcctctcctgcccttgtctccctgtctcagcagctccaggggtggtgtgggcccctccagcctcctaggtggtgccaggccagagtccaagctcagggacagcagtccctcctgtgggggcccctgaactgggctcacatcccacacattttccaaaccactcccattgtgagcctttggtcctggtggtgtccctctggttgtgggaccaagagcttgtgcccatttttcatctgaggaaggaggcagcagaggccacgggctggtctgggtcccactcacctcccctctcacctctcttcttcctgggacgcctctgcctgccagctctcacttccctcccctgacccgcagggtggctgcgtccttccagggcctggcctgagggcaggggtggtttgctcccycttcagcctccgggggctggggtcagtgcggtgctaacacggstctctctgtgctgtgggacttccaggcaggcccgcaagccgtgtgagccgtcgcagccgtggcatcgttgaggagtgctgtttccgcagctgtgacctggcsctcctggagacgtactgtgctacccccgccaagtccgagagggacgtgtcgacccctccgaccgtgcttccggtgagggtcctgggcccctttcccactctctagagacagagaaatagggcttcgggcgcccagcgtttcctgtggcctctgggacctcttggccagggacaaggacccgtgacttccttgcttgctgtgtggcccgggagcagctcagacgctggctccttctgtccctctgcccgtggacattagctcaagtcactgatcagtcacaggggtggcctgtcaggtcaggcgggcggctcaggcggaagagcgtggagagcaggcacctgctgaccagccccttcccctcccaggacaacttccccagataccccgtgggcaagttcttccaatatgacacctggaakcagtccacccagcgcctgcgmaggggcctgcctgccctcctgcgtgcccgccggggtcacgtgctcgccaaggagctcgaggcgttcagggaggccaaacgtcaccrtcccctgattgctctacccacccaagaccccgcccacgggggcgcccccccagagatggccagcaatcggaagtgagcaaaactgccgcragtctgcagcccggygccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccrtcgggctgaggaagcacagcagcatcwtcaaacatgtacaaaatcgattggctttaaamacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccstctttctcttctcccttggactttgagtcaaattggcctggacttgagtccctgaaccagcaaagagaaaagamggrccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacgagcatacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacgcaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacaygcacacacagcacacacatgaacacagcacacagcacacacatgcacacmgcacacacgcatgcacagcacacatgaacacagcacacacmaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccsctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccayaggagggggctcctggctggcctgaggctggccggaggggaaggggctarcaggtgtgtaaacagagggttccatcaggctggggcagggtggccgccttccrcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctygcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagygccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccrgccccttgcrtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcarctcctttaacgctaatatttccggcaaaatcccatgcttgggttttgtctttaaccttgtaacgcttgcaatcccaataaagcattaaaagtcatgatcttctgagtgttccactctctgacttgggtactggactgccggagggagggaaggggctgagcacctggaagcaggcagagggggatagaagagggaaggggaaggaaggccttaggggtgtggacacctctctccgtcccctgatcacatacatggagaaatgagagagctggaagccagactctcagactcactgtcgtgcacctgaagccagggggtctgggacagtgtcaggcaccaagttctcaaagatgggggtgccacgaagggtaggagcctggggggctttttcagagaaaaagcaaagtaccatcagtaccaactccagggaatgcctcccccaccaacagccttagaggactggggctgggcaacctctaaaaggttctggaaaccgtatctgtggctggagatgggggctcagggccactctcacccagggactcagcccccttccaaggttgaggctgcccagatgtcrttagtaccactgcctcctgccagggctcagcctgtacccacctgtcccaagggtgctggcctctagctttcaagggtccctgagcatgggaggaggggtaggctgggctgctgggagcctggcccagcctcttctctccatccccctccaggaactttccagcagccttgggcagtggatctgcctgtgccccgcctgctgtggggatggagggacaggggcgccacagaaggagcccrgaagtgtgcccagggccctgcagccttcagtgctgggcaggcggtggggaggggcctgactgggttgggggcgtgcttgcatcctggcccccagggtctgcccctggtcaagccctgtcccttgatggctgcctctgtccctagcatttctcctgtgccgggcactggagggtgctgggctgtcacccaagcctctgaggcctggggacacgtctacacggacagtgtcactgcccacaccatctgagaaccactccgagggaagggagagggtgggcggtggtttggggagttgcctggaggaggagggattagccttgaagatgaggagggctgggggttggagaagagcagattggatatggggggcaccatgcccttcctgagctggtccctggctctgcacctcagtgctaggtctaagctggagggtccagggcccaggtggcattgctgacccccagggggtcggggctgctctgaggcccttctgtagatgtagatggaagcctagtcctgtccaccttcctgaggccaggtggagttgctttccctgcaagcccaggcagctctgccctgtgcccctcccccagccctgcagtcccccaggcccacgcagggccggcctcatggtctcgcttcctctctgggtctgcttcagggcccagcctccagccccatgagcctgggccctcctgctcctgtccccactggccccaggtcacttcaacactggctctccccgcaccctgggcctgctcagccactcctgcccacagccaggagcttctgtgcagcttctttcctttcacttgcagcctgcctgccctctgcttccccggaccccttgtgaacttccctgacctctctgcagaactgggcaaagccactcaccctggttcccccgggtttagcctggtctcttgacacccactcagggctgcccagccttcatcctgcttcactgggcccagcctcattccagggcttctgagactgcagggccctctcttctcccctctccctgctttgcaaattctcagttcatcctggcagctccaactctccatccctccacccatccatccccccatccatccacctatccctccacccatccctccacccatccctccacccatccctccactcatccatccactcatccctccacccatccctacacccatccagccacccatccatccacccatccctccacccatccatccagccatccaaccacccatccctccacccatccatccactcatccctccacccatccctccacccatccctccacccatccctccacccatccctccactcatccatccactcatccctccacccatcccctacccatccagccacccatccatccacccatccctccacccatccatccaaccatccaaccacccatccctccacccatccatccatccatccaaccacccatccctccacccagtcatccacccatctacccattcacccacttacccactcattcacccactcatccatccactcgtccatctacccaccaaaccatccactcaccatccacccattcacctactcacctgtccatccacccacttaactctcactcacccactcatccatccatccactcaccctccatccacccacccagtcatctatctattcatctgtccatccacccactcacccacttacctctcactcgcccactcatccatccatccactcaccctccatccacccacccacccatctatctattcatctatccatctacccactcacccacttacccactcacccactcatccatccatccactcaccctccatccacccacccagtcatctatctattcatctatccatctatccactcacccacttacctctcactcgcccactcatccatccaaccactcaccctccatccacccacccagtcatctatccatctatccatctacccattcacccacttacccgctcacccactcatccatccatccactcaccctccatccacccacccagtcatctatctattcatctattcatctatccatctacccactcacccactcacccactcatccatccatccactcaccctccatccatccacccactcatctatctatccatctatccatctacccactcacccacttacccgctcacccactcatccatccatccactcgccctccatccaccccccagtcatctgtctactcatctgtccatctacccacttaactctcactcacccactcatccatccatccactcgccctccatccaccccccagtcatctgtctactcatctgtccatctacccacttacctctcactcgcccactcatccatccatccactcaccctccatccacccacccactcatctatctattcatctatccatctacccactcacccacttacctctcacttgcccactcatccatccatccactcaccctccatccacccacccagtcatctatctattcatctatccatctatccactcacccacttacctctcactcgcccactcatccatccaaccactcaccctccatccacccacccagtcatctatccatctatccgtctacccattcacccacttacccactcacccactcatccatccatccactcaccctccatccacccacccagtcatctatctattcatctattcatctatccatctacccactcacccactcatccatctatccactcgccctccatccacccccagtcatctgtctactcatctgtccatctacccacttgactctcactcacccactcatccatccatccactcactcctccatccacccacccactcatccacgtatacaaacacatggacaggcactacccacatgctggactttcagccaagagatgagctcagcgtcatggagggaagaaagcgaaaggtgttcggtgctcttttaagcaagacaggcctcatggagaagttggcgtgggggcagagactggacggagctgaggcctcatggagaagttggcgtgggggcagagactggaaggagctgaggaaggagtatgaagcatccagaaagagcgttcttcctcacagggataaaacatgagtggtctgggagtgtttgagccacagcaggaagtcgggggtttgggttggtgggagctgcagcaggaagaggtggggggcctgtgtagggggctgaggtcagagctgtaatggggggcagatggcctgggctgcataggccatgccgtttgttcaacagacaccatgggaccctgaggccatggggtgaattgtggccctcagaaaggtctgtcccgtcatgtgcagtgactcgaacctgtaatcccagctacccaggaggctgagccaggaggatcacttgagcccaggagtccaaggttatagtgagctgcgatggcacctgtgaacagacactgcactccagcctaacctaaccctaaccctaacccaacctccacgcagcacccacgtggcctcgtggcacagctcggttcatagtccagcagtggtaccttatttccttggtgacaagcaacaccctcatgatgacccatgaggccacctgacccacactacccatcaccaccaccgctatgacacctgcccagccacagtggtcccaggttgggttgcccctgcctagaccccttcccctgcagacctttgcccaggtcatcttggcgtggttgcaccctcggcgtggagtctgccttggaattcctctgcacaatggcagcccgtgtggacctgtcccacaaacgctctgagaatgaagaggacacacttccaatggcacctgctgtggccagcttcactcctccaggatgtcctgcagacccctcacccagcatgcgtctgccggtccaccactgccctccaccacacctcacattgagttagttgaggagatccacggactccaccaggccctggcccctgctgctgtccagcctcctgtagagccagcccctctggccatgctccatatgggaccagagcagtggggccagagtctgcctctctccacttagagccctccgtgaatcccgtgggccactggcaaatccaggccctggccaggctttccagcacctggccccatccctggtcctcccacccacccctccactcccagtcccaggctgcacctgctgccctcttgcccaggccctctggtatcacccttgtcctggtaactcacgcacgccctctgctgtactgtgccatcctgacccccaggagtctggcctccctggtctcccttcctgtttgttctggcattgagccccccaccatccgccagagacactgctaaccatggtcccaagacgcctgctggcaagtcctctccaggatccctggggctctgtctggggctcccagaccagaggggtcagacagaaggccctggagggtgcctcgagggactctggcaccccaccaatggctaactccctgctccccgggttagcttgtctcctgcccctgtgttagcttcccccttgccccctagcccctgggttagcttgtcccctgccccccgggttagcttgtcccctgccccccgggttagattggcccctgcccctgggttagcttggcccctgccccccgggttagcttggcccctgcccctgggttagcttggcccctgccccctgccccccaggttagcttgccccctgccccccgggttagcttgccggggagacccagctgccaggcatccttgctgaggttgcccaccggcccgctcagcaggcctcatcctggaggaacctgtccctctgggtctggcccccagggtccccgctcttcccagctcccacacaggtgcggccaggccagggctggcacccacaggctgacagccccacccctcaagcctggtctccaccttctcagctgggcccctggccctgcccactcccctctggcccaggccggggctgcagccccaggctcagagtgtagtctccagcctgtcccccggctcccagccccagccagcccaggcctcagccggcctgaaaccaaagagaaaatgcctgtttatgccagtcatgccgaaagcaaaacagtttgtggtttgtgacccaaattttttgcctttttttttcagaacataacaaagcccaagacaactccctccccgctcccagccctccccccaaggcagacagaaatgatctgtttacactgg

SEQ ID NO: 17642 - DNA, 112486 bp, Homo sapiens
  misc_feature (1)...(112486): n = A,T,C or G, or insertion/deletion polymorphism (see Tables 1-2)
atcacgctactataaagacacatgcacatgtatgtttattgtggcactattcacaatagcaaagaattggaaccaacccaaatgtccatcaatgatagactagattaagaaaatgtggcacatatacaccatggaatactatgcagccataaaaaggatgagttcatgtcctttgtagtgacatggatgaagcaggaaaccatcattctgagcaaactatcgcgaagacagaaaatcaaacagcgcatgttctcactcataggtgaattgaacaatgagaacacttggacacagggtggggaacatcacacactggggcctgtcgtcaggtggcgggatgggggaaggatagcattaggagaaatacctaatgtaaatgactagttaaagagggcagcaaaccaacagggcacatgcatacatatgtgacaaacctgcacgttatgcacatgtaccatagaacttaaagtataattttaaaaaaatgtaagagaaaagaataccaaagttaattgcaaggatccttaataagaactacttacattggaagcaaaccacagagaattgtaaggagtcatgtgacagagaggaccaggatgccatgaaaatggacttggctaaaaataggtcatttaacccttggctgactggcatctctctagattttcagttatacaatgttcaatctgctgtgcaaggtaattccatcttgcaaaggatttgatgttacattctaccacacatacaactgaattaaacttttacggaattggaaatgcaaataattgatcaaaataaatcaaacaagaaaagaataggaaggaataaccagtgatggaatatcaaatatgaatggaaaacagaataggactgctaaaaagaaaaaaagcttcagaagcacataatagccgtgttatttagaatcatagtggtgtgcaaatgacttctatcacatctcattcaataccagagcaaaagatgttaagtttattatgtaatgcccaccaaatagctagcttttgaaaaaaacttgtttctcaatttgagctaaccatttcaggctactgcatcaaaccaaagttattggcatcatgctaagctagatgtgttgactgaagtatgagattcacacttttgtaaatgaaaagcaatttgattaggcaatgttttcctaagtgaaagcaagttattagagaagtaaagaaacaaaagaatggctactccatatagcggagtttttgtttttttttttaagtgtaggcaaatgtttagtgaagatgatatttcaataagaaaattggtgcttgggacgtgcttccactaaatttgagatatcttagacaaaacaaagtcttattttcaagacattatttttatcagactgaagtcttggaactatttgatctagttactctatgttctcaactgtgttaactaattgaaaacaacattgttattaaaggtattcacaagaaaaattcagagttactgttgcatatcctttctctgtttcaaactgttttctcctaagcacccaaggctctgtgatgtctgaaacagttaatcattaattttaaaagataagcttatcgtggaattagaaaaaaaaactattttaaaattcatatggatccaataagagctcatatagcaaagagaatactaagcaaaaagaacaaagctggaggcagcacactaccccacttaaaagtatactgtgaggctacagtaaacaaaacagcatgatactggtacaaaaacaggcacatagaccaatggaacagaatagagaattcacaaaaaaagtccgcacatctacaaccatttgatcttcaacaaacctgacaaaaacaagcaacggggaaaggattccctatttaataaatggtgatgggagaactggctagccatatgcagaaaattgaaactagaccccttccttacaccttacacaaaaattaactcaagatagattaaagacttaaatgtaaaacacaaaattataaaaaccctgaaagaaaatctaggcaataccattcaggacacaggcatgggcaaagattttatgatgaaatcgccaaaagcatctgccacaaaagcaaaaattggcatatgggatctaattaaacaaaagagcatctgcacagaaaaagaaactatcagagtgaacagacaccctacagaatgggagaaaatttttgcaatctatctatcttacaaaggtctaatattcagaatctataaagaacttaagcaaatttacatgaaaaaaacttcattaaaaagtgaacaaaggacatgaagagacatttcacaaaataagacgtacatgtggccaaaaaaacatgaaaaaaagctcaacatcactgattacagaaatgcaaatcaaaaccacaaatgagataccatctaatgccagtcagaatggcaattatttaaaactacataaacaccagatgctggcgaggttgtggagaaataggaaggcttttacactgttgctggaaatgtaaattggttgaaccattgtggaagacagtttggtgattcctcaaagatttagaaccagaaataccatttgacccagcaatcccattacagggtatacatccaaaggaaaataaatcactctattataaagatacatgcatgtgtatgcttattgcagcactatccacaatagcaaagacatggaatcagcccaaatgcccatcaatgatgtactgcattaagaaaatatggtacatatacaccatggaatattatgcagccacaaaaaggaatgagattcagtcttttgcagggatatggatgaagctggaagccatcctcagcaaactaacacaggaacagaaagccaaacaccacatgttctcacttataattgggagatgagcaatgagaacacatggacacaaggagaggaacatcacacactggtgcctgctgggggagggcagtggtgggaggagtattaggaaaaaatagctaatgcatgccagggttaatacataggtgatggtttgataggtgcagcaaaccaccatggcacacatttacctatgtaacaaacctgcgcatcctgcacacataacctggaacttaaaattaaattaaattaaaagacaagctaaaagggttaacgaaaaataattagataaaaaaattttgattttcaaaatcctgaaacaagagttttaaatttgcttttaatatatattcaaatcctttaatactgttcccttccagagatgctgcttaatttcctctcttgagtgtggcttggacttaatgatgcatttctgatatggtctggctctgagttcccaccaaattctcatcttgaattgtcatgcaaattgtaatccctatgtatcgggggagggacctcctgggaggtgattggatcacgggtatggtacccccatgctgctcttatgatgctgagggaattctcatgagatctgatggttttatgaggtatttttccccacttcgatctgcaattctctctcctgccaccatgtgaagaaggacgtgtttgcctccacttctgccatgattgtaagtttcatggggcagccttctcagcaatgcagaactatgagtcaattaaacctctttcctttataaattacccagtctcaggtatttctttatagcaatgtgagaacggactaatacaacttctaactggtaatgctgacataagagtttgtgactctgggtgtagaacataaaactcactgcagcctcccccttctctctcaatgtctctggaatcatgagctctgggggaagccacctgctgtgccataagcagccctgaaggaaggtccatgtggctgagaactggggccttctgggaacagaaaacaaggaactagggcttttccaacagccatgtgacccatccatgtttcatgtgaatcctcagtcccagtgaagcactcagatgatgcaggcctaggctgacaactggactgcaaccttgtgagaggccctgagcaagaagcactcagggaaacctctcctggattcctgaccattggaacctgcgggagatgatgaatatttgccattttgagctgctaagttttacataatttgttatgcaatagtaaataactaacacattttcacaaaagaggatgtagtattacacattaatttgcatttgctctaaatttatcattattattaatattattgttattgagacagggtctcgctctgtcgcccaggctggagtgcagtggcatgatcaccatgcactgcagtgtcgacttcctgggctcaagggaccctcttatctcagcgtcctgagtaactgggactacaggcatgaagcaccacgcctggctaattttctaaatttttttgtagagatgggggtttctccatgttgcccaggctgatcttcaacatctggagtcaacaaatctgccttcctctgccttccacggtgctagaatcacaggtgtgagccaccacacctggcctaaattaattataagacattacacatgtaacttagttttaaaaggtaaggagaatgtccatggctgaagaggatgcattttattaccattcacaatgatcactttacttgaacttcaatttccaactgtgtccaaattaaacacaaaaggaagatccaacccttgctgggctgattctttgatggcccccaacagccacctcccggtcattcactttcccccagttattcaagcaactctagtgtagatgctgctgtgaagggatttagcagatataactaagggcctcaattagttgactttaggctgggtttatcctgctttgactgtcctaataaggtgagtccttgaaaggtctgtgttctttctgagcatagagatttgcagtgtgagagggattcagcatgaggggtttcctctaccgtgggctttgaaaatgaagaggctgtgtaggaaagaacactgttaggcaccaggaattgagcacagccctgcctattctctgtattgacagccagcaaggaacagaaacctcagtcttacaactgccagaaactgcattctgccacctctgtataagcctgaaggaggattcaaaatgaaaacacagcttttggaagcccagaacagggattctatccacatcttgcccagatttctgaccaaggaagtataagcagataaatgggtgttgttttgccagtcgtggtagtgcacgaatgaattgatgaattgatatgcacactaattacataaaataaaatatttcttaactttttcagtattttacattttataattttctgtgatgcaatttaatagactcatatttcattcattcagtcaagaaaaattaatttaatccctacaatgaaccaggtgtgccctcatatgcttacgtgcctgacattccagaagcttcacaagaccaaggtggagccagtggaatgttttaggtggagaaatgacacactctgactcacaggagcaggaccactgtgcagagaacagtcacgtagcaggtaatgggacagtgctagtgtcacaaataaggagtgacaaggtggtggggactaaggggagaggagggcctgagggatgagaggaatggagggaagggctggagatgcaggaggtgaggaaatggagcagagggaaagaattcgaaagcagcagaactcaggtttaaacacattgttttatatattttaatacatcaatctacagagccttgcagggtgatctttgcagttggcctttaataccttatgtgggtctgcctaaaaactaatttttttatgttaatcaggtttaaaaaatactaagtgttcatataaaatatacacaacacttagaagtggatacttcctaaaaacaggcagtgcatgagcactggtgaggggcattgtgactgcattgagtgcttgccactgtgagatgaataaagtccgtactggctcctggttacaacatatagtaacacagtggctaccttgtattaggagatgtcctggactcacacagaaactcagggctatggaatgaaggtaaatttaaaatactacaagcgggagtcacagatacattgtctggraaagtgaaacttaggagctttgtgattcctgttgtaatgcttttagacacatttatatgtcaagggaccaaagtcacatttttggccvattagattcctgatcatyaggagttaccaagattctgctacccactgtagttaataaacaaaaagcaaactggtctctattctatctcatgcactcaggcacaacttttccagatttaaaaaacaaacaaacaayaacaacaaaaaaccctgtctctacacctccattcccagggcaagctcactctctggcaacaagctccctggvgtgatttttcttctagaagagtccacggggacaggtaaggagtaggaggcagggagtccagttctgggacggggattccgtgatgcaaagtgaagagagaggvacggggcccattycgagggtttctccctggtttctcagacagctcctgggccaagactcggaaackttgagacagagcgcttggcacagaagtagcggggtcagggcgaagtcccagggcctcaggcmtggctctcaggatctcaggccccaaaggcggtgtatggattggggaggcccagcgctgggsattccccatctyygcagggtttctcttctccctctcccaacctgtgtcgggtccttcttcctggmtactcaccmggctgccccagttctcactcccattgagtgtcgggttyctagagaagccaatcaatgtagccgcggtcccggttctaaagttcccacgcacccaccgggactccgattctycccagtcgccgaggatggtgtcatggcgccccgaaccctgcttctgctgctctcgggggccctggtcctgacccagacctgggcaggtgagtgcggggtcgggagggaaacggcstctgtggggagtagctagggkcctgcccggcgggggckcaggaacccggttgcggtgccgggaggagggtcgggagvgtctcagccccctccttgctcccaggcttccactccttgaggtatttccacaccaccatgtcccggcccggccgcgcggatccccgcttcctctccgtgggcgacgtggacgacacgcagtgcgtgcgsctcgacagcgacgccacgagtcccaggatggagcmggaggggccggaatattgggaagaggagacagggaccgccaaggccaaagcacagttttaccgagtgaacctgcggaccctgagcggcyactacaaccagagtgaggcctgtgagtgacaccggccgggggcgcagvtcactacccstcyacatcccccacgraccgcccgggtctccccgagtctctgggtccgagatccacgccgaggcagcggvacctggagacccttbacccgggagaggcccaggagccgttacccggtttcattttcagccaaaatccccgcaggttggtcctggcgdgggcggggctcggtgggcggggctggccgcgggggcggggccagggtctcacacccatctagaggatgtctgtctgcgacgtggggtcggacgggcgcctactccgcgggtatcaccagcttgcttacgatggcaaggatthcatcgtcctgaacgaggacctgtgctccttgacagccgcagacacggcggctcagatcacccagctcaagtgggaggcggcccggggggcggaggttcatcctcacagggataggcacctattagatgtggtgtggttttcctctctactcttagaccctcagccagtatcactattggcattcctgagccactggctcagaatttcagtacattatctgcccgcgggacacacctcagaggkaaggggatgaagcgtggkccatgaccatggmaycccctggtcttatcaccacctgcacctcccaggggctgccagccacacagagtcatggacaggtctctacagacacaacttagtgccagcttggatgaaaccctctgaggaatggstgccatctttcaggatgtggtgcatgtattgaatcaaagatgtctctatagtgctgtgtttacagaaggaagaatacgtgggtccaaaaaccaagaagtagaagcaggtgtggctccatatctaaacccttatattcaccttcagggtgattttgcacttctcatctccaatatctgggctctgtaggggaggaggtcctggtttcccaaagggggcaccctggcaaggagacatttaaatgagagtccatggaaytayacyttatggctgcccccagggatgtttgaatagtatgtgtccagayacaagmaggtgagaagaggaggaggcagggctgctatcacacaaggagggcaggagatgtgtgtgtggaaataagagatccacttggagaccttatggttccccttgtcctgttgtaagtgtgagcagaatcatccagcaacccagcctgagagggtttcatattcaagagcccagaaccctcaggaaggaaggattgagygatactcayaggtaatgtcccaaggctgtgctcctgtgctctgacatcctcagcaggattggtgcaaagccctgcttcccatgggctgttcccagccagtgactggtcacagcaggcdttaaggcaagccattcctgggagacacgggactcctctgatggcyaactgtagctggaagdctcctccacggccttgctcaactctccttagattgcctgtgctctaggatgcgtcdaacaaactttctctccttctgtccagcacttggggtcacacttgcatcgtggtctgccgccttttccagggatttctggctcacttcccatattcccttacgggtgtgtcccctyataagatgtcgcagactttaagctcatcttggcatctgctccttgaaggacttggactaaaaattatttccatctgcatatcaataactcttattccaacctgtaaaatccttctctttatccaacttctgccacccccacagaatctattttacttgtgtgtgtagtatctctttgagttaacagatatttgttctattaagctactaaattttgaggtagtttgtgacacagcactwgataactattaaggctttcttaagtttccattattccatggatattatctacatatcttttaatcccttgcattttaataacattagctatacttgctgtttccaactctttcctcctatttttgaacattttaaattttgtctttctctgtccttccttccttctttcctcctttcctccctcagagctttctccctccctccatttttttcataaactccaagtgtttaggccaaaaggaagcattatttgaactttatgctaaaagtataatgccgtaatttataatataaaagtaaagaaaaggaagttgttaatggaatatgaaaaaatgcctagggtgattctatagccaagacagtaccttttaacatttaatttctgcctccaactgaatgttttcagaacacatgagcaacacaagctctttcccattcttggtacaagcacttgagaaatcaaattagccttatctagtatgattaatgtccatacatcatataatcccaccatctgcctcctgatcataccccctggggacattcttggctatgtgtccaggagacatgtacaccaatgtttatggcaaaaactrgaaacaatcacatatacatcaatgggaattaacaaaattgtcgtataataataaaaagtaaaacttcagcagcaacagtgaatgaacagcaccctcccacatcagagataactctcctacacataacatgcatcagcatcacagaagaatgcacattgtgtgagttctctgtacggggaagtttaaaaaagcaggtcaaactgtgatttggatatatatatacttattgtaaaaatctttagagacaatgaaaaggaatagtaaatacaagactcaagatagaagttccttttggggaatagaattggacaacagccgagggtggcttcataggttttgttttttatgccaggaggggatgtccaggtagttaagttacttgatcataaatctttatttatttatttatttatttattttcgagatggagtctccctcttgttgcccaggctggagtgcagtggcgtgatctcagttcactgcaacctccgcctcccaggttcaagcaattctcctacctcagcctcctgagtagctggaattataggcatccaccacgacacccaggtaatttttgtatttttagtagagacrgggtttcaccatattgtccaggttggtctcaaactcctgacctcaggtgatccrccaacttcggccttccaaagtgctgggattacagacatgagccaccattccyggcccacaaatctttaaagtgtcatttttcaaaatgcaccttgtgygccattcctgactgattatttggaaatgaaagagaaaagaaaataccaaagttcatctcaaggatccttagcaataactacacacgttaaaacaaagccacagccaattgtaaagagtcatgtgacagagaggaccagratctcatgaaaaatagccttggctagaaagaggtcatttgaccctgggctaattggcaactctctacattgtctggcatacagtgttcaatctgatgtgcaaggcaattgtatcttgcaaagaatttgagaatktgatatgttgctcacattttaccacacatacaagtggattaaacttttacacagtaaaaaaaaaaagcattgttgagcaaaataaattaaatgaaaagacataaaggaataactagtgatgaaatagcaataagaatggaaaacatgaaagagatgcttgtacagcaatgatagcagcacaaaagaacagtgtttttcagaatcatactggagtccaaatcacttctaccacatctaattaaaaaacacagtgaaagatgttaaactttcataggatgcccactgaatagccagttattgaaaaatcttgttcctagattggagtaaacaatttctgcytaccctagccaaacaaattattgtcatgatgctaagctagtgtatagacagaggtgtgagattcacatttttctarctgcaaagcaccctgattaggcaaatatttttgtagatgcttgagtaagaaaattggcattttgggcattcttaaaccgaattagaaacttctgaagagaaacaaacrtagttaygattgtaaaggcattattgtatggcaccaaagtcttgggacactttaatttagctactgtattttctcaactctgttgcaacttatcaaagagaatattaatattaaaggcatttacaaaaaaaatctgagatattgttgtatcttctttctctgtctcaaatatttaatcaactttacagaagagaattttaaagtattaaaaaaagtcagatacaagaagtatttgatttacaaaaccctgaaacaataatgttaattttgcttttaacatgtttataaattctttgatactcctcctttccagaagtgcagcttcattccctccctgttcgtgtrgcctggacttaatgactcacttctaactgatagagtaatgctgacwtaatagtttgtgattctgggtgtagaacataagactcacygaagtttctactttggttctttctttctctggaatcatgagccctgggggaagctggctgttgtgtcataaggaggcctgtggtccatgtgactaggaagtgagtcctcctgggaccagacaataagaagctaaagcctcttccaaaagccatgtgagagattcttgtgtcttgtgaatccctggccccatttgagccctcagrtgattcagccctggaagacaactagactgcaacrttgtgagaggccctgagccagaagcattcagagaaacttctcctggattcctgaccatggataactgtgggagatgataaatatttgttgatttgagctgctaagttgtaggtgacttgttatgcagcagtagataactaatacagcttcacaagagaggatgaatcactgaactttttcatttgctctaaattcattataagatattaaacatgtcatttgcttttaatatttaataaaaatttccatggctatataagatatattttattatcattaacaatgatctattttttgatcttcaacttgtatgttctatttaaacatgaaaggaagatccaggctatgctaggctgattctatgatgacaccccaataaccacccttggttwctcaggttaccccagttactcagttgacactaaagcaggtgctgctgtgaagaggttttgcagatatatttaaagtccccagtcagttgactttaagatgaggattatcctgcttagacggtcctaatcaggtaagctctgaaaaggactgggttyttcctgagaatagagactcacagtgtgagagggattcagcgtgaggggcttcctccactttgggctttgaaaatggagggatcatggggaaagaacactggtggccaataggaattagaagccctccccactgtctactctgatagcccgaaggaaacagggaccttaatcctacaattgccagaaaccgaattctgccaacaaactctrcacaagcttgggggagaaccccaatcttaagatgaggatacarctttgcgaaactctgaacaaagagtctatcacrttaggcctggatttctgatgaaggaaatgtagacaaataaatgggtgctgttttcagccactaagtttgtggtaattggttatgtactgccaggaaataaataaacagattcaaaggataagtatatgacattttctccaccggaatgaattcatgaactgatatgcatagtagttgcataaaaccaaatatttcctaacttgctttgcattttccatttcatgatttttgtgtgatacaattttgaacacaattatatttcattcattcattcaacaaaaattaacttagtgcctactatgtggcagatatacttttatattctgtagatacaactttgatcaaarcaacccaaagcccctgtgcttgtgccttccattctagaggcttcttgagagtaagatggagccattagaggcttttaagtgaagaaatgamacaatctgactcacattagcaggattgctgacctttgtggggagaacagtcatgggcagcaggcragggacagagctagggmcacaattcagtagtgacagagtagtagagactaaggggagaggagggcctgaaggatgacaggracagagagaagggctggagaagcaggaggtgaggtaaaggaacagagagaaagaattctaaagcaatggaattctcagacttaaatacagtgttttatagatttttaatgcatttatccgcaaagcctggcacagtgttacttgcaccttggtctttaatgcattctgtggggctgtctaaaasctaattgcctctctaagataaaaaggttaaaaaaggccgggcrcggtggctcacgcctgtaatcccagcactttgggaggccgaggcgcgtggatcacaaggtcaggagatcgagaccatcctagctaacatggtgaaaccccgtctctaataaaaaattacaaaaaaattagccgggcgtggtggcggtcgcctgtagtcccagctacttgggaggctgaggcaggagaacggcgtgaacccgggaggcggtgcttgcagtgagcgagattgcaccactgcactccagcctgggcgacagagcgagactccgtctcaaaaaaaaaaaaaaaggttaaaaaagaataccaaatgtctcaataaaatatacacatagcttagatgtgaataattcataataataggcaagtgcatgggccggccattatagctcatgcctgtaataccagcattttgggaggctgaggcgggaggattgcttgagcccaggagttcaagaccagccagagcaatttagggagacctcatctctacaaatattatttttagaaaaattagccaggagtggtggcacaagcctgtggtgccagctacttgggaggctgagggaggagcattgatcacatgagccaaggaggtmgaggcttcagtgagtcatgagcgtgccactgcactttagccagggtaacagagtgacgmcctgtctgtaaataaataaaaaataaaaaaattaataataaagggagtgcatgagcactggcgaagggcactttggctgcattaagcacttgcaattctgaggtaattaaattctgtacaggctcctggttgcaatatacggtaatacattgtgctttgtattgagatgtcctggactcgcacacacaaactcagagctatgaaataaagatactgtaaaaatacaacagaccagagtcacagatacacagtctrggaaagtaaaacttcactttgtgagtctaattgcaatgcgtttagacatatttatatatartggggccaaaaatcatctcttttacaaattagattcgtgaccattcaggggctaccaagattgtgctacccactgtagcacaatcggagacccacsccgaggctgcgrgactcgtggagaccctcgacacaagaaccccaggtgcctatacccgattccattttcagttcaggcccaaatccccgggggattgatcggggcagaggaggagctcagtggctgaggctgaccgcgggcttggggacagggtctcccacctccagtggatacacagctgcgacctggacccggaccggagcctcttcgcgcggggatgaacataccctacgatggcgccagttacctcgtcctaaaccaggaactgctctcttggaccgcagcggahaaggcggctcagatgttytggaggaggaacatgcagagctgctcaaaacctacctgccsggaaggtgggcggagtggctcagcaaaggccttaagaatgagaaggagagbctgcaatgcgcaggtaccagaggccacgggkcgcytccctgatctcctgcagatatccctgagccaycttccaaaagaaggggaggaaaatgggaccaacgctaaaatatccctctccctcttgtcctgaggcagaagagtcctcctgggtttctaaatcctataccagagagtgactgagggcccgccctgcactctgggacaattaacggatgaagtctctgcgggaaaggaggggaagacaatccctggaatactgatacgcggtmccctttgaccccccagcagccttgggcaccaggaattttcctctcaggccttgttctctgcctcatactcaatgygtgtgggggtctgattccagstcttctgagtccctcggcctccactcaggtcaggaccagaaatctctgtttccgcctcagacactagaactttccaaggaataagagattatcccaggtgcctgtgtccagaatgytgtctgggttctgtgctcccttccccaccccagdtgtcccdtccattctcaggatggtcacatgggtgctgtgtctcatgaggaatgcaaagtgcctgaattttctacctcttgccctcagatcccctgaaggcacaggtaacccwccaccccatctccaactatgaggccacgctgaggtgctgggccctgggcttctaccctctggagrtcacactgacccagragcsggatggggaggaccaaattcaggatgcagagtttgtggagaccagacttgcagggtacagaaccttccagaagtgggcagctgcagtggtgtcttctggagagaagcagaggtacacatgccatgtgcagcaygaggggttgcctgagcccctcacactaagatggggtaaggagacgaatgagvggtcatgtctcttctcaggcaaagcagaagtccttctggagcctttaagcagggtcrgggctgaggcctgggggtcagggcccctcacgttcacctcctttcttagagctgtcttcccagcccatcatccccgttgtgggcatcattgctggcctggttcttcthgttgctgtawtcactgtagctgtrgtcgctgctgtgatgtggaggaataagatcccaggyaggaaaggggtgagctctgagtttccttcttccattggtggatttcaagccccaggtaggagtwggctcatatcttgcctagttgtgaggcaccatctccacacacatttaccctgttcagaggccctgtctatcaacvcttactcttttgtaaagcacytgtgaaaatgaaggacaaatttatcaccttgattgtggtcatgggaacctgactcccagcartcacaggtcaggggaaggtccctgctgaggacagacctcaggaggacaaytggtccagcctcaacacatcctcttccctygggttttctgatcctgacctgggtctgtagtcacagttctggaaactyctytaggatctcatgccctgcctcctccctggcctctcacagtttgttttctttccacagatggaaaaggaggcagttatgctcaggcttcatgtaagtgtggtagkggtgggaagagtgatccctgagatccttgggatagtgtagacaggagcccatgggggagctcagccaccccaaaattcctcctttagtcacatcacctgtgggctctgaccagattttgtttttgttccaccccaaacaggaasagtacccagggctctgatgtgtctctcahggcttgtaaaagtgacaccttagagggcctgaagtgaaagaggagttgggcagaggggacacaactargctctggagattctttgatttggaatttttcaaggtgtggtgggctgttcagtgtcacaacttactrtgactgacctggattagtttatgactatgttttttctaagattgccttgtgagggactgagatgcaagatttgttcatgcctcctctttgtgacattaagdgcctctggcttctctttctgccaaagcvtctgaatgtgtctatgtctacagtaacaggtaagaaatgggagaccagcccatcctcatgtccaccatgacccctgatattgtttggatctgtgtccccacmcaaatctcatgttcaattgtaatccctaattttggaggtggtgtctggtggcaggtgatcggctcatgaggatggatccttcatgaacggtttagaaccatctctttggtgctattcttgtgataattctcataagatctggtgtttaaaaatctgtgtcacctccctgctctctctccctcctgctccaggcatgtaagtaatrtctgcttccccttagccttccagcataatcgaaagttccctgaggccctctcataagatgagcagatgccagaatcatactttctgtatagcctgcagaaccatgacccaatttaaacctcttttctgtttttgttttgtttttgttttttgaaggaaaatttatattattttaattatttttacatacagaaaactcaacagcatacatttcacccaattyagtggcatgttctttaccctttgcctttttgagcttggcaatgcaaaccacatacttgagacccaggacactgtctccccagtgayggcggatctcatcvtatctgtcattgtaattggtcctgagaactyccaccagcttagccaaagcacctttgtcttccgagttaacctgtgtgaaggtgacagtggtgcaggtcttcctatggactagatgtcccagtcttgccttccctttgataatgcagtaagggaccccattttatgacacaggacaggcaagaagacaaccagcttgatgggatctacatcatgtgcwatcaccaccagctgagctttcttgttctccaccaaggtggygatggtgttaactcctgctcgaaggacaggtggactcttagtggggaatgtcccctttgccagcagctttcttcttggcccvggccaacagcctctgcttcttctcttggtttgtctctggtctgtattgtgggccagcttaagcagcagagtagctgtttggctgtctggtgcctgggtgaactggttaatctcaggaggcactttcagccacttatagaggatggttctctgctgctgcaacctgatatagcagggccatttcacaaagtgggtgaggtstcttttgggctggatatcctgtccagtgccaadattcttaggccttttctcaaacaagggatttaccactttcttggcctcctgcttcttcacgacagcaggggctggagccaccttcttctccttggccttctttccttttggcatcttggatggtgggaggagaaagaaagaaacctattttstttataaattacccagtctcaggtatttctttataaaagtgtgagaatgaactaattcagaaaatcggtaccdggagttgggtattactataaaaattsttgaaaatgtggaaacdgctttggaactgggtaacaggcagaggttggaagagtttggagagttcagaagacaagaaaatgggggaaaatttgcaacttcctagagatttgttaagctgttgtgaccaaaatgctgatagtgatatggacaatdgagtccaggctgataaggtctcacatggagatgaggaayttattgggacctagaggaaaggtcacttttgttatgcattggcaaakaacttggaggcattgttccccctccctagggatctgtagaactttgaacttgagagtgatgtataagggtatctggtggaagaaatttctaagcagcawagcattccagatttggcctgcctgcttgtaatagcctatgcacatatgtgtgagcaaagacatgacctgaaactggaactgatatttaaaggggaaatttaatatccaggacaattcctagtggagctgcaggaacaggacccctgccaagactactaaatcatagagccactggcaatatgcaagctcagcctggaaaagccataagcattcaatgttcacccatgagagcagctatatggattatgttcaccaaagccacggatatgaggctgaagatggcattgtgagtccattgcttgcascagccagtgtgctcagggttcaagatatagagtcaaaggagattattttagagctttaagttttaatgtctgccatgatgagtttcaaccttgtgaggacactgcattcatttcttttggyccatttatttcttttggaatggaaatgtataggaaatgtctctaccactgttgtattaatattttagaagtaaataactttttttaattttacaggtgcacagctataagaacttaccttgagtctcagatgagactttggaatttagagttgatgctggatcaacccaacacattttggacaattgggagaagattattgtcttttgcaatgtgagaagaatgtgagctttggctggctagggacaggatgcaatgatataaatatttatccccagatacctcatgttaaaatctgatccccaatgttggacttagggcctaatgggtggcgtttgggtcttgggggccaatcttttatgaacagagagatactgccctctctcgggagtcaatgaattgttgccctattagtttccaaaagagctagttgttaaaagagtctcgcaccttcctactccctctgttcctctctkaccacgtgacttytgcacataccagctcccctttgccttctgccatgagtggaagcagcctgaggccctcgctaaatgctcaaacatttccagacatcagaatcctgagccaaatgaaccttgtttatataaattagtcagtctcagacatttctttatagcaacacaaaayggaataagacaaccctctcatcatagstatgtgtctgtggcagycagcccccattctcaaggtatccaggatccwctcagccaagagtcctttcctcagtattctaaagacactctaatcactcaagagattctaaggtttwtaggagaaacsagggacaaractaaatgtttttgtgataactcatattayccccttttctttgaccacatatttttcatacgaaaaggattataacagtaaagaagcattggcatattatccaagtctcattcggtcattcaaaattaggccagtttatcatcctcttgtatgaatatgtctcccagaatgacatcactcagctttgcagacaccaytcaatcttawcaggttccaaaaacaagaatggtctcagggacayacagcttcacccttttaggcatccagtatagttgacctaagagacaacatctcttgctcacaccacttttgaggagataagctaatattgaattttcctcattacataaccctttgatttattcacctaccctcagccactattcctccttctgtccctttatatcagtcttttccagttctagaagtgacattaggtttggctgctgtgctggcctagactgcatgcagcaayagtattctaccatgtcttctcttaatctactcttgatcatagacrgtaggttacataggttaggaactagtgcaggctatctgaccaccagtctacgtagctctacttacagttaatcccgactttgccagatgaaatgaaggcacagcgcaatccttgatttgcttgggaattcttacataaaggtataaaaatatagttatggttttttccttagggataattcctgtttctggcagttcgatttgcatccctgttcctggtaccactgcaccctgtgtaaaaaaagaaataagaaatgaagtgtagtcattattccagcatcctccccttaagaagaattgtatgtacagtcataacagcatcaccctgatccatcaggaaaaagagaggaagctacctagtggagtcagtttcgcagctccacccatgttgacagtaagcacattcatgaagatataaaagccagtccttcatgtttatattgcccaacaattatattggcagtttttagacaattagacaaccaatgtttcaactgactatttctttttttttttttttttgagatggagtctcactctgtcgcccaggctggagtgcagtagtatgatctcggctcatgcaacctctgcctcccaggttcaagcaattctactgtctcarcctcccragtagctggtaatacaggcgcccaccaccacacgcagctaatttttgtattttcagtagagacrgggtttcaccatattggccaggatagtctcaaactcctaaactcaggtgatccgcccgcctcggccaccaaaagtgctgggattacaggcatgagccaccgcgcctggtcagccatttcaatattctatcaaagtttcccctgaatagtacatttccctgtgcaytgttggctttttaaggctgtaaagtgtgttttcttgtgtaaagaaatgtgactcaacagtccaaattggtgtaatctccatttttctggttcttgtatagcctttgaagcattgacatctacccctggttgawcatagcccaatccagagtcagtgacttccctgtcaagatccattggcagctcctttggggttgctggcattagtctggcttgccagctatgaatgatcaaagcttcccactacagaatctgtcacagagctgcctctgtctgttttcttgaccaaaagtcaaaacagacagtatgagaaatgagataaattaccaaaattgtgaacacaagagagagtatcactaatgaccctttagaagttaaaaawcattataagttaatactctgaaaaacctgaagccaatcagttagaccacttagataaaatggacagatttatacaaagatagaaattgctgaaactgactcaaaaataratagaaaatctgaagagaactgtacactaagacagtaattttaaaaccttctcacaaagaaatgccaaagcccagatatcttcactggtgaattctatcaaatatttcaaaagctctttcagacaagaagagaggaggcaagactttctagctcatttacagaactgacattaccctaatatcaaagtcagagcaagactgacaagaaaagaataccatagaccagtgtcaccaataaacataaatgaaaacatccttaacaaacattggcagacaatagaaagccacgtaaaaaaggattacattccatgaccartgggattcatcccaggaatatatggctggattaacaattagaaatcaattaatggaatgcactgtagtaagggaataaaagacataattatctcaaaagatacagaagaaacagttgacaaaaatgttaacaccactcatgttcataagtttcaacaaaataggaatggaggggaccttcctcaccctgataaagggcatctataaaaaacccacaactaaaatcatgcttgctgaagaaakactgaatgcttttctcctaagatggagatcaatgcaaggatgtccmatccaacacttctayttaacattgtactggagattgcagctggtgcaataaggcaaataattaaaagttaaaggcatccagataaaaaggaaaacataaaactctattcacagataacatgaccttgtctgtagaattcacaagcagataaaagcctgctagcactaaaaaatgaatccagaagctcccataggatataaamtcaaattaaaaattattaacatatttctctatacaagcaattaaaatctaaactttcctatcacagtagttacaaaaagagagaaataggaataaatttaggaagacagcagagtttgttgaaaactacaaaacattactgagagaaattaaaggtctaaattcatggakagatgcggttggaaagctcaataatattgttaagatgrcaattctccaccaagagatctataggttcwgtacaatctctatcaaaaccccagcaggcattttatggaaaattgacaatttaatcctaaaaatgtatgtgaaaatgcagaggatgcagaaaagccaacgcaaatttgaaaaaaaatggaatgtcatataaaactacaataatccagacagtgtgaaagcgagagacacagagattaatgaacagaagtgagaatctagaaagacattcttacatttttttgtcaattgatcttcaatgaagttgcataggtaatatgatgtgacacttatcgccatataaaatataagctcaaacaaattagagacctaaacagctaaaatttrtaagttaaaaccataaaatttctaaaagaaaatataggagaaaatttttgtgacattgagtagttaggcaaaagattcttacataaaatacaaaaaacatgatctacagatgaaaaaaaagtgagagacaaattgggcttagttaaaatttaaaacttaagtrctccaaaagacaatattgagaaaatgagaagacaagccgtagattgagagaaaatatttcacaatttatcacaaattacatctgtgatgaagaacatgtatccagaatatgtgaaaagttcttaaactcaatgtaagaagatgagcaactcaactaaaaatgagcaaaacatgctcaactgacttttacaaaagcacaaaagcaattcaatgaaggaaggagagctttyccatcaaatggtgatggaacaactggacaaccacagtggaaaaaaaataacctgagccaaaacytcatgcttcatacaaaaataactcaaartgagtcacaagctttcatgtaaagcacagagttaaaatggcaaacattgagccaggtgtggtatcacaggcctgtactctcagctactcaggaagctgaggtgggaggatcccttgagcccaggagttcaaggccagcctaggcaagaattttttttctaaaataaataataaatttaaatttttaaattacaarccttttaagaaaaagtcatcagagctaagactggacaaagagttcttaracataacaccaaaagtatgatccataaaagttaataaattggatcttatcaacactaaaaactgttgttctgtgagagacctatgaagagcataaaaagacaagctacagaatgagagaagatatttgcaggcaacatattmtgtaaagactgtattcagaatatatgaagaaattttaaacaacaataaaaatgaaatccaaatacaaaacaggcaatgagcaagacaygaacagacatttcactgaagaggataaatactgggctaataagcagatgaataggtgctcaacatcattatccagtaggaaaatacaaattaaaaccacagtgatgagaatggctgaaatacaaaataaaggtagcaacagatgctggcaaggacgcagaggaactgggacactcttatattgctggtagggatgtattttaaaatggtacagccrctctggaaatgagtattgyagttttcttcaaaccgaacatgcaatttaccttatgactagcaattgccctcctaggcacttatttcaaacragggaatactttatgttcacgaaaatcctgtgcacaaatactcttgcagctttattcatgatacccccaaacaggaattaatacaactgtctttccgtaggtgagtgagatctgctggttgaaatmataactgagtcacacaagtgccctttctcaaggctaccatcctgcttctctgtgcagtaagkgtyttatgcatatttcccattttctcacaaagaatattaaagacgtatactcaaggatcaaactttaayccacataaattttttactgctccatcaaagacactcttaaaygggactgcagtttggagccactgcctggttctgctkaggtgctgggtgtgytaccgaccttggcatttgcagcactaatggaaaagtcaacacaatgaaacaggcagatggcatcttggtattactgtgaaaacaagyctgcctccaggactctctgaaggctgctcaggggacacactttcaaaatggcaaagatcaattatggttcctagtgggacacaacccctagcctattcctattcagcactgtcttgctctctattttccctcattcttccaacttataactgtataaattttcaaatgtgcaaagaagctgaaagaayggtgcrgtaaaattcaagytaccactctgccgtatttggttaatatctctttatatacataaaaggagagtgtgaaatgatggaccatggagacccagaagggtaagggggttggcagttggtgtataatagaggggtttcttgatkggtacaatgtgcttgtctccagtgctggatgctctgaaggccctgactttaccacaaccaatatagcaatgtagcaaaattgcacttgtgcctcatgaatatatatgaatytaagaaataaaaaataaaataacataacatgtytctttatagatacaggtagacatgtttgtatagcatgtgtgtgaatgtgtgtgtgtgcckgtgtgtgtgtccdcctgtgtgtgtgtktccgtgtagagaggcagcacaaattaagagattaagattttgtgactgagctattccaaagtaacttaaacataaaacacacatggataaatgtgtctgtgacaacaaacctgaatacaaacatgaaataatatgtctataaacacatctctagatagatagcttatgaatgaattccctaccccagctcccttactggttgccctgtgaacacavggagtcagggaacaggacccagctagggtccctcatccttctcttgcatccaggcaggtcctgcatccactctggctgcacagaaggctcccatccctgccttggtctgtttcacaggtgctcccctaactctctctgccaccactgctttatctggatggagctgaggctgccctgaccaagaacagcaccacccatctgtgtccccaagaccaggaagttaggaggaaccacacaacaaggtcaggaactatcccacctccccartcagtctgaactgatggcgggagatgctgatgcttgctttactcatcctcaatcccagctcacttattcttcattaattcaatccaatctccccagcagtcacttcaccccagaagctgactgacctctactcttcgtaatcaggaaaccacaaagcactctccgtcccctccctgatatcacccttcagctctacatcatcatatgtgggctctaactctgcagggaagatgttgccccacagggtcagcccctgaacactggctgcaaatgtccccccatcccttcccagccctttcggtgttgctgtgaatctgtccctcactgagaactggyggggagatgtgggggaggagggdagvtttctttatgctgtgtcaaagcatggagacagacctctccttctctcctgaacctcacactatcccttcccagacacttgaaataaaacgcagaccagaaatgtctatttaagagttaaatatctatagtataaaatatgaagacagagtagaatggggtaatgcaggagagcatgacagagatgacaggacctcaaggtgccaggaaagctggtgctgggccaggaccaaggagccatcagcaggacactcactcataawgctcacctataataatacaattactgcatatgtaatatatcaaaatataataaaataacaaaataacaaaaataatatggcacagctgcaaataccccatatatactaacccttttcattcatccaaccacaagaaataaatgctcgtagtttccccatgtcatagatgaggaaaatgaggcacaaagagagaacatgctggtgaggcctaggcaaggagttgaatccagaycgcctgrctgcagagtctagttgccctcagtggagccagcgaacccaggagctgacaccagagactgagatctcagctgtgcactgccctggtggtctcctgtcccaaccaggtgttgacccaggccttgcaggctcacgcgctctggaaaaaagagagaaaccaataaatgctcccctgggtgcagagtgctgctttttattycctgaggagttctccctcctcagtcactcccaaatcagatttaccctttctctgacggaagatgacgtccccacttttttctccctcccatsgcacttttccagcccctgccagtcccctcccgtgactccatcaacatcagcacctgccctgtgtccaccatccattktgcagtgagtgaaaggacccaggactaaggaacaagacccavgaggaaactcagtgccctttcctcctcctctcaagcctgaccagccctgacacagtgagaggcctccccaaagagaggccctggccctgtctccatgtccttccaggtctgggccaagtcacacacagtccttctcttcctgagaccccaggccctcttcacctgcagaggcacctgcataccagggcaggccctgcacrctgtgggttctgccctccaccagcagctcactgttcctcccctcccagctctgagcagacagctcctaacwagagatmcyatcaggaagccctggggctcacaggcccbgcatggaaatatgtggctgccatggagtctgcacctgacctgatgctggggacccccttgctcaaggaggcccagcctgccctccccataacctgcatttgggctgtgcttgctcctgcctgtccactcaaccctggaaatgcagctccaccccagggctgctgcttggtgaggctgcaagcccttcctgtcccattcctaacagggattccacccaggccactgccatcgcagctcacaggggatcttcttcgcctgtggagtagggggtttcttcagacccctcatcctgaggctgcctctacgcaccctctgcacctggggattgccactgccacaggcactgtctcccacatggaccctctgagaaacgaagccccaaatttgacttcctgttctattcaacatcctttacaacatcagtdttggvggaaatcctattaagattatccagctgaaattatgttgatgbacaccaatacttaaagcaggaattttgagaaactaacatgtaattttcatgcctttttctvgccaatgtcccagtgacctacgagaaaaccwttcctgcctacagggaaccagaactgacaatccctctataggagacaccgcaggtgagagcaggagcaaccacagacctgcactgcccgygctgtggttgcctcctggacggggccctcttgctgcagggcaggggatgaaccgtcccatctgcccaggcctgagtggccaactaactgtgcaattaggttcaaggatgagtcaccaccacctcactggccagacacacggaagtggagaaatggcagaaagactcgggtttcctggacaccycagactctcactgtcccctgcactgcctctgtctttgcagaaactcaaaactttctgcttgctcttttcctctcccctcaaacaacctgactgtgggggahatgattctgactgtctcttattbtaaacttaccaggcagygactacactaagaacaaaaamattggctcaggaaaggcaaggtgaggccacagagcacagaacaaagcccaaaaaacagcccactgggtactatgaccctcgggggctggaaaaagtaacacctggacatgggatgaaaacagggaccacagctgccctgacagagggctggtccccactccccaaatagcccagggacatctgcttatcaactggtccatattatctgcaaggaaacacagggagacaggggccatatggtgggaacccagaaaaagcacggtctcgagggacccagaggacgtgacacccctgagacagctcccagatgaggcatatggggagctgcaaagtggacagaggatggccatgtgcactcaggactctccctgttacaaggggacctcaaaggggctgtacacatgggggccctcattctgggyctcgtgggtctttttcttgatgtcctcctgatggctggagaaacaggggagggggatgcagaraggaagggactagaggcaccacctctccttggattcctctccagtttctagccctccctagatcacatctgcctttactatttgctccctctgagatagygatcatccaggccctcagcaatcagcacgcaattcccaactcacccacctggatgcracctggtaagcctgagagacagagaccgggatggggacaaagcaggcaccacggccctccctgctgcccactcctcacctgcagcaggaggaggcyacagctggatgttcgagggccttggcycagccctggcttgggcaggacttaagggtgtaaaaaataacctacatgtgatggytcattttcaattctatgtgccttagtataggtttaagcaggccacatggtcataaagagataaagaaggaaaatgtactaagccaccatcccccctacttcttgctttccctttcatgcactggccaggcacctatcggttggggccccctcaacgaccccttccccacctcaccaaaaaatgtagtttaggctarcttgcaacatagataattgtaccctttcttatcaactaagtgcagccattagggacataagtcaaatgtttaaagagtcctgagacaatcacaatgcattatgggctgcaacaaaatgcagcaaaaaaaaamaaaaccctaaggaacatactwgaagtcttaaactaccaataggtgacatccgggaagatcgtaagtccttggtactcagctaatgagcaactgggggagggagttgmgcactagggaataaattgttgaaactctccctggtgtgcctgcattccagacacccaatattgcaaaaccgtcactracactctcacttttgctgttctctgggtctcagagtccattctttgggtttggatgggtgcgtttgtttctcataatctagttgcctatatggggatctctgtgcttgygtgaagtgagtgagactctgcctgaaaggagaaacacrtaccaattgattcatgtggcccattctatctggatgtcctggctcctcgcagaagccatagacaaacttgaaactgttattcaggacacaatgaaagtgacatgggggtacgggagggtggggtggaaagygggcaccacagcaaccaggcaacctcatgtgtcttgtggaaggcactgaaagtactgtgggggtcacatcaccatgagagagctgaaggatgtggggtggtgttggggctgtctatcgtctctacgtaatccagcaaactgtccctgagggagcctgatgakgcctaaagaatgaatgagattactctaggtatggccaagtaggagttataattgcagcttttatgttgtctggatatcactggtagagcagattaataaatccttgggcccacagtgtgcagctgcagacttggtgagtgcattcctttccactccaattagaaaggggatatggaatgattcacattcatgtgggatccacaacacatttatttatcatttgcctcagggctattgtaactcctctgcccgctatagtatatagtcttaagactacactagacatactggatatcctataggatattaaatcagctcatttcattgacaatttcatgtttactggggtggatgagcagcaggtagaaastgcactggagtccttggcaaaacaagcacactccagaaggtgaaggtaaaccttacagagcttcaagagtggccactgaagtgaagttttatgggtgaacaagtgccaagtgtttaggggaatgyaggtgtgtcccctccaaggtaaaagacaaactgtttcatcttgcatcctcaccagaaggaaggaagcacactgcctgatgagcctctttgagttctgatgacaccacattccacatttaggtgtgttgctttggcccacactctaggtgacataggaggaggccaccttcatgtggggcccacacaggaaaggaccytgyagcagatccaggccatggtacaagcagccagcatccctcagaccccttggggctggtggtgccagtggtggggaaagatgcaggatggagctgaaccaagcaccagtgggagagtcacaatgragggcctgggattctggagtaagatcatrtcatccacagcagagacatatgccccctgttagaagcaacatttagtgttacttgtmctgatttgatagaatgcttgaccawgrgacaccaaacaacaatgtggttccaagtggctgtgtgacccacaaagtcataaattgcacaggcccaacagcattcatcaacaggtgaaaatggtccacctggrttgagcttgaatcccwygytkacacccacagaaaacacccaagtgtgawgtggcactgaacwaccaaacagacaaatggcagttagccagccttcaccatgggtcagcccaggcctggtaggatgggtgcatgaatggagcaaccacagtggcaggcatgaggctatgtatgrggccagcagcastgactctcccagccctaccaaggtagatccagctactgccactcctgaatgtcaactcgtcagcatttggagcccatgatgtgccctagtggggcrctatttctttmggcgaccagccactaagtaacaagtgactacatttagctacttccatcctggaagggccagaggttcatcttcacagaaataggcycatattccatgggtgggttttcctgtcttgctctgacactcagccagcaccactctccgggtgctgttgacattcctgatctgcaggctaggcggtgctcctagcccattctctgcctgaaggacccatttggcctggaaagttttaawgtttccatggctgtgggttccactaatcctatcaccatctgcaccacccaggagctaccagccacaaggaatgctggacaggtcttctataggcacaactcagtgccagcctggaggaagcactctgaragtgccatctttcagaacatggtayattgtttgaatcagagatgtctctatggtgctgtgttctcaatggaagaacatgtrggtccagaaatcaaaaggtggaagcaggtatggctccatgtccaatctcttagattcayccactaaggtattttgccttttttatstcccaacaatgggctgtgcgggttaggaggtcctggtttccaaaggagggtacccttaaaagtagacaaaagagagcccattgaactacacattaytttagtcaccagagaagtttggagagcatgttcccagagaccacatcgtgagaagaggagtgtccttctctccaggcccaggtaataggccctcatccccaggaggaggcatggctrctttcacacaatgagggcagaagtgtgtgtggaaaccagacatccacctgggaaccttctgggtccccttgccccattgtaagtgtgagcagaatcatccagmaatttagcytgagaggatttgatttccaagaacccagacccatctgggcagcaggtttgagtcacactcctgggtaatctcccaaggccctgctcctgtgctctgacatcctcagtagcattggtatggaggccctgcttcccatgggctgttcccagtcagtgatggctcacaccagtgacactaaggcaggacattcctgggagacaggggactcctctgayggccaatggtggctccgggtctyctccatggccttgctcaactctccttagattgcctgtggtctaggaaacatccagtaaaccttctctccttctgtccatcactgggggtcacacttgcatctcggcctgttgcctttcccagggtaacctgactccctcacaatatcgtctgacaggtatgtcccctaataaaatgytgtaactttaaycccatgatggcacttgctttttggaggatttggactacaaaatcattttcatctrcacaccagtgtcctcttattccaatttgtaaaatccttttgtttattcaacttcttctacttgcgttggctccattttgctggtatttgtattatgtttttgagttcgtcaatgtttgttgatttaatcactaaatttgggggtagtttgttatgcggcaatggataactaatgaagccctcttacatttccattattctatacaggttacgtacatctgctttatttccttccattttcataayaytggccatacgtagggtttctagtttctcaacgtgtattcttttctttattttagtttcttttcttttttgttccttccctttctccttccttctgtccctccctccctctctttcttctctatttccattcaacctctcgccttccctcctttttactctgctttccttcccttttcttccccttccccttccttcttttcttctttcactccttcttctcttcctccttctttccctcccttcctccattttttcctttttattatgaaaatttcctaacatataaaataaccctatgtgattgtgctataagtaagcattttctgaatctgtatgycaaaagtacaatgccacggtatatgagaaacaagtaaacaacagaaagttattgacagaatctaaataaaaatgcctgctataattctgcagccaagacagyggctttcaactcaattccttcaactcartgttttcagaacacatcatcaacatcaagtattayrcacttatttcaaaagtttargccaggcgtggtggttcacgcctgtaatcccagcactttggkaggctgaggtgggtggaccacctgaggtcaggagttcaagaccagtctggctaacatggtaaaaccccrttgtcgcaatcggttactatgggatataatgaagggggatgaacacagaaataaagacaaagacaaaaagatctgttctaaaagaaggggtcgggggcttcttgcttctagtgattccttctggcagcaaactcagtttgtcagtttgccaacatcctgctttcatgagaacagtttgctgtttgctcatatagcctccagtggtatactgagttgatcacgaccctcattctttcggcctccaataccccgactctactaaaaatacaaaaattagctgggcgtggtggtgcatgcctgtaatcccaactactcgggaggctgaggcaggagaattgcttgaactgggaggtggaagttgcaatcagccaagatagcaccactgcagttcagcctgggcaacagagcaagacttcgtctcaaaaataaataaataaataaataaataaataaataaataagtttaagttggcacaatcactttggaaatcatattattattatctagtatggttaaaggccatayaacatatcatccaatcatcccactcctaatcatacactctgcgggctttcttgcctatgtgcccaggagacakgcacactaatgtttatggcaagaactggaatcagctacatatatatcaatagaaaactagtgcaattatggtataaccataaaatgtaaaccttcagcagtaaaaacgaatgaatgacagcctcccacaccacagataactcctatatgtaatgtgcatcatgggaaaataaatgcagtaggaatttgckgtactggaagcttaaaaaccatcaaaactaactaatatttggattggggatatatctatacttattacacaaatccttaaagaaactctataatttctttatagatattatgaaaacagcaaggtactggtacaaaaacaggcacatagaccaatggaacagaacagagaactcagaaataagaccacacatctaaataaaggaataataatcacaagactcaggdtggagtctccttttgggggatgtgaatgggmagcagcccagggtagtttacaggttctgtgttttacaacagtgctggctaaagtccaaacaacatatcatccattcccttttaaaatggaacttttaaaataaatgtgtaatayttgatgttgatgatgtgttctgaaaacattgwgttgaaagaattgacttaaattcctaattccttaaayagattttttcaaagtaaaatatgcttggtttttataaaaatgaaagagaaaagaataccaaagttcattgcaagcatccttavcragaactacttacattggaacaaaaccacacagaattgtaaggagccatgtgacagagaggaccacsakgccatgaaaayggctttggctacaaataggtcatttgatccttggctcactggcatctctgtagattttcatgtatacaatcttcaatctgatgtgcaaggtaattccatcttgcaaaggatttgatgttacattctaccacacataccactgaattaaacttttacagaattggaaatgcacatcwttgatcaaaataaatgaaacaagaaaagagtagaaaggaayaaccagtgayrgaatagcaatatgaatagaaaacacaataggactgcgaaaacaaagaaacaaacaaaaccacttcagaagcacctgatggcatgctatttagaatcatagtggtgtccaaatcacttctatcacatatcattcaatatcacaacaaaagatgttaagtgtattatagaatgcygatcgaatagccagttatygaaaaaactagtttctcaattcgagctaacaatttcgtgatactgcatcaaaccgaagttattggcatgctagatgtgttgactgaagtatgagattcacatctttgtaaatgaaaagcaatctgattaagcaatatttttctaagtgaaagcaagttaattagagaaagaaacaaaggatggctactccagagacagagcagtacttctttttttaagtgtaggcaaatgttttttggaagacgatatttcaataagaaaactggcactaggggcatacttcccctaaatttgagacattttagacaaaacaaagacttattttcaaggcaytatttttatagcactaaagtcttggaactatttgatctagttattctatgttctcaactgtgttaactcattgaagagaacattgctgttattaaagatattggcaagaaaaactcagagatactgttgtatctcctttctctgcctcaaactgttttcccctcaacacctaaggctctgtgatgtctcaaacttttagtcattaatttaaaaagtgaagcttatcatagaattagaaaaaaactattttaaaattcatatggatccaaaaaagagctcctatagccagaagaatcctaagcaaaaagaacaaagctggaggcatgaggctacctgacttaaaactatactacaaggctacagtaactgaaacagcaaggtactggtacaaaaacaggcacatagrccaatggaayagaatagagaactcagaaataagaccacacatctaaaaccctgtgatcttcaatgagccygacaaaaataagcaatgggcaaaggattccctatttaacaaatggtgctgggagaactggctagcaatctgcagaaaattgaaactggactccttccttacaccttgcccaaaaattaacttaagatggattaaagacttaaatgtaaatcccaaaactataaaaaccctggaagaaaatctaggcaataccaatcaggacatagggatgggcaaagattttatgatgaaaatgccaaaagcaactgccacaaaagcaaaaattgacaaatgggatctaattaaacaaaagagcttctgtagagtgaaagaaactattatcagagtgaacagacatcctacagaatgggagaaaatttttgcagtctgtccacctgacaaaggtctcatattcagaagctacaaagaacttaagcaaatttacaccaaaaaaaaagcttcattaaaaagtggacaaaggacctaaacagacacttctcaaaagaagacatacatgtggccaataaacataagaaaaaaagctaaacatcactgatcattagaaaaatgcaaatcaatactacaatgagataccatctcatgccagtcagaatggcaattattaaaagtcaagaaacaacagatgctggcaaggttgcagagaaataggaaggcttttacactgttggtggaaatgtaaattggttcaaccattgtggaagacagtgtggcaattcctcaaagatttagaaccagaaataccatttgacccagcaatcccattaaaggttatatacccaaaggaatataaatcattctattataaaggtatatgcatgtgtatgttcattgcagcactattcacaatagcaaagacatggaatcaacccaaatgcccacmartgaggaactggataaagaaaatatrgtacatatacaccacggaatattatgcaaccataaaaaggaatgagatcaagtcctttgcagagatacgaatgaagctggaagccattatcctcagcaaactcacacaggaacagaaaaccaaacaccgcatgttctcacttataattgggaactgagcaatgagaatacatggaaccagggagaggaaaaacacacaatggggcctgttcggggagggcagtgatggggggatcattaggaaaaatagctaatgaatgccagggttaacacctaggtgatgggttgataggtacagccaaccaccatggcacaygattacctatgtaacaaacctgcacatcctgcacaygtaccctggaacttaaaattaaattaaattaaattaaattaaaagataagcttaaagcattaaagaaaaataattagataaaagaagtctttgatttacaaaatcctgaaacaatagttttaattttgcttttaacatatacgtaagtcctttagtacagctctctttcagaggtgcagcttaattccctctcttaagtgtggcttggacttaatgatgcacttctgatatggcctvtctctgtgttcccacccaaatctcattttgaattgtcatgcgaattctdatccccacatattggcgghgggacttcatgggaggtgatcgaatcatggggatgattcccccaagctgtggaagtcagcggttgaacctatttttcctaatgctcccctcagcactgccctcccataataggctccagtgtgtgatgttcctctccctgtgtccatgtgttctcattgctcagctcccagttacaagtgagaacatgtggtgtttggtttcctgttcctgtgttagcttgctgaggataatggcttccagcttcatccatatccctgcaaaggacttgatctcattcctttttatggctgcataatattccatggtgtatatgtaccatataaggggattttccccacttcactctgcatttttctctcctgccaccatgtgaagaatgacaygtttgcttccccttctgccatgattgtaagtttcctggggcagcctcctcagccatgcacaaytgygagtcaactaaacctcttgcctttataaattacccagtctcaggtatttctttatagcagtgtgagaacagactaatacaacttctaactgatagagtaatgytgacataacagtttgtgactctgggtgtagaatgtgaaactcactatggcttccaccttctctctctctgtctctgggatcatgagctcttggggacccagctgctgtgccataagcagccctgcaggaaggtccatgtggctaagaactgaggycccctgggaccagacagcaaggaactaggcttttccaacagccatgtgactaagccatgtttcayrtgaatccyyagccccagtgaagccctcagacgatgcagccctaggctgacaactggactgcaaccttgtgagaggccctgagccagaagcactcaggaaaaccgctcctggattcctgaccattagaaactgtgggagatgatgaatatttgytgttttgagctgctaagttttacataatttgttacacaatagtaaataactaatacattttcacaagagaggatgtattattacacrttaatttgcatttgctctaaatttatcatcatcatattactatttttgagacagggtctyrctctgtcacccaggctggagtgcagtggcatgatcaccatgcactgcagtgtcgayctcctgggctcaagggatcctctgatctcagcctcttgagtagctgggactataggcatgaattaacatgcctggctaattttctaatttttttgtagagatgggggtttcaccatgttgcccaggctgatcttgaacttctggagtcaaatctgccttcctctgccttcaacagtgctaggattgcaggcgtgagccaccacmcctggtctaaattaactataagatattaaacatgtaacttagttttaaaaggaaaggagaatttccacggctgaagaggatgtattttattactattcayaatgatcactttacttgaacttcartttccaactgtgtccaaattaaacacaaaaggaagatccagcccttcctgggctgattctatcatggctcccaacaaccagctcctggtcattcaccttcccccagttattcaaccaactctaatgtaggtgctgctgtgaagggatttagcagatataattaagggcctcaattagttgactttaggctgagtttatcctgcttggactgtcctaataaggagagtccttgaaaggactgggttcttcctgagcatagagattcacagtgtgagagggattcagcatraggggtttcctccactgtgggctttgaaaatgaaggggctgtgtaggaaagracgctggtgggcaccatgcattragtgcagccctccctgttctctacagtgacagccagtgaggaacagggacctcagtcttacaactgccagaaactgcattctgccacctctgtataagcctgaaggaggattcaaaatgaaaacacaggtttaggaagaccggaacagagattccatccacatcatgcccagatttctgattaagaaactataaasaacaaatgrgtgttatttggccaggcgtggtagtgcacacctgtatcctaacatttgaggagctgacacaggaggaacacttgcagccaggactttgagaccagctaggataatatagtgagacactcgtctctacatttctytttaattagctgggcatggtggcacttgcctgcagtcctagctactctgaagactgaggtaggagggtcccttgagcccaggaatttgaggctgcagtgagccatgatcatgtgactgcacttcatcctggatgacagagggagactctgtmtctaaaaataaatcaatgaatacaataaatgggtgctgtttaaagccaatgtttgtgacaatttgttacccagtcttataaaattcatacacagactcaaaagactcctggaatgaactgatgaattgatacgcacactagttacataaaataaaatcttttttaactttttyagtgttttacattttataattttctgtgatgcaatttaatacactcataattcattcattcagccaagaaaaaataatttagtccctacaatgaaccaggtatgccctcatatgctcaagtgcctgacattctagaagcttcacaagaatgaggtggagccactggagtgttttaggtggagaaatgacacactctgactcatagtagcaggaccactatagagagaacactcatgtagcaggtcatggaacagtgctagagccacarttcaggagtgagagggtggtggggattaaggggagaagagggcctgagggatgagagggacggagggaagggctggaggagcaggaggtgaggaaaaggagcagaggaaagaattccaaagcagcrgaactcttaggtttaaacacattrttttatagattttawtacatccatctacagagcctcgctgggtgttctttgcagttggcctttaatatcttatgtgggtctgcctagaaactaattgttttttatgttaatcaggtttaaaaaatactaagtattcctaaaaaatatacactccactcacatgtggatacttcctaaaaacaggcagtgcgtgagcactagtgaggggcattgtgactgcactgaacacttacaactgtgaggtgaataaagtttgtgctggctcctggttgcaacatatagtaacatagtgtggtactttgtcttgaggagatgtcctggactcacacggaaacttagggctacggaatgaaggtaaatttaaaataaaacaagcgggagtcacagatacaytgtctgggaaagtgaaacttaagagctttgtgagtcstgttgtaakgcttttagatgcatttatataccaacrggccaaagtcacattttttacckattagattcctgatcattcaggggttaccaagrttatgctacccactatagttaataaacaaaaagcaaactggtctctattctatctcatgcactcaggcacaacttttccagatttaagggggaaaaaaaaccctgtctttacacctacaatcccagggcgagctcactctctggcamcaagctccstggggtgatttttcttctagaagagtacaggaggacaggcaaggagtgggaggcagggagtccagttcagggacagggattccgggatgaaaagtgaagggagagggccagggaccttgccgagggtttctccctggtttctcagacagctcctgggccaagactcagggagacactgagacagaacgcttggcacaagagtagcggggtcagggcgaagtcccagggcctcaagcgtggctctcagggtctcaggccccacaggcggtgtatggrttggggaggccccgcgttggggattctctcctccttctcctaacctgtgtcgggtccttcttcctggatactcaccgggcggccccagttctcactcccattaggtgacaggtttttagagaagccaatcagcgtcgccgcggtyctggttctaaagtcctcgctcacccacccggactcattctccccagacgccaaggatggtggtcatggcrccccgaaccctcttcctgctrctctcgggggccctgaccctgaccgagacctgggcgggtgagtgcggggtcaggagggaaacrgcccctgcgcggaggagggaggggccsgccyggcgggggcgcaggacycggcagccgcgccgggaggagggtcgggcgggtctcaaccyctcctcgcccccaggctcccactccatgaggtatttcagcgccgccgtgtcccggcccggccgcggggagccccgcttcatcgccatgggctacgtggacgacwcgcarttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggccagtgagtaacyccggcccagggmgcagatcacgaccccccacctccatgccccacggacgscccgggtactcccgagtctccgggtctgggatccaccccgaggccgcgggacccgcccagaccctctacctgggagaaccccmaggcgcctttaccaaaatcccygcgggtgkgtccgggcgagggcgaggctcggtgggcggggctgaccgarggggtggggccaggttctcayaccctccagtggatgattggytgcgacctggkgtccgacggwcgcctcmtccgcgggtatgaacagtatgcctacgatggcaaggattacctcgccctgaacgaggacctgcgctcctggaccgcagcggacactgcggctcagatctccaagcgcaagtgtgargcggccaatgtggctgaacaaaggagagcctacctggagggcacgtgcgtggagtggctccacagatacctggagaacgggaaggagatgctgcagcgcgcgggtaccaggggcagtggggcgcctccctgatctcctgtagacctcycagcctggcctagcacaaggagaggaggaaaatgggaccaacacyagaatatcgccctccctctggtcctgagggagaggaatcctcctgggtttccagatcctgtaccagagagtgattctgagggyccgtcctgctctctgggacaattaagggatgaagtctctgagggagtggaggggaagacaatccctggargactgatcaggggttccctttgaccccacagcagccttggcaccaggacttttcccctcaggccttgttctctgcctcacactcaatgtgtgtgggrgtctgactccagctcctctgagtcccttggcctccactcaggtcagaaccrgaggtccctgctcccccgctcagagactagaactttccaaggaataggagattatcccaggtgcccgtgtccaggctggtgtctgggttctgtgctcccttccccaccccaggtatctggttcattcttaggatggtcacatccaggtgctgctggagtgtcccatgasagatgcaaagtgcttgarttttctgactcttcctttcagacccccccaagacacaygtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacayrtgccatgtgcagcatgaggggctgccrgagcccctcatgctgagatggagtaaggagggagatggaggcatcatgtctgttagggaaagcaggagcctctctgaagacctttaacagggtcggtggtgaggsctgggggtcagagaccctcaccttcacctcctttcccagagcagtcttccctgcccaccatccccatcatgggtatcgttgctggyctggttgtccttgcagctgtagtcactggagctgcggtcgctgctgtgctgtggagraagaagagctcaggtaaggaaggggtgacaagtggggtctgagttttcttgtcccactgggggtttcaagccccaggtagaagtgygccctgcctggttactgggaagcaccatccacactcatgggcctacccagcctgggccctgtgtgccagcaccttctcttttgtaaagcacctgtgacaatgaaggacagatttatyaccttgatgattgtagtgatggggacctgatccyagtaatcacaggtcaggrgaaggtccctggctaaggacagaccttaggagggcagttggtcgaggacccacatctgctttccttgtttttcctgatcccgccctgrgtctgcagtcacacatttctggaaacttctcgagggtccaagaytaggaggttcctctaggacctcatggccctgccacctttctggcctctcacaggacrttttcttcccacagattgaaaaggagggagctactctcaggctgcaagtaagtatgaaggaggctgatccctgagatccttgggatcttgtgtttgggagcccatgggggagctcacccaccccacaattcctcctctggccacatctcctgtggtctctgaccaggtgctgtttttgttctactctaggcagtgacagtgcccagggctctaatgtgtctctcacggcttgtaaatgtgacaccccggggggcctgatgtgtgtgggttgttgagggvaacagbggacatagctgtgctatgaggtttctttgacttsaatgtattgagcatgtgatgggctgtttaaagtgtcacccctcactgtgactgatatgaatttgttcatgaatatttttctgtagtgtgaaacagctgccctgtgtgggactgagtggcaagtccctttgtgacttcaagaaccctgactyctctttstgcagagaccagcccacccctgtgcccaccatgaccctcttcctcatgctgaactgcattccttccccaatcacctttcctgttccagaaaaggggctgggatgtctccgtctctgtctcaaatttgtggtscactgagctataacttacttctgtattaaaattagaatctgagtrtaaatttastttttcaaattatttccaagagagattgatdggttaattaaaggagaagattcctgaaatttgagagacaaaataaatggaagacatgagaactttccacagtacacgtgtttcttgtgctgatttgttgcaggagaggagagtagatggggctgcgcccagtgggtgctcaggccaccatgaactttatgtggtcactgctcagctgggtcatctttgctgctccattgtccttggcccttcagtagaaccttgtcccaccaggacctgtgatcacatagacttggatatcacctaggrtggtccctacacbtagaagttcctgtgttatcagaagaaaaattttcagacccctacacctcttcccctccttccaggtctctttcaattgtattttccatcttttttttttttttttttttttttttttttttttttttgagatggagtctcactcaggctggagtgcagtggtgcaatctcaactcattgcaacctccacctcccgggttcaagcaattctcctgtctcagcctccctagtaactgggagtacaggcacatgccacaatacccagctaattttttgtatttttagtaaagacgggatttcaccatgttagccaggatggtcttgatctcctgaccttgtgatctgcccgcctctgcctcccaaagtgctgggattacaggtgtaagccaccatgcctggcttccccaaccttcttaaaggaagcagattctgaaacttcccgagaggagaggtcccagagtttttcattgtagtttactttctgttggaactcctcttctgctctctctcctactcttcttcctgccctgagttgtagtaatcctattgctggctccaaaccaaactcatggatttgtaaagcagagtctaatttagattcatatgtggttggataattggagccataagccttgggttatctttcctsaagagacaaatatggttgtgtgctgcagtgtgcaggaggattggtgtgggaggagggagggagggaggacacaaaagcagccctggtgagaaaagcactggtgcatttatatccacatgagataatattgttccacagcggctacaaaatgacatttggcctgagtctacattaataaagatattgcctttagaataggggggcgcactacagtaatcatccattcaagtggcatttgttgtctgctaggtatttgactgtttttgcatttagaaaacatcgttaaagtaaaaacagaaaaatttctggccttgtcgtgtrtacattctagatgcaagcttgtccaacctgcagmtctcgggatgcatgtggcccaggacagctttagaatgtgaygatttttttgcttatctgtagtggcagatatcatgaaaattatccatgcattttttttcttttttctatttttttctgctcatcagctgtcattagtgtattttttgtgtggctcaagacaattcttcttcctatgtgacccagggaagccaaaagattggacacctctgcaggcagatgatatagtataagcagagtaggaacagaaaatgcttgagttagaaggtggcaagtgctgtgtggcaggtgatcsagagggtgggctgtgggtacagggaggtggctgttgtgctgggtggtcagcatgggccttgttgcaaatgtgaccttggagtaaagatttgagggatgtgaggagttgtctacacggatgtctcagaaagttcttttcaggcagggaaaccttcagtgcagatgcactagggcaggaaattgtctgtgttcctggaaggaggaagaggccagaagtgttgaacagagagaaactgaaatgaagtcagaggtgtgcccagagcaggttgccctggagggtgtdggaaggatgttgacctttgctctgaatgacatggggagttagaggacagttttggaaagtgggacatggtaggacttatcctttgaaagcttctctctggctgctgtgctgagaacagaattgagaggtgggggactagtgaggcagtgggraaaacggtgggaaaggagtgcagtattccaggatggagacgtcgcttaccttgactggggtgtgagcaggggaaatagtgggaagtgatgggattctggatgaattcacagcacttgctaatggatttatctgtggtgtgagaaagaagaatcaaggacacccacagtattggactgagtgagcagaagggtggagctgctgtcartggagatggggagactctggcaggagcatacagaggagagggcattgcaggcatccagtggaggtgacatctacraggaatgaaggtgaggggcccagatgcctctgcagctacagattcatcatccaatcactatcctacttccaccacccctgtgtctcagagccagagcattgattctcccctgtgctgtctgcacaggtaggtgaaagtcagggaagttatggtctgctgttggttataataagtcacagattattgtgctttctcagataattaaagaaataayaagagaatttgtaactagaacacttactgagaagaccacaataatgcaaagbtttttattcatctaaagaaggcaacagaagaaaaatagttgagcaagaaagataatattagaaggcagtaaatgaaaatggacagacttaaacccaaygaggtcaacaatgacattaaacgtaatggactcagacactccaattacaagacaaatagtgcagagggataaaaataaataagtaaataaataaataaccgtaggctatttacaaaagccataatttcagtagaaggtacagaaaagttgaaagtaaaaagatagaaaagaaataccagacaaacattcatgaaagaccacatggagatgccatttagaaaaattacagcacatgagtctcctgagacatagagtacatgtagacagctcacagtgtctttttcctttttttcagagacagggtctgttgcccaggttgaaatgcaatggtgatatcagaccttactgtaacctcaaactcctgggctgaagcaattctcctgcctcagccttctgagtagctaggacgagaagcctgtgccgccacacctggctataatgtctcattttctcatttgctgtggtgtgaacaaggaaacaataycatrccatgtatttgacttgcagcaggtacacaacaaatgtcaggtgaatgaagaaataaaaccacttagtaatccaagccatatccacatttacattttacaggtgaggagcaacatcccagacaagtaaagtaaaataaattgatttacatcatccagagcagaatcgagaacacattccctgtgctaaaggaatcagaactctactaggggtcatagcagatatcatgcaagtcacatatgttaattactagaactggagttgatacattttgagatatactaaaccaagggtttggaaggattaactgaatgcagaaataaaggaagaaaatagatttgtttaaaagatggttagaatctttaaagaaacaacatctttttaaagtggccttatgtggaccaaagcagagatgagctcaaatgtcaggtgggaaaatgcttgactaaatgcagctctagacccaagggagacctaaaaatcctgggacattttcggttgtcacgtggggattggtgggagggggtgagtggggtgctgctggcaaacctcccacaatgcacaggacagaccacaagggattctctgtyycaaattcttaatagggctgctgttgagaaacccgcccgagaggtaagtgctgtaatgtcctcaccatttcacagattaagaaactgaggcaccaggaagaaaagtgtcagtaggaccagagctgaaggttgaatccaggccacctggctgcagggtcttggcttccctggttaagtcagggacccaggagcccaccacaaacaatcccagctgcgcggtgccttcatggtctgtggcgccccctggtgttgacactgggcctrtggccaaatgaggcttgagggaaaaggaaaacgggtttaggtagcgggatctccttcaggctctccagatttcaagccatgacttacactcagaaaaaataatgttcaccttaattatctccccaaccctgtttttcccagttccggccagtaccctccctcgactccatmaacatcagtacctgccagatgcccagcacccaccatgtgaggagtgaaaatgccccaggactaaaggacaagatgacgttccaccccagccatcccgcccctcctagagctctagctctgtgcmtttagtgcttaggcttttaacctggggtccgcgaacccactttcccatgacactgcgtgcagaagtgatgttacatgcacacatgacttcattacaggacattggatattaatattcatccgatcaactgggggcccaagataccactcttcccccaacagtttgtgatcctctgaattaaagaaagggcagagattgagggaggccctaactccaaatcttctaccacttctagggaagtgctgaaaagaagtgcaaggtactcaacccgctctgggratacagcaggaaagcagagtgttcatggatttcgaattccatcaaagaaatacaactttggcaaaatatccaagtcacttttctaagccccaggcagcagctcaaaacaaacaacaycaaaaacaaaacaaaatctcggcccaggtgaaatcattgaagacataaaactttgtgagacctgtatttagagcgaaggacaattcaatttagggctgcagcagaaaacccctacatcatattgggtttttcctcatcatgaagktctcctggagggaccttctcccttcagcagtgcatagtgaggccatttctgtgtaaaaagatagaatctccttggattcctgatgtttacatttactactcacttctttgactttgtagatgccaacttcacattcaacatctttcaattattttctttactttgtctaagcagagaatttaaacttgtttctgaagcagaaaaccagggactggttatttgagctatcrccccamtctgtggctctcttatgcaataagcataagagattgtgggccaacagaatttgtagcaagataaacataaacccttcatttcagcctatgtttctgtttgtctggtgatgttccagtcttgctccagtcttaacattttaaaaagtataattttacttaaatttcattttatargaagtcatatrtattcatttctgttaggtttctcagtgaaagcctcctcaaaacaactgtgaagtaaagacatgtaaataaattcatggtgctcccatgtattcrtgctcattgcatcttacaaatgtgtcagccccactgcaacagatggtgcatcaacaaatggtgctggaaacctggatatccacatgcaaaagaatgatgctggacaaaatttatgcccttccattacacccttttcaaaaattaagtcagaatgccttaaagaactaatcttaagagttaaacctgtaaaactcttaaaagaaaatactgagggaaagtcttatggtcattagaattggtagtsgtttcttggctggtgaccaaaagtacaagcaataaaaggaaaatgacaaataagacttcatcaaaatgtaaaaacttttttgcatcaaaggacgctattaagaggtgaaaagaggctaggcgcagtggctcacgcctgtaatcccagcactttgggaggccaaagtgggtggatcacctgaggtcaggagttcgaaatcagcctggccaacatggcaaaaccctgtctctactaaaaatacaaaaattagccgggcgcagtggtgggcacctgtaatcccagctactcgggaggctgaggcaggagaatcgcttgaacctgggaggcagaggttgcaatgagctgagattgcaccattgcactccagcyggggcatcagagagagactcygtctcaaaaaaaaaaaaaaaaaaamaaaaraaagtraaaataaaagaaactgcatagaataagataaaatatttgccaatcacatatctgataaagaattaatatccagactacatacagaactacaacttaacaatagcaaaacaatctcattcaaaaatgggtaaaagacatgaatagacaattctccagagaagatacacagtaaggacataaaaataaggaattccaataaggacatgaaaatatgctcagcttcactagtccaggtgttggtgaggatgtggagaaaatggaatgcttgtgcactgctgctgagagtgaacaacagtgcagccaycatggaaacaggatgaygctttctcaagaaggtaaacatagaatttccayatgaagcaacaattccacttttgggtgtataccccccaaaaattgaaagcaggtatgcacacagataattgtacagtcatgctcatagcagtgctattcccaatagccaaaaggtggacgcaacccaagtgtccatcagaggatgattggaaaaacaaaatgtggtgcatatacacatggaatattaatcagccttaaaagtgaagaatatttggattggatggaaccttgaaaacacgctaaataaaataagccaraaaaaagrcaaatatgatatttcwcttatatgaggcacctagaataagcaaattcacaaaaacagaaagtagaatacaggttaccaggggctgarggcaggaacaatgggcagctgtcatttaatgggtacagtctctgttgggatgatgaaaatgttctgaaaatgcatgttggtgtttgtgtaaccaccatcaattgtaaatgtgcttaatgccaatgaattgtacactgaaaaaaattkttagaaggtaaatcgtatagtatgtgtgttttaccacaatttwaaaaatatatatcaacaccaaatccaatcacttytcactcctctgccacctccaccccagaaccatcmtcactaggatagaaaaccggaagggccttccagctgggctgcctgctgwctctcatgcccactgtccatcacccacacaacagagagagcgtgcctttccaatgggaattagrgcatatcctatgaacgctccagctccttcccttcttaggcacaaggaaaccccagtttcccaccatttcctatgcactccttatcacagggtcccctctggccactttggcctcatcccattactctcagcctagctcaytcttctccactcacaccagtttcttgtctactccaccctgtctcyaccacctgcccctgytgtgactcccacatgcatgtgctgcccagtgatccacatggctcactcctcacaccattaaggtccctgctyaaatgtcccatggtcaagtgttcagaaatgtcttgtccagtgacctcttctgaaatctatcccctgccattcccaccacygccaccaatcttctaacccaagcatatttttcttaatggcaattatcagtgatactrtgacaggttttatttgtttattgtctgttgatttattaaggttaccaagaaagaaagaaccaatagcataggtacatagatgatagatagataatagatagatagatgatagwtgatagatagakgwtagatgatgatagatagatagatagatagatagatagatagatagacagacagatagatagataggtgatttattgggctaattggctcacacaattatggaggctgagaagtcccatgatagactgtctggaagctggagaactagaaaagccagtagygtggctcagtccaaagtcaaagccctgaggacccagaatacagaacaggaggataaaggggctcactggtgcaaaagtcagagtccaaagatcatcgaacctggagttttgatgtccaaggcaggagaagaagggtgtcccagccccagttccagagagagagwcagagacagagagagacagagagacagagacagagagaaattttacttctatctacctttctgttctatctgggccactaggtgattggactgtggctgcccacagtgagagagsatcttccccaccagtccacccactcacatcccttccagaaaaactctcacagacactggtttaatacttacaatttgagtagtctataatttatttttttgagaytgggcttgctggctggagtgcagtgttgttcatggctcactgcagcctgaatcttccaggcttaagcaaccctcccacctcagacacccaagtagctgggactacaggcatgtgccaccaagcccrgctaattcttttgaattttttstagagacagggtttctctatgttgcctaggctggtcacaaactcaggggctcaagcaatctgccagcctgagcctcccaaagtgctggaagtacaggcatgagccaccatgtccrtcctgagtgttctatgaatttttaaaatcacaaccatagaagaatcttcatgtacaaacatgcttgtcaaaatattctttaccaaaagacaagatgaaagcacatggatctaaaagaaccctgstgacttctccttgtttgagatgggatgcagcttctagaagtgtgtaaattttatgcagactttatgacatggaaaactactttcataataatacattcaaaaagcaacttcaaaataacccacaaccactctgggaggccaaggtgggtggatcacttgaggtcaggtgttcaaaaccagcctggccaacaagtgtaaccccatctatattaaaaacacaaaattagccaggcgtggtagtgcacatctgtaatcccagctactcgaggggctgaggcagaagactcacttkcatccgagatgcagaggttgcagtgagccgagatcatgccactgcactccagcccctgggggacagagtgagactccatcttaaaaaaaaccccaaaacttatgaatgcaactttctacaatgaaagcatatataaaaatatatacatagaaaacaaaagaatggaartcagcaycactgcagaagatagctccagggatgaccattcacactgcagtccaggaagtttcaataataygatagcagtggttctttggaggggaagcctgggtgatatttctttcttctctgcatttttttttctttaaaattcaaccasgtgttgatrtgtgcattttaaattcttstgtaatcaaatacattttcatatttctartgtagaaacatgtatttttaacattcaaaataaaacatttgaagtaaaataacaatgaaaagtggctgaacactgtggtgggcacctgtagtcccagctactcaggaggctgagataggagaatggctcgagctcacraatttgaggctatggtcacacctgtgaatagtcactgctctccagcctggagawcatagtgagacctcatatttaaaataataataataaaaagaagttcagatctccttccaatctcaacctaaaacaaatttctcatttgaagtccatatggcagaaatgcctactgatggctcctccagagagtaaaaaaaatattgttcctctacaatccatgactcatccttctgttacagtgttcacctgggcaatgaagtcaacactragaatatcatcaatttatggaatactgattatctcttttatagatatataaattataattatgtatatatayattatattataatatatataattaccatcacacctgagagagtgagatggattcttttcttccacagatgaaaatctgagtccctgagaacctagggktttggtatgggttcactgaaaatgttggccttgagaattaggaaacagcttcctgcaggcctgcctggatgtgagccacaccartggagtctccrcaacagcaggaagagcaactgagaaccctggaagcttcayacttgyaatgttccatgtccagcggcattcagttgatggatgggccaagataagaatacagctccttccttcaattgggggtggcagaggggtgaatcagtcagctacacataatgtgtgtggtgtttctacagatatctttaattaytctgctgagaactccacctcaaatgtacaaaaastctgtactcactggtaagcaggatcctttttaggaaagcaaaggactttgctgacttaagcaaaacattttctctccaaatgaattatcctgattggataatctcttactcccactgaaattagccccagagttgyatttgagcatttgggtcaaagacagaaagtcattttgagggttgggcctggctgatcttggacaatgttctgaaagagggctttctacttgcagaagaacaaaggtktgctctgggtaggagatgatgtcctgagaagaaaagacagataggcagattctcaagcaaactcaggagtttactatacaaaagattttggaataycttcctcagcctckttttcattgtggtaaaatacacataaacacaaaggataccaccgtaaccatttaaagtgcacaatgcagtgacaattygtatgttcacaatgttatgtaaccatcatcactctctagttccagagtgtttttatcacctcagggggaactctgcacccattaagcagtcaccctccatttccacctgccagcagaccctgtcgycacaaatccacttctttctctatcgacttgcctcttatgaatatttcacaaaaatgggctcataagttayktagcctcctgtgactggcttccttcacttgtcttgttttcaagattcagcaatgttttagcatatrccagtgctttattcattttatgaccaaataatattctattgtaggaaaaaactatatgttgtttctccattcattggtcgatggacattttcttttaaatcaaataggaaaaacaagagaggaattacaaatatatatakgtgtgtgtgtatatatatatgtcttgtagggttgagachatctcagtcagctttttttaacctgtgaatgtcdtgatttctccatcatttctgaaggagagttttgcagacatacaattcttggttgatagtccttttactttctcagctttaaatttgtcatcccaaygcctcctgaaccccatggtttctgatgaaaatttgtatgttaatcttattgaggatccattgtacctgaaaagttccttctctgttattgctttcaagatggtctgtttgtcattggtgtagactggttgattataacgtctctcagtgtggacttytaaaattcttgctgcttaaaatgtatcaagtttgttggatgagtaaaattatatttttcatcaaatttaggagatttgaagttattattcctccaaatagccattcttctttttctctctcctttctttgaggattcccaaaatgcatatgcttggtgttgtctcacagttttcwtaagttctgttcatttttcttcataatttttttttayttctgcacctcaaactggataatttcaattgtcttacctttaagcttgccgattcttcattctgcatagtgaaagttgcttttgtaaaaaagtaaatagtaaatttactctagtaaaatatagtaaaaaatagtaaaattactctagtaaatttttcatttcagttattgcacttttcagctccaaaatttctayttggtttctttttaaactttctrtctttttattgatgttctctatttgagttaagatagttcttctgatttcctttagttttttgcccatagtttcctttagctctgtgaacatatttaagcagtcaattcaaagttgtttgtccagtaagtatgttcaatggcctttctcaggaacagtttctgtcaattsctcttttttcttgagaatgggtcttacygtctagtttaattgcatacctcatttttattttgaatactaacatgtggtgactttgaaaatcatgttttctaaactatttttgtatagactgtattctttattgtgtgtcatcactgaagtctctattctgtaagcttagtggtcaactcatgatttgatagatatttcctgaaacatcttcagccaaaaagaaataagaaaaraaaattcaatctttttatctgggctctctgtgtgttttggggcatgccctcaacactctgctgggcagtttacaatmctgctttggccttcatttcctacttgtgcagatattgaaagttagcaagaggtgtgaacacagggcattctcaggtgctttgtgagtctgtgcgacatactggtcatgvaggaggctatacagattcccagggatatggaagcttttcaaaacccatattcccatctcactcacccagtttctcctccaggcttttctgtatgtctattaccttyctcatgtaatatatttttgccccaagggggcagctgctggttcagtggcacttaaatggttttagcagatgccctctgcctctgtgacctaagagagttctgagtagggaaaataaatgcaaaccatttattttctttttctttcttttttttctttttttagacaaggtcttgctctgaagcccaagctggagtgcagttgcacgatcctggctcactgtagcctcaacctcctgggcttaagcaatcctcccacctcagcctcttgagtagctgagactacaggcacatgccataatgcccagttaatttttgtattttttgtagaaatggagtttcaccatgttgtctaggctggtctcaaactcctgaactcaagaaatgcacccagctgagcttcccaaagtgctgtgattacaggcatgagtcaccatgcccagcccaatgtaagccatttcttatcatccttcacggagtcacccaacaggaaaaggtagacaaccacaacacttygagaacatggtccactcggctcccactggcattggagcccacactaaggaaccaggctgctgtcttcaagatcactactgacttgaacagggaggaatgggccaagggtaagatatgktgccacaaagctctgctcctgagttccagttgatttttctggacttgctaggttgcaataaacctttgatgatttttcagggttccaatgcagttgattctttatcaacccaatcagaatatctggtggtaggtccaggaattcttgctttaacagctctcygagggaatttttttttttttttttttgatggagttttgctcttgttgcccagggtggagtgcaatggcatgatcccggctaactgcaacmtctgcctcccgggttcaagcgattctccttcctcacytcccgagtagctgggactacaggcgcgagccaccacacccagctaattttgtatatttagtagagactgggattctccatgttgatcagtctggtctcgaactcctgacctcaggtgatccccccacctcggcctcccaaagtgctgggattacaggcatgagccaccatgcccagccaagggatttttttttatagtgatgttttacaagcacattgtctctgtgcagaggtggcccttggagttcctatgccactatgttctctgatgtcactcctcagccacctttgaattgtgyttatgcatcagaattcctgatctgctaagtacttccaggaaactcattcawatggtaaacatcattaagcacctaccttattctgggtactgtgctctatggagttgagcctcagataaaagamtcaaacttccttggacttcatagaagtcaaaggtgggggtgggaagataaataaagaaattatarcacagcatgttatgtattttacatgacttttttctttgaaagctacattattaatattttatgacagtactgagttacatataccaaagattacaaattaaaatttmtgctttctttctctcttttgttcttacatatttctctgttcttgtagatattttgarattgggtattatggagacagtgcaacrgtttcatttatatgataatgttttgttttacctttattcatcaaagagagatttgtcagctgcaaatttctagtttgacattggttttctctcagatctttgatgattatgttgcttctggctgctgtggctgacagggratagtcagttacattttaaccagttgcttcttagaggatctgtgtttctcctgtggcaaattttaagatatctgtttctctttaacatcttctgttccagtgcagtatgagtaaatgtggatctctttttattcacagtgctatgatactgttaggtatgagttctaaatttctcttaaaataattaacatgtcagtatgttcaattctttgccctctacttttaaacttaacttcctcataaagcaaccttttttgatcacctgttccaccctgactcatcctgattacttgctccagcctgactcattctggttacctgctccaccctgactcattccagtcacctgctccaccctgactcattctgattacctgctccaccctgaytcatcctgattacttgycccagcctgactcattccagttacctgcwccaccctgactcattctgatcacctgtttcactctctttaaattagccaatctgaattagtttagcctgtgcggtctaaccctagccaataggggaataacacagcagcaggggccacrtgcatcagggataagaaccccttccccttccttgtccaggggtgygctcaccattgctccatctgtgagggcacacccttgtatagaagtaattgccttgctgagaagaaaaaaagaaaattttatatttgagtgctatttctttgtggcatcragactttatttacaataatacatttccttaatattttaagataacctctttctggaatgcctctttccatttactcacttctcttcttctaggaatttaattagagaagaattaaattaaacctcattcaaccaccatatacactgtggaatccaaaataatggcctcacacatatgtccaagccctaagacgcagaccatttagatatgttactttacacagcaaaagggactttgctgatatgattaagagcatggacctttagatgtggagattattttgtattatttgagtggccccaatctgattgcatgatttctttaacctggagatgactggagaaatatgggtcagatggagtgctgaatttcatctagaataatttcttaatctagtaaaataacatcatctctgttttttattctttaattaagtggcaaaatgcattaaaaggtttaaagtttaaatatccttgcattcttgggctatataccttggtcaagacagtctgtttataacacattggttaatacagtctactaatatttttcttagaattttcacatctaattaattaaaagtgattttcctataataggtaaatagtagaagggggtaagtctcttattttacaaattattcaaataatacatgaaaagaaatggaagactgagactacaactctttgccatccgtaatgaatgaacagatctagccactgaacagcaatgacaattttcatcaccaaagggaaataaccagtattaaactcttccccttgttgaaaaacatgatatagtaccaccaaaactcacggggaaaaaaatctgaatagatgcaaacctctataccaaactacaaatttctagaaaatgcaggtaatagagatgcatattaaaccatagtttggggtgcaatccacaaaatacaaacaacaggaaactctaccagacaatattaatttcaaagggataacctatagaacaaataagaacaaaaaacttatttttaaaggtaaaactaaactatcatttgggatgatgaaaatataaaatagaacaaagaagtgaggaccacaaaagtcaggatgtgattgatttttatttgaaaaaataaaaatttactattgaactgggtcaattgatggggcttctaggtcagctgacaaacttctctctctttctgatggttaaagagtgtttactgttgattaaaggtcaccattttaagattttttttcttttatgtcacctgtgttttatgacaaaaaggcgaacgcagaataaaatgagttatggggcacggttcctgttctgcacaaagcctcctccccatcctcctctctggacactgagcacccagaacaaccggcagccccaggacccctggcakggctgtctcattactgagtgtgcatccagctccacggttcctgttctgcacaaagcctcctccccatcctcctctctggacactgagcacccagaacaaccggcagccccaggacccctggcagggctgtctcattactgagtgtgcatycagctccacggttcctgttctgcacaaagcctcctccccatcctcctctctggacactgagcacccagaacaaccggcagccccaggacccctggcaaggctgtctcattactgagtgtgcatccagctccacggttcctgttctgcacaaagcctcctccccatcctcctctctggacactgagcacccagaacaaccggcagccccaggacccctggcagggctgtctcattactgagtgtgcatccagctccacggttcctgttctgcacaaagcctcctccccatcctcctctctggacactgagcacccagaacaaccggcagccccaggacccctggcaaggctgtctcattactgagtgtgcattcagctccacgtcgctggagacaatgtccacagtttattttttgagtcctggatgaacctgacaggacatagctgaggggaagcctggcccagtctgcaggctttggccatcagtgcagagggaggaggtcctcatctctccactggagcagttacaaccagagcctcctctctgcgtgggagtgaggctcggtccttcccctgaacacggtgacagggatctctccacaggtagagatgacaccattcctcctgtaacatggtccaatctcacgcttgttnnnnnnnnnnnnnnnnnnnntgacaaacttctctctctttctgatggttaaagagtgtttactgttgattaaaggtcaccattttaagattttttttcttttatgtcacctgtgttttatgacaaaaaggcgaacgcagaataaaatgagttatggggcacggttcctgttctgcacaaagcctcctccccatcctcctctctggacactgagcacccagaacaaccggcagccccaggacccctggcagggctgtctcattactgagtgtgcatccagctccacggttcctgttctgcacaaagcctcctccccatcctcctctctggacactgagcacccagaacaaccggcagccccaggacccctggcaaggctgtctcattactgagtgtgcattcagctccacgtcgctggagacaatgtccacagtttatttcttgagtcctggatgaacctgacaggacatagctgaggggaagcctggcccagtctgcaggctttggccatcagtgyagagggaggaggtcctcatctctccactggagcagttacaaccagagcctcctctctgcgtgggagtgaggctcggtccttcccctgaacacggtgacagggatctctccacaggtagagatgacaccattcctcctgtaacatggtccaatctcacgcttgttctgctttacaagaaagttgacccacgctggtgtcccctgaagaaatcacaggcacagaggagggacaggtggatttcagggctgtgcttgatctgggaaaggaagaktgcagaccgccaggtggcgccgctgmactgcttctgcgcccaggaggtgcctgctggggctgagattgaaggtggggagaaggatgtcacagctcatcgcacaggttcccggtaaaaatcctcctgcccagcctagcgggctctcccttaatcaactgtagcgaaaactgtctccttctcacgttcctggaaggtgctttttgacacaagaaagaggatgtgaytgctagggtcatcatgtcattgtttattgtgttgccagtaaagtgaaatcaaaatacacaataaataataaaayaacccatgataagccaatgtttataatgtactaacaccactgagccagtgtttataatgtactgacacactccaagtgtgggcacagckgcagacatgccttgtctcttgggtcaggacacagggtagagtgaaatggraagaaatcccagtcactgcagaaaagggcccccatggaagaggcctggcagggaggccagctgtcccagggccgccatatttagggatgactccccctttctgggcagcactggtttttttaattatttttgcattcacagtagttctgaaattgcaggatgctgagacccagcactggtcagttacaccgtctcttcttcaccattaaatactgtgccaaacagcaccttcatacatttccatcctcttccaggagagaatcaaaacaacaatggacacattgatgcatgcaaaaatactttaaatatgtgctatcagaagtagctactaaaacattaattccactgaaatgagggaggctgtaaaaaagaaaaacattgcataccygtattcacagcaacattactcaccatagccaagacaaggaagcaaacaaagcacccatcaacacatgaatagatgaagaacatgtggtctatgtaggcaatggaatatgattcaaccttaaaaagaaggaaattctgttacatgctgcaacatggatgaacctggagaacaatgctaagtgtaataagccaatcacaaggaaattccaatactgcgcaattcgttatatgcggcgtctaaactcttagaacctgaaagtagaatggcggctgccagtggttaggctggggggattcwtgaggagattttcagcgtagagtttcagttttgcaagatgaaaagttctagagatctgttgcataacaatgtgctacagttcatattatagtactctatacttaaaaattgttacgataccaaattttatataatatrgattttggcgcaatgaaaaaaataattagctctgataccaacttaggaaaagagcacatgaatttattgaaaatatattagcatgtgcttactatgaaaaagagatgcagaaaactgtgagacaaaaagagagayccttgctaccccagctattatccatgaaccagcagaaccagcatctcatgaaactggacagaaaggctcacaggcccagccttgacaggttgatcagtctgcatttgtcaggaccccaggtggctccactgcatgtaaagcaccgccccagatggtggtggagggagatcctaggaaggtgactctgtcccacaggtagaagcctccagtccagatgggagcagccagaagggcccargagggacatttccaagaaagtaaaattaatagaaagttcaaagtctctaatttcttaacagagtcacagaaatggaacagatatcaaagttaaattaatgagagttatctagaacataaacaaaaacaaaggcaagtattaacttgaggaagaacaaatactacgaagcaagtgaaaagtagtcaagttgacatatgagaagatgagtcacggaaaaaaacaaggagtggctgaattaaacataattactatataaatatactgggaaaaggaaagaacgggaagagtgaaagagaacaagtgatggatgtggtgacgtcgcgttctcccgggcggggccggaggcggtacagatgagggacacattcatggctaacrggacsgctcttctcgttctgcgttctgcttgcggycggtagtctctcctccccgcccatgggcggtggttggaggcaggggtgcggaatccggccgacctcgctgtcctcgccctctaccttgtggcrtcggtggggttggggagatgagttctccgacgcagyaggcacccctgctcatctcctatggctgttgccttttgggcagcccctcttcgcggcggtggggctgtcscgccggcctgtcacgttgcccttccctgggcttgtgaggattggctccgcttggacctttgcggtgctcccggagccctccaggttgtccctccggtgccggaggccaagcggtggtgtccttcctgttcccagcgccccctcctcctgtcgctgctgcagtgcctgtgtgtgggtcctgaggggttttggggaggtagaatatttttatttatttaaataaattaaaaaataagaaaaaaatacaaaaagaaagagaacaagtaatcttaactattgattccaccatcgtgcagtgcaatagtcaatggctgcaactgaaaaatcaagcaatgttaayaaagaaatggtgctttggtgcttagatatgtgaaagtaaagtcaaaagaatcagctgaaacttgaaagtggttgctccctagaaaggcagaaayagagaagagaggactctccctagaaaggcagagaagactcrtttttctcagraagtcctgcrcaaatatttactctttcmattatgtgcaattgtaacttcgaataaaataaaaacaaaagcttcagttaacatgcaagtttatgcctaatgacaactttgtttaacaatgataaarggctaaccaaaatataaaaacacttaracataaaacagcatgtataaatgtgtatgtgacatcaaccctgaatacaaacttgaaagaatatgtctataaacaactctggatagatagcccatgaatgaattccccactccagcatctttactggttgtcctgtgagcctaggcagggaggggaccaggacctgactagggtccctaatactcttgcttccaggcaagtcctgcatrcactcctgctgcaccragggctcccatccctgccttggtctgtttcataggtgctcccctaactctctgccaccactgccttacctgggtggagctgaggccgccctgaccaagaagagcrccasccatctatgtgccccaaaaccagaaagtcaaaagaaaccttgcaacagggtcaggaactatcccacctccccacctccgaatcagtctgaactgatggcgggagatgctgatgcttgctttaytcatcctcattcmctgtgcatttatttttcactaattcagtccacatctcctagaagcagactgacccctacccttcataatcaggaaaccccagagcactttttatcccctccagaatataacacttcagctctgcatcatcacatgarggctccaactctgyagggcaggtgtactctcacagcttcaggccctgaacatttgcttcagatgtccccccatcccttyccagacctgtctgtgttgctctgaatctgtccttccctgagaactggcggggagatatcagggaggaggggagatttctttgtgctatgtcaaygcatctagacagarctctcattctcccttgaacctcaactctatcygttcccagacacttgaaataaaacacagaccagaaatgtctatttaraagctaaatatctatagtataaaatatgaagacagagtagaatggggtaatgcaggagagtgtgacagggcraggggacctcaacgtgccaggaaagttggtccttggctcccctggaggagccgtcaccaggacactcactcataaagctcacctgtgataatacaaytacatgacattaatgtattaaaatataataaaatcataacaaaataacaaaaataatatggcacagctgcaaacacctcatatatactaacamttttcatccacccaaccacaagaaataaatgytgttacattcccyatttcatagatgagaaagctgagccagcaagagaaaaagtgctggtgagacctgggcagggcgttcaatccaggccgcctggctgcagagtgtaggtgccctcagtagagccagtggacctgggagctgagagcagagactgaaatcccagctgtgcactgccctggtgttctgtctgagtcaggtgttgatctgggccttgcaggctcatgtgctctggagaaaagagaraaaatagtaagtgctcccctgggtgcacagtgctgctttttactccctgacgacttctccctcctcagtcagtcccaaatcagattcaccctttctccgagggaagatgatgtctgcacttttttctccctcccatggcacttttcccagcccctgccagtcccctcccgtgactccatcaacatcarcccctgccctgtgcccaccagccaccatgmaaggaggaaaagagccccaggaccaaaggacaagacctgggaaaaacccagtgccctcccctcctctcaagcctggccagctctgacagcaggaggactccccaaagagaggctctggccctggctccatgtccttccaggactgggctgggtcacackcacagtccttctctycctcagtccccagtcccacctcacctgtagagacacctgcacacaarggcaggccctaaacactgtggttctgccctccacctgcagctcagtgctcctccacttccagccctgagcaggcagctcctaactgggaagcccattaagaatcccatcagcayggcaggcccagcatggaaacatgtagctgctatggggtctgcagctgacctgaccctgggaacccccttgctcaaggaggccctgcctaccctgacccccaggcccatgacctgcacttgggccawgcttgctccagcctggtccactcatccctggaagcacagcttctccccagggctgctgcttggggaggctgaaaggccttyctctcctgttcctagcagggattcctagcagggattccacccaagccactgccctcacagcccataggggatcttcttctccctgtggagtagaaagtttcttgagacccctcagcctgaggctgcctctgcccaccctttgcacttggggattgccactgccacagccacygtctcccacatggaccgtcctggagagggagctccacatttgagttcctgtttcatttgatatrsrttacaacattagtattggtggaaatccttttaagacccagctgaaactacgaacatctttattggacatcagcatttaaagcaggaattttgagaaattagcacataactttcwcacccctttcctggccartgccccagtaacctacaaggcaaccgttcccrcccacggggaaccagaactgacaatccctcttcaggagacaccacaggtgagagcaggagcgaccacagacctgcactgcccctgctgtgggtgcctcctggacagggccctcttgctgcagggcaggggatkaaccatcccatctgcccaggcctgaggggccaactgacagtgcaattaggttcaaggatgagaaatcaccaccccctgccagatacacagaagtggggaaatggcagaaagactcgggtttcccrgacactccaggctctcagtgtctcctgcactgtctctgtctttgcagaaacacaaaacttgctgcttgctcttttcccctcccttcaaacaacctgactgtgcgggaaatcatcctgaccatctctcactccaaactcatcaggtagtgcttattctttcaaaggtattttgtgactgtgcaagcaaatataaatgtatatgtrtatgttctttctccctttgcacacaaattttagcaaactayatatgcttttctgtaccttgctgttttcccttaccattgtatcayggagaccatcccatgaagaaatatcaagaactacactatgtctttcttttttttgttcaaaaatttcttggcaatccattgtataggcatgcattttttaaaatagagattaccctttttgaatgcaatgctttttaaccagctccctactgatagrcatttggattatttctttcagagaacaatttgacatcatgtagcatcatatgggaagggtgcagtgaccccactcctacatgcatatcctaggggagctcacatattcttggaaccagaaarcaatgtcccagcatgttcattgcagcagtgtctttaataaagactatgtagaggtcaatgaagtggggaagagataaattgtagcatattcctcccatggaatactatctagcaatgaaaacaaatgaactatttgtgtgaacattgatccmtctcatagaccatgttaacggaaaaagcaagcaaatgcataacaaaatcagcaagaaacaatttataaaaagtctaaaagtaaagccaggcaagggggcctatacccrtaatcctagcatcttgggaggccaaggtgggcagattgcttgaccccagrcgttccagacaagtctgggaaacatgataaatccctttctctacaaaaawtacagaaattagccaggcatggtggcgygaacctctartcccagctactcaagaggcctagaagggaggaattgcttaagcctggcaggtagaggctgaagtgagttgtgtttgtgccactgcatttcagtccaggtgacaaagtgaaaccatgttaaaaacaaacaaacaaacaaacaaaaacaagagactttttaaaacttagtaagaatataggggcatacagcaaattcaagacacacattcaccaacagttcttgctttgctcagtacagtattgactgaaacacatgcataacagaactgtggaaaatcagggctatctacacgtgtttctgttattttctatgtatactacatacagccaataatattaaaatgtcacaaattgacaaacctggrtggcagcttcacaaagatttcttataattctctattttttcttctagctagaactaccttataataaaatttgtgaagtgaatccacagaaattgagcaaaataaaaaggagtcgttgagtgtgaggaaagctrcaragaagtaaagacaggtggagacatgacaatactgagcatgttagtgaccttcacagtaactgacttcctggaggagtgtgagcttaagccagaatgaagtgatagaccgtgaaagacggatgaaggagtagsagcttctggaggcaaacatggtrtgtggttggctggattgggatatgtggagggactctgaacattctgctttaggtccagcactagagaaagaggactcatctttatttagcaccttccacaatctgtagagaaatctgaaacattgcaaaagaagatatatgaatggccagttcagggaaaaatgcaaagtaaaaccacagtgagaaaccactaagcaaccattagaatggctaaaattaaaatgattaataactataaatgctagcaaggawgtggaacaatctgtactctcctccattgcctatargaatataaaacatccattttgaaaatcaatttcatatcatctaataaagttaaacaagctagtcctctacagctaccatttccactcctaggtatatactcaagagaaatgaagattttgtcrataatccctgcataaaaatgttcatagtttctttatttataatagtaaaaaayaagaaataactgccaatktacaaaaatcatgattcartcatacaatggaatattatcagcaatgaaaatgaaagaactactgatacgtgcaccaacatggrttgatcacataggtattacaacaagcgcaaaaagccagatacaagggaggccatatgggatgagtagatttgtatgaagttttaaaacaggaagaactgtgctatcctgatagccgtcagatcaatggctgctggaggcatggaagctgagttgaagggagaaaaagggatctttgtgtacattgatagtggcaagagtaatatgctgcatttgtcaaaattcattgataaatttgatgaagatctgattattttggtatatgtacattttataagtttaaaaatcttataataaaaatcataatgttgctgataaaaataataattaaaaatattagcaacaaaatccaacagtataccaaaagaataatacaccatgatatgtccatatatggcaaacacagagctaacattatactgaatagggacaagcttatagcctctcctccaagatctggaagaaggctaagactcccactttcatcacttttattctacacagcactagaagtcctagcaagagcaatcagccaagaggaggaaataaagggcatccaaattggaaaggagaaagccaacttagccttattcgcaaatggcataatcttttactcagaaaaaactaaatattggccgggtgcggtggctcacgcctgtaatcccagcactttgggaggccaaggcaggcggatcacgaggtcaggagatcgagaccatcctggctaaaattgtgaaaccccgtctctactaaaaatacaaaaaaaaaaaaaaaaaaaaaaaattagctggtcgtggtggcgggcgcctgtagtcccagctactcaggaggctgagacaggagaatggcgtgaacccaggaggtggagcttgcagtgagccgagatcgcgccactgcactccagcctggatgacagagcgagactccatctcaaaaaaagaaaaaaaaagaaagaaagaaaaatctaaatattccaccaaataaatggtgagaactaataagcaaattcagtaaaattacaggatacaaaatcaatgtgcaaactttcagagcatttatatatacaagcaccatataatctgaagaagaaatcaagaaagcaaaactatttacaaatcataaagaggataaaataactaagaatcaatttaccccaggaagtaaaacaaaaactataaggcactgatgaaggaaattgaagagtacacaaaactggaagagccaggcvcagtggcacatacctgtaatcctggcactttgggatgatgagacaggagaattgtttgagcctgggagttcaagactagcctgggaaacatagtgagaccttgtctctaagaaaaaaaataaaacacayaaattgggagaattaatattgttaaatattaatttwaaaaatgadacacataaatttcatgcacataaattgggagaatattgttaaaatgttcatactacccaaagcaatttacagattcaattcaatccctatcaaaataccaatatcattattcacagaaatagaaaaaatcgtgaaattcatatggaatcgtaaaatatcccaaatagccaaagcaatcmtgagcaagaagaacaaagctagaggyatcacacttmctgaattcagkatacaatataaagttatagtaaccaaatcagcatggtgctmgcataaaaacagacvcatagactaatggaatacaaaagagaactcacaataaatccatgcattgatagccaactcatttttggtaaaggaactgagaatatacaatggagaaagaacaaaagcaacaatggagaataaatggagctgggaaaatgctaccagatgcagaagaataccactagaaccgtctcycaccatatacagaaatcaactcaaaatggattaaagatttaaatgtaagtcccaaaactataaaactactagaagaatgcttacaggaaacactccagacatgggtctvggcaaagactttatggctaagacctcaaaagcacaggcaacaaaaataaaatagacaagtgggactatattaaactaaatagcttcagcacagcaaatgaaacaatcaacagaatgaagaggcaacctgttgaatagagaaaatatttgctatgtattcatccavcaaggaactaacatctagaatatacaaggaacttaaaaaactcagcagtaaaaayacaaataatccaattaaaaaatggayaaagtgtctgaatagatgtttctcaaaaggagacatacaaatggtcaacaggtatacgaaaaacactcaaccttattaaatatcaggaaaatgcaaatcaaaactataatgaaatatcatcttatcctatttagaatggctactaataggaaataaaaaataatggatagtggtgagcatgtggagaaatgggaactgttgtacactcttgggaaagtaagtacagcaattatggaaatcagtataatgatttctcaaaaaacaaaaaatagaactactattggatccaacaactccactcatgggtatttatataaaggaaaagaaatcaatatatcaaaagactacctgcacccccaggtttattgaagcactattcacagtagcgaagttatbaaatcaatgggtgaattcatcaatgggtgaatgaataaatggtggtatatatatacacaatggaatgcaattcagccataaaaaagaatgaaatcctgtcagttgcagaaacatggatgtaaccaaaggtcattacgttaggtgaaataagccaagcaaggaaagacaaataccacatgttgtcactaatatgtgcgagccaaaaaggttaatcttagggaggtagagagagtagaawgacagttcccagaaactgggaagaatgtaggggtgggaaaatatagagatgcaggttaatggatgcaaatgtccaattatatavagaaaataagttctaatgtttgatagcacagcagactgactaaagttaacaaaaatgtatatttcaaaatagctataagagtggatttggctgggcrtggtggctcatgcctgtgatcccagcactttgggaggccgaggagggtggatcaygaggtcaggagatcgagaccatcctggctaacatggtgaaaccccgtctctactaaaaatacaaaaaaaaaaaaaaaaattagccgggcgtggtggtgggtgcctgtagtcccagctactcgggaggctgaggcaggagaatggtgtgaacccgggaggcgaagcttgcagtgagccgagatcgtgccactgcactccagtctgggtgatggtgtgagactccatctcaaaaaacaaaacaaaacaaaaaagagtgaatttaaaatgttctcaacagaaagaaatgataaatgcttgaggtcatggataccctaaatatcttgactgatacacacattctatgcatgtatcaaaatgtcacatgtatccyataaatatgtacaaatattatgtaycaattttaaaaaatttaaaaaataaacmacacaatatggggcatttaaaaaggtacaaaaattatgagcatgataaaaatttggcaaatattttcctttttattaagatctttttcattccataagtttaaggagaataaagcccataaagcatcagaagaagttgctctcctgaaagagactcttctgctcagttaaaaagacagaaacagaatcactggagtgagtaggactttggabaactgcacagcaccatgtcttagtgtctgggattacacagacttagggaggaggcctcaccttccgggaagaactaaactttggttctctttcttgttttttctattgcaagaccaaaattttagaaaaccaagagaaagatttcagccaaagggwtgtactgtctattactctcttttattttttagaayatccattgtcaaagacgatccagactgttacaagaggaattgtgttcctacgccaccaaaatccacatgttgaagccctatgttgagaaggcagaagaagtggccatctacaagcaaaggaaagaggcctcagaagagatcaaccctgcagcaccttgaccttgcacytgtggcctctggaactgtgagacaacacatatttattatttaagtcacccagcctttggtactttgttatggcagccctagcaaattaaaacagvaatattaccttttctaccttgtcctatgtatgaacatgagatttttttaggagtatgaattacctgagatttcaaaagatagagtgaggcaattgaaaatagatgatatagggtcatttccaagcctctgagtgtcccctggccaccacagaaaaatgaagatgttcccattccctttcagtttcacacaaagcaaaagttgtagacctaaactgacatagaatcgccaactgcattaatttatttgagataatgagggagctagttttgcccaaatttcacagaaagacgatgaacaagtagtaagctaaagaggcttcttttgcaggggattgcaggtattatatgtttttctcctacttttaagatacattttcctaaaadgttttgtctaggagtaaatgtcatcactttgytttttttcctcccaattgaatcactkgttcctccctgcatttcagtaatgttgctagcatggaggtgtttgtccatgattcacagatgattcaaagagcagagagcttctcctgaggtcacacagcacgtaagcggtggaacaatggcaggcacdtgactctctaggcccctagtccagttttctgggttctrtgagaattvtagcccttggtttctgttacatgtggttctcttttgagccagagaaggaggacgcacagtgagaagaaagtgccdgagccccaagtcctggcttagatttactgggctggggcatggagasagaggctgccactgattctcttaactccagcttctattaccagtcactaagctgaaagcaggaaagtttatcttctgcacttggtccatcagaacyaagatggcagaaagccccactatctaccayggaaaagacaagggtccctcttaccttgaaccatgacccagctttctaactacatatgtttttctgcacatgtagctatttttcttctcatcaagctccagtactcacagtgcaaacacaggagatactgagcctgatgctctgatggaagctctgagttgagattttattttatacttaggtgcctctgavtcattagagttttttgcctgactccactctggccccatttcaatcaaggtctatatgctctgggacctctccaggttctcatcagaaatgaaaaaaaaaaaaaaaaaaagccatgtccagctcctgggtcctccctgatagchgtgagaggcagctcctaatgggagagagccttggggtgaccaaggcctcacagacttcattattcctggaccacatggctccagcctcctgatcacaatggatcagtggtcttagattccgctccaatatttgaagttttttgttcttcggcctcvgcaaatgctctctggttgagatgaagggaaaagacacagagacgcaaaagctgtgactgcatggaactctgtccmaggtacctcccggtgttctcttacttatgttvgccatgtcctcatgaatttagtgaaatgggcatgttgtctctgagtggaagkgaggggacacyactgggcagagctcmatcraagggtggctggtgtcctctataccatttatctacacatvttggggtttttctagcatgaaatgtcccagaggcagccaaacccgaagcttggctcctccaaggaatgagtgtgagtatcatagccctggccaatgagcactgaactctagagagaccaagagaccttctaaatattgggacactttagttctgaatcccagaagttggcttcttgcctgggaggcaggtgtcactgcatctgatccaaaaaagcagccccatagctcaagatgctcttctggatttctgcctcttcctggttcctggccaagcaaatcttcactgctttgctagcccatctataaattcaaccagacttttcaaatatgtattttcctcccatttttcyagttgtastcaatgggagaagtggtccaaatgacctaatcagcaattgctggaaaccaaagtaacagtatacaattctatgtgttaatatcatataccaagagagaaaatgtatagatatcagtagtagccatttaagcactgtaataatatctatctatatcccatgagtataatatatataaataaatgataacaagaaaataatctttatgtgtaatacdtgactatgactctgacagacaaacctgagagcatagtacgacacttatcaccttcactcatgagccagatagtgtgaaatgagaagcagagatttgaaatgtgttgcaaaactctctcaaagaaagtagagtaatatttttcgtgagcaaatcaaagcaatctcctcacaaatcacattggacttataatgtgtgggatgtgtctttattaaaatggaggtaatcctaggtatgtggtcttttttacatgaaccgtactgtcactggctcactagctgtcacttcaccaacaatcdttccatttaataaaagggagatcsccccatgggccagcatttcccaggtggaggcctcttgcagvcataatcttccaacagagaatttccctgggaacctagaaagaagagaagaggctcaagcaaaaaggatgaaagaaatagcaacaacggcggggcatggtggctcacacctgtaatcccagcactttgggaggccgragagggtggatcacctgaggtcaggagttcaagaccagactgccyaacatggggaaactccgtttctactaaaaatacaaaaaattagctgggcgtagtagcgggcgcctgtaatctcagctactctggaggctgaggcaggagaatcgcttgaactcaggaggtggaggttgcagtgagccgagatggtgccactgcactccagcatgggyaacgagagcaaaactccatctaaaaaaaaaaaaaaaaaaaaccaacagcgataatatcatacactgtcatggtgctatgtgttaatcygtgtccttagcactttcaaaatatgaattcatttaattgtcackatacawctatggggtgtgcctgctaattttccgttttcaggtgatacaataggaaagaaggtcgcctacaagtcgtggtggagctgggcttgcacgcagacaatcctgccccagggccatgctcacatctctgcactatccaraatgtgagggtgggtggagagtccagctcagggagagtgattggagagacagaataataagaagagtgggcagactggatcactctgatggttctggggcttctcttccaggagagaagaagacaaaaattatgtcaccatcaaggaaagtatccaaadtctctggcttaaacctgggcrtctccagctctgggacaggtggctgggcagggaagacaaactaagscaagggcccagctcggaagagtttcctttcctgagaattctgcaggagtttccctgacctcatggccacctctcatactttgctcttgttttttccccagggccgatgagggcgtcgtatctggtttccagtggggtctaaagacgccatcasagtgastggagattgggcttcataaagtgggagatctccaggatccttcctggaatccaagattcccagagaagccggatcccgcgtcccggaacccaactcctgctgctctatgagccctgaccttggggagamctgggctagtgaggagaggatcaagatgaactgggctggggaggcaggaggtaaagggcggcctggagagctcagcagctcctcccacggckcttctgccccggtctvgggtctgcagactcctcaggtcatatctccaagtacgccgccccacgccaccctcccgtggtccctgtccctctgtcccctccccagctccccctacaccgtaagaagctcccaggtaagcggctccagggccgggcggtaggcaggagggagcccgggaggctgggthcccgcggggaggcggagagagcgcgtcagggagacagggagcgggcggggtccctctcchgcyctcaaggtgccggttcccggggcccaggctcgcactcccgggtacttggaggccaggggagagggaggactgtggcaggtgaggcaaggagctgtctgagccgctcagcagcctccaggagtcagctctctccaggcctgtcttcactccagtgcctggtcctgcccaggcccccactcccactctgctctcaacctggccccagacaggatcccaaacaactcctgttcctaatgtgaaaaatgtttctgccgctttaggcagaacttgctttagagcactggcrcagacttccgcaggtcttgtgtctgaatttcttggcactgtgtcttttctcacttattcttctgcaaggaaggaattatatcactggttggatgagacaattggctcagatgggttcattgagcactcacccactgggmaagtgtcygtcggggccagctctgggccagatgtgcccaaggmtytatagctagttggtggaaaggcctggagggttcatattcaagtccacctgacttgaaaactcatattgaccttacttaagtactgattccccctttataatccatgccataaacttcattgtcttattttaagaaattgccacagcagcctttagcaaccaccctcttgaacagcyggyagtcatcaacattgaggcaagaccctsyccagcaaaaagattaaaattagctgaagcctcagacgaccgttagcattttttagcaatagagtaattttaaattaaggtatgtacatagttctttcatacataatgctattgtayacttamtaggctacagtagagtgtgaatataacttttatatgtactggaaaaacaaaaatttgtgtrrcttgtttgttrccatggtctgaaaccaaatctgcagtatctctgaggtaygtctgtartttccctttccctcttttgaacttgtttcttgtccttgtctggtcctgcaagctgtatgagtttgcyttctctggtaggtctggggacatkgtatcccttataaccttggttcctggcatatgacactggtaccargctctgttggactagtgaggctcccyacacacctcctgaactagagcaaaagctctgtgcacacaccgtgcatgtgtgagcctgtgaggagacggkgccttcctgcaggctgttctgaaggggtgttctgttgtgactggaggaaatagcmatgggcccctgggcagaagtggctcagaatggaatggatggccccagttttgatcatctgggaacaggaagattctcagataaaaacccatgttttagaagacaaaactgcccaagagtggacagcagctaaccagtaagctatctgggatatcactgtacactgggagggaagatggcctctgccatggtgtagggtgcctgacccagacaaggaggccttcctaggggtcagtgcttctgaagcacctttaaatgaggacaaatacctcatgttcatgattagccracttgtgcccactcagtggaaaaagaacccagaattttgcaaaattttcagagagagggattcccctcttgtctcttagtgctagggttatgcatgactcgtgcttgaattacagtgtgtacwcagctgaaagtcttaattattagaatataagaggcccaaactactgctgttacagatatgtaaaactacacagtataagtttaaacaacccacaaccaattaacagtgaagatarattaacaacctttgtaaatttaaaacaagattggcaaccctttagaaaaaaaatgagactkttgcaaracaatctaaatgatacactaataacaaacsttcatgaaaatgacatttcaaccatctgaatttctgctttaagttataaactccaaaatgaactaactccyaataatttacagtagggagctctaagccacaaataaaggtgtcaggacagacctgagacctggagtgagcacatccctcagggtcatragtcaatcctgtaagacccytcctccctcagacactccatccagtcatcaggaggtcaagaaaagttccccacagcactaagacccaaccacctcactgtcctcacctccatggacagagcccaggtgaaagccacccctgctcctcctcccgcatcycycacaggctcagcaccatcgtcggcctggagtgcacctggactgagctcatcatgctctgtccctgtttgtgtcagtcacactgggtcccccacatactctgcacttgcatccccacaaggctctgcacacctctattctgtctccccgacctccccagccacagaaatcttcccagtgcaccccctggatttctcagtccacatcagcaaaacctcctcakcctctctcaggatgttcctgcatctcrcagctccagcagcaacctgggtytccctgaggacatgaccccctccgaagtcctcccacatgggggagtttccccagggacttgtacccctgggttcagaggtgaggtggggtccttgctcctcattgtggttctcagaactttctgcctccctcctccctaaaacccctaggctgtcatcagattagagccccatttgcctcactgtaaccattccctgtgggccccaggctgttcttctcaatcctgagtcttgtagctcctggttcactgtcaccctctccagcattgctgtctccttgactcttggtgacttcaacatacgcagatgtsgtgggctgagtaatggtccccadagatgtccagtcttaatcgttggaacctgtgaacaggttgcattgcrtggcaaaagggayattactcatgtaatgaagattaaggaccttaaaatagggagattctgctggamtctctgtgtgggcccaatcaaatcacaagagcyattaaaagcagagagcctgccctggttggagtcagattctgcagaggaggaaggcagaggagaagctggagaggrgaggtcagaagttccaagcaggaggattgaatgtgccttaggcaccrtgtgtgagtatctgagagaaggctctaggagctaaggrtggctcttaacaaggaagtggaaacctcttttctatctgcaaggaagtgaattcaggcaagaacctgaatgagcttggaagtggattcttccccagagtctatggaaaggaatgcagaccttcccgtatgttgatcttagccccatgagactgggtggacttgcaatccacacgactgtgccatgatacataggtgctktttaaagccatttggtttgtggtaatttttatggcagcaatagacacccacacagcagagaagatgccctcgcttcctggcctctcagatcctggaactcctctcctccatgatcttctcctgtctgcctgaatctcatgcccttgttatcccctaggcctcatcatggctaagaaccccagcccttccatactctcwatctcacactwcccactctctgaccatctttccactcatccccttgcaaggtggccacaggctctgaggacacagatactatcattttatcatatgctgtgatgtaatatcagtggaccactcatygcatatgtgcttgctttccaygcttggagtctaccctgtagtacatcaattccaacaatcgttccaccctcctgggattcccaatccagtgatcctgccatctactcactgtccctcaccctgggtgtcctgtcctccctcctcacccattttgaattctatggtaaataatttccatccctcccttccctctcccttgarttgtcacactcacctggcaaaactacacagctggtgggttccacctckgcctatgctgagcctgcccccatgagctgcaggaggctggagagmagcacacagtacgctgactggtctcttaaaatttaggattccaaaccacataggaagtccctaccatggccagcaatcaccctctccctgcatggctcaccctcagcctcctcctggcctgggtgacycttacacacyttttctttgtgctcacacatccaacctgccttccccattcttacttcagctgatdaccttgcttcccacttcactgagaaaactgaacacattagaagacaacttcacagattccaccactgtctgctcatgcatttgcarctgcaccacatgtcaggcgttttaccatgtgasggactgttgtgggttaaccmttctgctcccagccagagccagaccctcttctggtgccccaattgccaycccttatcatctacttaaaggtgtcagttcatcaattaataccatttttatctttatygtcaacctttttcctctctccccactggatcattgtggcagtcatgagaatgcacatcccagcccctcatctagaagaagcagaattgatgatggcyccagctcttgaagtctgaaatctattgccacatttgctctgagactatgcccacccctggctttttccagccaatgattgaggaaagtagggcagaaactaaggcaggacattyctcttctgaaggctgactgaagctccagggctccctgccacccttactgaacttcccttagcctgcacasggtctaggatgcttccagctgaccttcctgcactctctacatcactgaggctcagmgttgctttgtggtccagtggctttcccagcattttctdtctcatgaatttctctcacaagtatttcccctaataaatccttacatgtttactactgtattggggtccgcttctcaggggaccctaactaacacaagtggcatgaagggtsatccatgaaaacaggcaaaaatgggaatttgaaataagcttcccactgcctggcaggccwagaggatgccacccgggttggtggcagacacagaaagtccatggcacaaggtgcagctgagcagctgggggtctcaccagtgctgagctgagaagttgccttggttagggagtgctatggcasatgcagtgatagaatgccctgcataataaggacagggttggaagaaacctacaaagacagtggctttggctrgttactkctcrgctgcatcgatgctgtgtaaaaagataatgagaatctgyggattgttgacagctatgactggctacatttgacaccctcggcagtgtctcatggacaggtcttyatctcctgtagcaaaagggcagatagcaaggaatgttagctctacatcactatgagggccacagtgctccagagatgtttgacactcagccaaggcaggcctgttacaggaaagtcagggctttggtggggaaacctgagattctgcaaactggaacaggattatgcgatgcdtgccctccaggatcttctgggcatgcagaggaggctcacccttctctagtaatggttcccactttcactgctggaagatgctacacaatcctcacccctatgatgccgcgvgaatcccactcaggaggtttgcaggaactagccagcacgtccccataggagcccagggactacttctgggattggaatttgagggtgtttgatcaaggaaccagaatttcaggctggatgaatataatcctttggcttgaagacactttctcagggcatggatttatcaaacactccaggactttgataagtggartaaacccactgctgggrtgtatccacatagtctagaaaaaaacatgcccaactctcaacaaggtagacatgtcttagttgccctggaacatgtagagratggaataacaagctgaggggagtgggcttggtgaaggcctaccaaaaccatgctcyacaagagggcccagaggacacacmttccaccagagcctcaggaacttgatggtgagagggacctgcatcactaagaagtgwcrgggtattgtcctttgtaggctgggggtgatggtagtaaagatagtcccagagtttcatttctaatatyactggggagagtgtggccctgaagagacaaagaccaagtggtggcagtgacttgcaaaagccagagggcacggttactatggcaacctcdgaggagaagccaagaggactcaagctgcagggaatgtggggaagkataatagagggtggtgtcccagggttaggacaggcagctggttgatatctatgataagaaagcaagaattgagaagcaggagggtgaaggtgtttgactcaatacaaaatcatgatcccatcctcaatgcctagacctcagccaagatgcagattcagatctcagtgacagaggaagagtccatatctctaggcggaatactctgcaaccccgtggaagtvtatgctgggacaattccctcagtccttcggcaaaggaccatatagccatttactcaggagattgtacactggggaaaggaaacaggcagaactggggdgattattgacactgggtgtgaactgacattgatgctcagatgcccacagcactatcatgtctctcatcacagtggggcttatggagctcagggagtaaacctggacacattatggcccacaatggaactactggatccatagacccagccctggttatcttcctataccctgagtgcayaattgacactgatgcactgctaagtggagttacccccaccctgggtccctagtctgtggagtaaggactttcattgtgctgaaagccaaagggaaacctctgacactgcccccatcctggccaaatcaaaaatcatagtgtgtcccagggtgggtcttgtgkaagayacttcaagtattgtggggrtcacatcaccattacagagctgaaggatgtgggatggtgttggggctgtctrttgtctctacgtaatccagcaayctgtccctgaagaagcctgatgaagcctaaagaatgaactagattactccaggtctggccaagtaggagttataattgcagcttttgtgctgtctggatatcactggtagagcagattaataaacccttggacacagagcatgcagctgtggatttggtgactgcatttctttccactccaattagaaagtggatatggagtgattcacattcatgtgggatcctcaaaacattgatttatcatttgtctcagggctattgtaactcccctgacctctatagtatagtcttaagactatactaracatactggatatccaataggatattaaatcagctcatatcattgacaacttcctgttgayctggstggatgagcagcaggtagaaagtgcactgtagtscttggcaaaacamgggcactccagaaggtraagataaaccttacaaagcttcmagagtggccactcggccaggtgcagtggctcacgcctgtaatcccagcactttggaaggctgaggtggvtggatcacctgaggttgggagttggagactagcctgaccaacacrgagaaaccccgtctctactaaaaatacaaaattatccaggcatggtggcccatgctggtaatcccagctacttgggaggctgaggcaggagaatcacttgaacccaggaggcagagattgcagtgagccaagatcgtgccattgcactccagagtgggcaacaagagcaaaattccatctcaaaaagaaaaaratagygggcattgaagtaaagttttatgggtgaacaatggccaagtgtttaggggaatgcaggtgtgtcccctccaaggtaacagacaaactgtttcatcttgcatcctcaccagaaagaaggaagcacactgcctgatgagcctcttycagttctgacaacaccactttccacatctaggtatgttgctttggcccacactctaggtgacataggaggaggccagcttcaagtrgggcccacacagaaaaggaccctgcagcagatccaggccatggtgcragcagccaccatctctcagaccccctggtgctggtgatgccattggtrgggaaagatgcaggatggagctgaaccaagcaccagtgggaaagtcacagtgaaaggcctgggattctggagtaaggtcatgtcattcacagcagagacatatgccacctattagaagcaacttttagtgtcccttgtcctgattagayagaatgyttvaccacdggacaccaagcaactatgtggttcgagtgcctgtgtgacccacagagtcatagattagacaggcccaacagyatccatcrtgaggtgaaaatggtccacctgggttgagcttgaatcccatgtttacacccasagaaaatacccaagtctgaagtggcactgaacaaccaaacagacaaatggaagttagccagccttcaccatgggtcagccctggtttggtaggatgagttcatgaatggagcaaccacagtggcaggcmtgaggctacrtatggggccaacagcactgactcccccctaccaaggcagatccagctgycgacacctctgaatgtccaactcatyagcaattgaggcccatgatgtgccccagtggggcactatttctttaggtgactaactagccactaagtaacaagttgactacatttagctacttccatcctggaagggccagaggttcatcttcacagggataggctyctattccatgggtgttttcatgtcctgctctcagaaactcagccagcacctctccgggtgctgttgacattcctgatctgcaggctaggmggtgctcctagcccattatctgcctgaaggacccacttggctgggaaagtttcagtgtttccatggctgtgggttccactaatcctatcaccatctgcaccatccagaggctgccagccacaaggaatgctggacaggtcttctacaggcaaaactcagtgccagcctggaggaagcactctgagaggtgggtgccrtctttyaggacacsgtgcattgtttgaatcagagatgtctctagagtgctgtgttctcaataggaagaacatgtgtgtccaggratcaaaagatggaagcaggtttggctccacgtccaatcccttagattcacycaatggggtattttgcacgttttatcttccaacactgggctgtgcagggtacgaggtcctggtttccaaggagggtacccttaaaaggakacaaaagacagcccactgaactacacattatggytgtcacgagagaagttttgatagtttgtgcccagagaccacctggtgaaaagaggattctcctcctctccaggcccaggtaayagatcctcatcttcaggagaaggcatggctactttcacacaatgagggcggaagtgtgtgtggaaaccagagatccacctgggggccttctggtttcccttacctcattgtaagtgtgarcagaatcatccagcaattcagcctgagacagcttgatttccaaggacccagacccrtcagggcagaaggtttgagtaatgctsggtaatctcccaaggccctgcwcctgtgctctgacatcctcagtagcattggtgctgaggycctgcttccaatgggctgttcccaaccagtgacagatcacaccagtgacacgaaagcaggacattcctgggagaccagggactcctctgatrgccaactgtagctcaaggactcctccatggccttgcttaactctccttagattgcctgtggtctayggcacatccagtaaaccttgtctccttctgtccatcactggggatcacctttgcatcttgttgcctttcccagggtaacctacctcccttgccatatcacctgacaggtgtgtcccctaataaaatgctataactttavtcccatgatggaacttgctttttggagcatttggactataaaatcattttcatctgcccactagtgatctcttacttattccaabgtgtaaaatctttttgtttattcaacttctacctgcattggctccattttgctggtatttgtaktatgcttttgagttcctcaatgtttattgtttaatcactaaatttgggggtagtttgttacacagcaatggataactaatgaagccctcttacatttccattattctatagaagttaactacatctcttttattttctcctattttgataatattagccacacatagggtttctagtttctcaacacctattcttttctttattttagtttcttttctcctttattccttcccttttttttttttttttttttgagatggagtctcactctcttgcccaggctaaagtgcagtggctcaatctcagctcactgcaagctctgcctcctgggttcatgccattctcctgattcagcttcccaagtagctgggactacaggcacctgccaccacgcccagctaatttttttgtattttyagtagagacggggtttcaccatgttagccaggaargtctctrtctcctgacctcatgatctgcctgcctcagcctcccaaagtgctgggattgcaggcatgagccaccacacctggcctcttccttccstttctcyttccttctaaccctccctccctctctttcttctctatttccattcaacctatcaccttccctccttcttgctccctttccttccccttccccttccttcttttcttctttcactttttcctccattcctccttctttccctcccttcctccattttttcctttttattataaaattttcctaaaatataaaataaccctatgtgattgggctgtaagtaagcattttctgaatctatatgtcaaaagcataatgtcttttatatgagaaacaagtaaacaacaggaagttattaacagaataaaaatgcttgctataattctaccaccaagacrgtgacttttaacacaattccttcaactcagtgttttcagaacacatcatcaacatcaagtattacacatttattgtaaaagtttaagtagccacaatyactttggaaatcatattatcattatctagtatggttaaagtccatacaatgtatcatgcaaccaacccattcctaatcatccactctgggrgctttggggctttcttgcctatgtgcacaggagacatgcacactaatatttatggcaaaaactggaatcrgccacatgtacatcaataggaaacyggtgaaattgtggtaaaacgatatgtaagccttcagcgtaaaaatgaatgaatgacagcctcccacaccacagataactcctacacataatgtgtatcatgggaaaatacatgcagtaggaatttgctgtacaggaagcttaaaaaccagcaaaactaactgaggtttgttttggggagatatagatatacttattgcacaaatctttgaaggaatacaaaggaatacgtatcagaagactcaggatggagtctcctgccgagaccagctcggtcaggaagaccctaacccagtggtgctagaggacttaaagacacacacacagaaatatagaggtgtgaagtgggaaatcgggggtctcacagtcttcagagctgagagccccaaacagatatttacccacatatttattaacagcaaaccggtcattagtgttgtttctataggtattaaattaactaaaagtatcccttataggaagcaaagggatgggcygaattaaaggaataggttgggctagttaactgcagcaggaacacacycttaagacacagatcgctcatgctattgtttgtggcttaagaatgcctttaagcggttttccgccctgggcaggccaggtgttccttkccctcattctygtaaaccygcaaccttccagcttggacrttagggccattatgaacatgttayggtgctgcagagattttgtttatggccagtcttggggccagtttatggccagattttgggggacttgctcccaacggtctccttctakggggtgactgggtagcagcccagggtagctttacaggyttgtgttttacaccagygctgggcaccctsgtagatacttgattataattccttaaacagagttttccaaattaaaatatacctgttttttatagaaatgaaaaagaaaagaatttcaaagttcattgcaaagattcttaacaagaactacttacattggaagaaaaccacagagaattgtaaggagccatgtgacagagaggaccaggatgccatgaaaatggcmttggctacaaataggtcatttgatccttggctccctggcatctctctagattttcaatgatacaatgttcaatctgctgtgcaagataatttcatcttscaaagatttgatgttacattttaccacacattaaactgaaataaacttttacagattggaaatgcacatcattgatcaaaataaatgaaacatgaaaagagtaggraggaatacccagtgatggaatagcaaatatgaatggaaaacagaataggactgctaaaaagaaaaaaaaattcagaagcatgtaatagcagcrctatttagaatcatagtggtgtccaaatcacttctatcacatctcattcaataccacaacaaaagatgttaagtttattatagaatgcccrtcaaatagccagtttttgaaaaaaacttgtttctcaattagaactaaccatttcgggctayagcatcaagccaaaattattggcatcatgctaataatttttactaaagtaaaataaagttkactgaagtatgagattcacatttttgtaaatgaaaagcaatttgattaggcatttttttctgcacagcaaaagaaactatcatcaatcacagtgaacagacatcctacagaatgggagaaaaattttgcagtctatccatctgacaaaagtctagtattcagaatccacaaagaacttaagcaaatttacatgaaaaaaaaacttcattaaaaagtagacaaagaacttgaacagacacttctaaagaagacatacatgtggccaacaaaaatatgaaaaaaagctcaacatcgctgatcattrgagaaatgcaaatcaaaaccacaaatgagataccayctcatgtcagtcagaatggcaattattaaaaagtcaagaaacaacagatgctggcgaggttgcagagaaataggaatgcttttacactgttggtggaaaagtaaatggttaatccattgtggaagacagtgacagtgtggtgattcctcagagatttagaatcagaaataccatttgatccagcaatcgcattacagggtatatacccaaaggaatacaaatcattctattataaagatayatgcatgtttacattcatggcagcactattcacaatagcaaacacatggaatcaacccaaatgcccatcaatgatgaactggataaagaaaatgtggtacatatacaccatggaatattatgcagccataaaaaggaakgagatcaagtcctttgcagggatatggatgaagctggaagccattatcctcagcaaactcacacaggaayggaaaaccaaacaccacatgttctcatttataattgggaactgagtaatgagaacacatggacacagggagaggaacaacacacactggggcctattggggcagggtggtggtgggaggatcattagcaaaaatagctaatgcatgccagggttaatacctaggtgatgagttgacaggtgcagcaaaccaacatggcacatgtttacctatgtaacaaacctgcacatcctgcacgtgtaccctggaacttaaaaaaaattaaattaaaagacaagcttaaagaaaaagacaagctgaaagagttaatgaaaaataattagataaaagaagtctttgattttcaaaaacctgaaacaatagttataattttgcttttaacatatattcaaaacatttgatactgttcccttccagaggtgcatcttaattccctctcctgagtgtggcttggacttaatgaggcacttctgatatggcctggttctgtgttcccacccaaatctcatcttgaattgttatgcgaattgtaatcsctacctatwgggggagggaccacatgggaggtgattggataatggrggyggtgcccccatgctgttctcgtgatactgagggaattctcatgagatctgatggttttataaggggcttttccctgcttcattctgcacttctctctcctgtcatcatrtgaagaaggatgtgtttgcttccacttctgycatgactgtaagtttcctggggcaggctcctcagccatgcagaactgtgrgtcwattaaacctctttcctttataaattasccagtctcaggyayttcttyatrgcagtgtgagaatggactaatataacttctaacttatagaataatgctgacataatggtttgtaactctgggtgtagaacctaaaactcactgcggcttccaccttctctctctctgtctctgggatcatgagctctgggggaagccagctgctgtgccacaagcagccctgcaggaaggtccatgtggctgagaactgaggccttccgggaccagacaacaaagaactaggccttttccaacagccatgtgactgatccatgtttcatgtgaatcctcagccccagtgaagccctcagatgatgcagcccttggctgacaattggactgcaaccttgtgagaggcccsgagcaagaagcactcagggaaacctctcctggactcctgaccattggaaactgtggcagatgaggaatatttgttgttttaagctaagttttacataatttgttatgyaatagtaaataaataacacattttcacaagagaggatgtattattacacattaaattgcatttgctttaaatgtatcatcvtcatcattattatttttgagacaydgtctcgctctgtcacccaggctggagtgcagtggcatgatcaccatgyactgcagtgtcgacctcctgggktcaagggacccactgatctcagcctcctgagtagctgggactaccrtcatgaactactatgcctggctaattttctaattttttgtatagatgggggttttgcccaggctgatcttgahcttctggagtcaacaaatctgccttcctctgccttccacagtgctaggatggcaggyrtgagccaccatacctggcgtaaattaattataagatattaaacaygtaacttagttttaaaaggtaaggagaatttccatggctgaagaggatgtattttatgaccattcacaatgatcactttacttgaacttcaatttccaactgtgtccgaagtaaacacaaaaggaagatccaacccttgctaggctgattctattatgccctcaacaaccagctcctggtcattcaccatcctccagttattcaatcaactctaatgtaggtgctgctgtgaagggagttagtggatataattaagggtctcaattagttgactttaggctgggtttatcctgcttggactgtcctaatcaggtgagaccttgaaaggactgggttcttcctgagcatagagactcacagtgtgagagggactcagcatgaggggtttcctccagcatgggctttgaaaatgaaagggctgtgggccrggtgcggtgcctcacgcctgtaatcccagcactttgggaggctgaggcgggcggatcatgaggtcaggagatygagaccatcctggctaacatggtgaaaccctgtctctactaagaatacaaaaaaaaaaaaaaaaattagccaagygtagtggygggtgcctgtagtcccagctgcttgggaggctgagacaggagaatggcgtgaaccygggagccatagctggcagtgagccgagatccggccactgcacccaagcctgggctacagagcragactccatctcmaaaaaataaataaataaaatwaaaaatgaaggggctgtgtaggaaagaatrctggtgaggaccaggaatcragcacagccctccctgttctctacattgacagccagcaagraacagggacctcagtcttacaactgccagaaactgcattctgccacctctgtataagcctgaaggagbattcaaaatgaaaacacagcttttggaagcccagaagagagattccatccacaattttgcccagatttctgatcaaggaactataagcagataaatgggtgttgtttcgccaggcrtggtagtgcacgaatgaattgatgaattgatatgcacactagttacataaaataaaawytttctgaacttyttccgtgttttgcactttvtaattatctgtaatgcaatttaatacactcatatttcattcattcagtcgacaaaaattaatttagtccctacgataaaccagatatcccctcatatgctcacgtgcctgacactccagaagtttctcaagaccgaggtggagacactggagtgttttaagtggagagatgacacactcygactcccaggagcaggaccactgtgaaaagaacagtyacgtaacaggtcatgggacagtgctagtgtcacaaytcacaagtgacagtgtggtggggactaaggggacaggasggcctgaaggatgaraaggacggagrgaagggctggagaagcaggaggtgaagaaaaggagcagaggaaagaattcgaaagcagcagaattcttaggtttaaatacattgttttatggattttaatacatccatctacagagcctagcagggtgtccttggcagttggyctttaatacytyatgtgggtctgcctaaaaactaattttttaatgttaatcaggtttaaaaattactaagtgttcctataaaatatacayaacacttagmagyggatacttcctaaaaacaggcagtgcatgagcactagtgaggggcattgygactacaytgaacagttgcaactttgaggtgaataaagcctgtactgactcctggttgcaacgtacctggttgcaaagtacacagtgtgctactttgtattgaggagatatcctggactcacacagaaactcaragctatggaatgatggcaaatttaaaatatgacaagcgggagtcacaggtacactgcaaaagtgaaacttagaagctttgtgagtcctgttstaacgcttttgggcacatttatacatcatggggccaaagtcacattttttacckattagattcctgatcattcaggggttaccaaggttctgctatccaatgtatttaataaacaaataaataaataaactggtctctattctgtctcatgcactcagdcacaacttttcccaataaaaaaaaaaaaaaaaaggaaaacaaaaaacagtttctacacctccattcccadagcaagctcactctctgtcaccaaactccgtgggtgdsttttcttctagaagagtccaggtggacagggagtccagttcagggacggagattcckggatgaaaagtgaagggagagggacagggcccatgccgagggtttcttcctggtttctcagacagctcctgggccaagactcagggaaacactgagacagagcgcttggcacaggaggagcggggtcagggcgaagtcccagggccccaggcgtggctctcagggtctcaggccccgaaggcggtgtatggattggggakgccccgccttggggattcgccacctccgcagtttctcttcttctcacaacctgcgacgggtccttyttcctkgatactcasgaagcgggcacagttctcattcccactaggtgtcgggtttctagagaagccaatcggtgccgccgcggtcccggttctaaagtccccacgcacccaccgggactcagattctccccagacgccgaggatggtgctcatggcgccccgaaccctcctcctgctgctctcaggggccctggccctgrcccwgacctgggcgcgtgagtgcagggtctgcagggaaatggtcgggaggagcgaggggcccgcccggcgggggcgcaggacccrgggagccgcgcagggaggagggtcgggcgggtctcagctcctcctcgctcccaggctcccactccatgaggtatttctacaccaccatgtcccggcccggccgcggggagccccgcttcatctccgtcggctacgtggackatacgcagttcgtgcggttcgacagcgacgmcgcgagycagaggatggagccgcgggcgccgtggatggagcgggaggggccrgagtattgggaccggrasacacagatctgcaaggcccargcacrgactgaacgagagaacctgcggatcgcgctccgctactacaaccagagcgagggcggtgagtgaccccggcccgggrcgcaggtcacgacccctccccatcccccacggagggccgggtcgcctcgagtctctgggtccgagatcctccccgaaaccgcgggaccccgagacccttgacctgggagaggcccaggcgcctttacccggtttcattttcagtttaggccaaaatccccgcgggttggtcsgggcagggcggggctcgggggaccgggctgaccgcgggggcggggccaggttcycacaccatgcaggtgatgtatggctgcgacgtggggcccgacgggcgcttcctcygcgggtatgaacagcacgcctacgacrgcaaggattacatcgctctgaacgaggacctgcgctcctggaccgcggcggacatggcagctcagatcaccaagcgcaagtgggaggcggcccgtsdggcggagcagckgagagyctacctggagggcgagttcgtggagtggctccgcagatacctggagaacgggaaggagacgctgcagcgcgcgggtaccaggggccacagggcgcctcccggatsgcctgtagatctccggggctggcctcccacaagaaagggagacaaatgggaccaacactataatatcgccctccctctggtcctgagggagaagaatcctcctgggtttccagagagtgactctgagggtccgccgtgctctytgacacaattaagggatgaaatctctgaggaaatgaagggaagacaatccctggaatactgatgagtggttcyctttgacrctggcagcagccttgggccccgtgacttttcctctcaggccttgttctctgcttcacactcaatgtgystgggggtctgagtccagctcttctgagtccctcagcctccactcaggtcaggaccagaagtcgctgttccctcctcagggactagarttttccacggaataggagattatcccaggtgcctgtgtccaggctgttgtctgggttctgtgctcccttccccaccccaggcgtcctgtccattctcaagatggccacatgcgtgctggtggagtgtcccatgacagatgcaaaatgcctgaattttctgactcttccygtcagacccccccaagacacatatgacccacyaccccatctctgaccatgaggccaccctgaggtgctgggccctgggyttctaccctgcggagatcacactgacctggcagcgggatggggaggaccagacccacacacggagctcrtggagaccaggcctgcaggggatggaaccttccagaagtgggyggctgtggtggtgccttctggagaggagcagagatacacctgccatgtgcagcatgagggtctgccmgagcccctcaccctgagatggggtaaggagggagatgggggtgtcatgtcycttaggraaagccrgagcctctctggagagctttagcagggtcagggtccctcaccttccccccttttcccagagccatcttcccagcccamcrtccccatcgtgggcatcrttgctggcctggttctacttgtagctgtggtcactggagctgtggtcrctgctgtaatgtggaggaagaagagctcaggtaaggaaggggtgaggagtgtggtctgagatttcttgtctcactgagagttccaagccccaggtagaagkgccctgcctggttactgggaagcaccatccacactcatgggcctacccagcctgggccstgtgtgccagcacttactcttttgtaaagcacctgttacaaygagggacagatttatcaccttgatgactgtggtgatgggacctgatcccagcagtcacaagtcacaggggaaggtccccgaggacagacctcagaagggcggttggtccaggacccacatctgctttcctcatgtttcctgatcccgccctgggtctgcagttgcacatttctggaaacttctctggggtccaagacttggaggttcctctaggaccttatggccctggcttctttctggcatctcacaggacattttcttcccacagatagaaaaggagggagctactctcaggctgcaagtaagtatgaaggaggctgatccctgaaatcctttggatattgtgtttgggagcccatgggggagctcacccaccccacaattcttcctctagccacatctactgtgggatctgaccaggtcctgtttttattctactccaggcggcaacagtgcccagggctctgatgtgtctctcacrgcgtgaaaggtgagaccttggggggcctgatgtgtggggggtgttgggggggaacagtggacacagctgtgctatggggttctttgaatttgatgttttgagcatgcgatgggctgccaaagtgtcatccattactgggacagatatgaatttgttcatgaatattttttctatagtgtgagacagctgccttgtgtgggactgagaggcaagakttgttcacaccttccctttgtgacttgaagaaccctgactttctgcaaaggcacctgaatgtgtctgtgttcctgtaggcataatgtgtggaggaggggagaccaacccaccctcatgtccaccatgaccctcttccccacgctgatctgtgttccctccccaatcatctttcctgttccagagaggmggggctgagatgtctccatctttttctcaactttatgtgcactgagctgtaacttcttacttccctcttaaaattagaatctgagtaaacatttactttttcaaattcttgccatgagaggttgatgacttaattaaaggagaagattcctaaaatttgagagacaaaataaatggaacmcatgagaaccttccagagtccatgtgtttcttgtgctgatttgttgcaggggaggagaatagatggggctgtgcctagtgggtgctcaggccagtatggactttatgtggtcactgctcagctgggtcatctttgctccttcattctccttggcccttcagtagaaccttgtccyaccaccacctgtgatcacagggasttggatgtcacctasggtggtccctgcatacaaatctcattgtggtatcaagagactaattttcagacctgtccagctcttgccctcctcccaggrctctttcctggattgtagttttcatcttgtctccaatctttttaaaggaagcagattctgaaatttgcagagaggaggggtcccatagtttctcatcatagtgaactttctgttggagctcctcttctgctctcctactcttcttcctgccctgagttgtagtaatcctagtgctggctccaatccaaactcatggatttacaaagcagagtctaatttagattcatacgtggttggaaaattgtacccataagcctagggttatctttcctgaagagaaaaatatggttgtgtgctgcagtgtgcaggagggttggtgtgggrggaggkagggagggagggaggacacacaagcastcctggtgagaaaagcactggcggyatcgatgtccacatgagatgatgttgttctttagctgccacaaaacagcatttgccctgaggctaccttaacaaagatattggctttagaatagagaagtgctctacagtgatcattcattcaactgacatttgttgtctgctagggatatgactgcttttgcgtttagaaagcatcattaaggtgaaaacagaaaaatttctggtgttgtggtacatatgttctagatgctagcttgtctaacccgtagctcgcaggctgaatgtggcccaggacagttttgaatgtgaggagtttttgcttttctgtggcggacctgagacctggagtgagtgcacccacctccctcaggatcaggagtgaatgctttaggaaccctcctttgcagygacctgcaaaagatagagggcacrgttactgtgagaacccagagtagcagccaaaggggctcaaccttcatggagttttgggaaaggttagtaaaaggtggtgtcccagcgtcagaacagatgggcagccagcgagggcactgcttcatatctatgatgggaatgcaagaattgaggagcaggagactgagggygtttgayyaaatacaaagtcatgatcccagtctcaattcctagacttcagccaagcttcagattcagaatcyacagtggggcttaaggaggccaggaartaaacctggacacattatggcccactgtgggaccactgggttcataaacccagtcctggttatctccccattctccacatgcataattggccttgatgcactggcaaagggagtcacccccayactacatccctagtctggagagtaagggctwtcattgtgctgaagcccaaagggaatcatctaaaacttccctcatcccarccaagccagaagcaatattgygccccaggtgggacttcaggagggtactgcagrtattgtaggggtggcactgccattagagagctgaaggatggggggtggtgttgggattgcctattatctccatataattcagcagtctrtccctgaagaagcctgataaagaatgaatggaattactccagacttgaccaagtaggagtcctgattgcagctgccatgctggctggatatcactgcttggggagattaataaggcctcaggcacatggcaaacagccatgcatttggtgagtgcattctttcccattccatttagaaaatggatatggaatgattcacattcacatgggatttataatacatttattgatagcttgcctcagggctactttaactcctcaaccttctataaatatcaccttaagagatctggacaaatcagacatctcacagaatactaaatctcttcdtttcattggcaatatcacatagattgggatggatgagyaagaggaggaaagtaygctgarttcttyggcaaaacrtgtgcactacagaaggtgaagattaaccttacagagcttcaagagtggccactgcagtgaagtgttatgggtccagtggttaggggcatgcagggctgtccyctccaaagtaaaagacaaacttgcatcttgcatcctcaacagaaggaaggaagcacactatttggtgagcttctctgggtcctggcaacaccacattccacatctaagtatattgtttggcccactgtctgggtataatataggaagaggtcagctttgagtgcggactagacaggaaaggacactgcagcagatccaggcggtggtgtaccaggtcatcaactctcagtcccctggtgctgggggtgacagygtggggaaagatgctagatggagctgaaccaagcagctgagatcaagtgagctgagatcccgcccctacactccagcctgagcaacaagagtgaaactccatctcaaaaagaaaaaaaaattaaaaggataagcaccctcccacatcagagataactccccaacacataatatacatdcdgtgtgagttctctgtatggggaagttaaaaaaatacaggtcaaactgtgatttgggtattattgtaaaaatcttcagtgacaatgccaaggaatagcaaatacaagactcaagacataggttccttttaggggataggattggacaacagcctagggtggcttcataggttctgtttcttatgccaggaggggatatccaggtagttagttacttgatcataaaactttatttatttatttatttatatattttgagtctcgctcttgttgcccaggctggagtacagtggcatgatctcagttcactgcaacctccgcctcccaggttcaagggattctcctgcctcagcctcctgagcagctgggattgcaggcaaatgccaccactcccagctaatttttgtatttttagtagagacgggcttcaccatgttgaccaggttggtctggaactcctgacctcaggtgatccacccacttcagcctaccaaattgctgagattacaggcatgagccaccactcctggcccacaaatctttaaagtggtatttttcaaaatgcaccttgtgtgccattcctgattgattdtttggaaatgaaagagaaaagaaaaygccaaagttcatcacaagcatcctttgcgataactactcrtagtaaaacaaagccdcagctggccgggcacggtggctcacttctgtgatcctagcactttgggaagtcgagrcctgtggatcacgagatcaggagttcgagacsagcctgaccaacatggtgaaacctygtctttactaaaaatacaaaaattagctgggcgtgttggtgcgtgtctgtaatccaagctactcagaaggctgatgcaggagaatcgyttgaacctggaaggcagaagttgcagtgagctgagatcctgccatcgcactccagcctgggtgacagagccatactccatctcaaaacraacaaacaracaacyacaaaaaacaagccacagccaattttaaggagccatgtgagaggaccaggatgccatgaaaaacagccttggctacaaataggtcatttgatccttggctagttggcaactctctacattttctgatacacagtgttcaatctgdtaggtaaggcaatagtatcttgcaaagaatttgagaatttgatatgttgctcacattttaccacacatacaagtgaattaaacttttacagaatagaaaaaaagcattgttgagcaaaataaattaaatgaaaagacataaatgaataactagtgatgaaatagcaataagaatgdaaaacacgaaagagctgcttttaaagcaacattagaagcacaaaataacagtgtttttcagaatcatactggagtccaaatcacttctaccacatctaattaaaavccacagtgaaagatgttaaactgatcacaggatgcccactgaatagccagttactgaaaaatcttgttcctagattgaakttaaccatttccacctaccacatcaaaccaaatcattgtcatgatgctaagccagttgtacagacaaagatgtgagactcacatttttctaattgcaaagcaccctgattaggcaaatatttttgtagatgcttgagtcagaaaattgtcattttgggcattctttttttttttttttttttttttgccttcaagcatctgtttaacaaagcacatcttgcaccgcccttaatccatttaaccctgagtggacacagcacatgtttcagagagcasggggttgcgggtaaggttatagattaacagcatcccaaggcagaagaatttttcttagtacagaacaaaatggagtctcctatgtctgcttctttctacacagacacagcaacaatctgatttctctgtcttttccccacatttcccccctttctattcgacaaaaccgccatcgtcatcatggccccttctcaatgagctgttgggtacacctcccagacggggtggcggccgggcagaggggctcctcacttcccagacggggtggccgggcagaggcgccccccacctcctggacgaggtggctggccgggcgggggctgccccccacctccctcctggacggggyggctgccgggcagagacrctcctcacttcccagacggggtggctgctgggcggaggggctcctcacctctcagacrgggcggccggggagagacgctccttacctcccagacggggtggctgctgggcggaggggctcctcacatcccagacagggcggcggggcagaggcgctccccacatctcagatgatgggcrgccgggcagagacgctcctcacttcctagaccggatggcggccgggcagaggctgcgatcttggcactttgggaggccaaggcaggcagctgggaggcagaggttgtagcgagccgagatcacgccactgcactccagcctgggcaacattgagcactgagtgagagagactccgtctgcaatcccggcacctcaggaggccaaggctggcagatcactcccagttaggagctggagaccagcctggccaacacagtgaaaccccgtctccaccaaaaaaatacgaaaaccagtcaggcatggtggtgcgckcctgcaatcccaggcactctgcagactctaaattattcaacgcctcagacactaactttccaaggaataggagattatcccaggtgcctgtggccaggaggtgtctgggttctgtgctcccttccccaccccagatgtcctdtccattctcaggatggtcacatgggtgctgctggagtgtcccatgaggaatgcaaagtgcctcaattttcttactcttcccttcagaatcccagaatvcatgtgtgatccactaccccatctcdgaccatgaggccgccctgaggtgctgggtccygggcttctaccatgtggaaatcacagtgacccaactgtgggatggggaggaccaaatttaggacgcagagcttgtggggaccagacctgcagggtatagaaccttccagaagtgggcagctgtgrtgctgtcttctagagacaagtagagatacacatgccatgtgcagcaggaggcactgccagagcccctcacactgagatgggctaaggagatgaatgaggggccatgtctcttctcagggaaadcaggagccyttctggaggccttcagcagggtcagggctgaggcctgggggtcaggacccctcacgttcccctcctttcttagggccatcttcccagcccacattccycatcrtgggcatygttacygtcctggttgttctaggtgctgtggtcactgctgtgatgtggaagaataagaccccaggtaggaaaggggtgagttccaagatttcttcttccattcgtggatttcaagctccagatggaagttggctcatttcctgcctagttgtgagacaccatctccacacacatttaccctgttcagatgccctgtcaactctcactcttttgtaaagcacctgtgaaattgaaggacaaatttatcaccttgattgtgatcatgggaacctgactcccagcagtcacaagtcaggagaatgttcctgctgaggacagatgtcaaaaggacatttggttcagcttcaacacatcctcttccctcgggttttctgatcctgacctgggtctgcagtcacagttctggaaactcctctaggatctcatggccctgcctcttccctggcctctcacagtttgttttctttcctcatatggaaaaggagtcagctatgctcaggcttcaagtaagtgtggtaggggtgggagagtgattcctgagatccttggaatagtgtagacaggagcccatgggggaggtcaccaccccacaattcctcctttagtcacatcacctgtgggctctgaccagactttgtttttgttccaccccaaacaggaacagtacccagggctctgatgtgtctctcaagtcttgtaaaagtgacaccttagagggcctgaagtgaaggaggagttggggcagatgggacacaactaggctctagagagtctttgatttggaatttttcaatgtgtggtgggctgttcagtgtcaccacttaccatgactgacttgaatttgttcacgactattttctttccaagactgccttgtgagggactgagatgcaagatttgttcatggctccactttgagacttcaagggcctctgttttctctttctgccaaggcatctgaatgtgtctatgtccctggtaacatgtgagaagtggagagaccagcccaccctcatgtccaccatgacccctgatattgtttggatctgtgtccccacccaaatctcatgctcacttgtaatccctaatgttggaggtggtgcttggtgggacgtgattggctcatgaggatggatgattcatgaatggtttagaatcatctctttcatgctgttcttgtgatagttcttggaggcattgtgccacctccctagggatctgtggaactttaaacttgagagtgatgattaagggtatctgatggaagaaatttctcagtagcatagaattcaggatttggtctggctgcctgtaatagcctatgtgcatatgtgtgagcaaagaaatgacccgaaactggaactgatatttaaatggggaaatttaatacccaggaaaattcttagcggagctgcagcaacaggacccctgccaggactactaaatggtagagccactggctatgtgcaacctcagcctggaaaagccataggcattcaattttctcccatgacagcagctatatgggttatgttcagcaaagccataaatgtggagctgcaaatggcattaggagcccagcagttgcaccagccactgtgctctggattcaaaatatagagtcaaaggagattcttttagacctttaagttttaatgtctgccatgatgagtttcaatcttatgaggaaactgcattcatttcttttggcccatttatataccttttggaatggaaatgtacaagaaatgtctcttccactgttttattaatattttagatgcaaataacattttttaaaaaaattttacaggctcaaagctataagaatttaccttgcgtctcagatgagactctagaattttgagttgatgctggaacaacctaacacatttgggacaattgggagtagattattatattttgcaatgtgagaagaacatgacctttggctggctagggaggggatgcaatgatataaacatttatcccctgatacctcatgttaaaatctaacgcccactgtgggacttggggcctaatggccaccatttgggtcatggtgaccaatcttttatgaatcgagagatactgccctctctcgggaatgaatgaattgttgctctattattttccaagagagctagttgttaaaaagaccctggcaacttcctactctctgtgttcctctgttaccatgtgatctctgcatataccagctcccctttgtcttctgccatgagtggaagcagcctgaggccctcactaaatgcgcaaacatttccagacatcagaatcttgagccacatgaacctcgtttatataaattagtcagtctcagacatttctttatagcaacacaaaatggaaaaagataaccctcgcatcacaggtatgtgtctctggcagctagccaccgttcttaagatatccaggatccactcagccaagagtcttctcatcagtactctaaagacactcttatcactcaagagagtctaaggtttttaggagaaaccagggacaaagactaaatgtttttgtgataactcagattgcccacttttctttgaccacatatcttttacaggaaaaaggattgtaacagtaaagaggtattggcatattatcagagtctcatccattcattcaaaattaggccagtttatcatcctcttgtatgaatatgtctcccagaatgaaatcactcagctttgctgacaacactcaatcttaccaggttccaaaaacaaggatggtctcagggacatacagcttcactcttttaggcatcccgtataattgacctaagtgacaatatcttctcttgctcacaccacctttgaggagttaagctaatattgaatttttctcattatataaccctttgatttattcacttaccctcagccactattcctccctctgtccctttatatcagttgtttccaggtttgggagtgacattaggtttgtctgctgggctggcctagactgcaggcagcaatagtattctagcatgtcttccctcagtctagtcttgatcatagagggtaggttatataggtaaggaactagtgggggctatcagaccaccaggctatataactctacttactgttaatcctaacttttcagatgaaatgaatacttgagaattcttacataaaggtgtaaaaatatagttatggtttttcgcttagggataattcctgtttctggcacttttatttacatccctattcctggtactatggcataacatatgaaaaaataaatttgaggtgaagtgtagtctttattccagcatcctctccccttcagaagaattgtatgtatcgtcgtaacagcatcgtcctgatccatcaggtaaaagagaggatgctacctagtggagttattcttgcagccccactcatgttgacagcgagcacattcatgaagatataaaagccagtccttcatgtttatattgcccaacaattagattggcagtttttagacaaacaatgtttcaattgaccatttcaattttctatcaaattttcccctgaggaggacatgtccctctgcattgttggccgtttgaggctgtaaagtgtgttttcttgtgtaaagaagtgtgactcggcagtccaaattggtgcaacctcttcttttctggtccttgtatagcccttgaagcattgacatctacccctggttgagcatagcccaatccagagtcagtgattttcctgtcaagatccattggcagctcctttggggttgctggcatcattctggcttgccaggtattatgatcaaagccttcccactagagaatctgtcacatctccatctgctgcctctgtctgttttcttgaccaacagtgaaaaaagagattatgagaaataagataaattaccaaaattgtgaacaaaagagattatcactaatgacccttaggaagttaaaaaacattataagtgaatactctgaaaaacctgaagccaataagttagaccacttagataaaaaggaccaattcgtgcagagatagaaattgccaaaactgacccaaattaactggaaaacctgaagagaactgtgaactaagtcagaaattgaaaaaccttctcaaaaagaaatgccaaagcccagatatcttcactggtgaattctatcaaatattttgaaagctctttcagacaagaagagaggagggaagactttccagcccatttacagaactggcattaccctcatatcaaagtcacagcaagactcacaggaaaagagtgccatacaccagtgtcaccaataaacataaatgaaaacatccttaacaaacattggcagataatacaaagccacataaaaaaggattacactccatgaccaatgggattcatcccaggaacatatggttggattaacatttgaaaatcaattcatggaatgcactgtattaatggaaaaaaagacataattatctcaaaagatgcagaagaaacagttgacaaaaatgttaacatcactcatgttcataagtttcaacaaaataggaatggaggagaccttcttcactctgataaagggcatctataaaaaacccacagctaaaatcaaacttaatgaagaaagactgaagactgaatgcttttctcctaagatggggatcaatgcaaggatgtccaatcccaccacttttatttaatattatactggagattgtagccagtgcaataaggcagaaaattaaaaattaaaggcatccagataaaaaggaaaacatacaattctattcacagataacatgaccctgtctgtagaattcacaagcagataaaaactggctagcactaataaatgaatccagaagggcccataggatatcaaatcaatataaaaattaattattaacatatttctctatagaagcaatgaaaatctcaactttcctatcacagtagttaccagaagagcgaaataggaataaatttaggaagacagcagtgtttgttcactgaaaataaaaaaacattcctcagagaaattaaaggtctaaataaatggagagatgcgagttggaaagctcgataatactgttaagatggcaattctcccccagtagatctataggttcaacacaatccctatcaaaatcccagcagggattttatagaaaattgacaaaataggccgggcgcggtggctcatgccggtaatcccagcactttgggaggctgaggcaggcggatcatgaggtcaggagatccagaccatcctggctaacacggtgaaaccccatctctactaaaaatacaaaaaactagccgggcgtggtggcgggctcctcgggaggctgaggcagaaaaatggcatgaacccggtaggcggaggttgcagtgagcggagatcatgccactgcactccagcctgggtgacagagcgagactccgtctcaaaaaaaaaaaaaaaaagaaaaaaagaaaagaaaattgacaaaataatcctaaaaatgtatattaaaatgcagaggatgcagaagggccaacacaaatttgaaaaaaaaaatggaatgtcatatgaaactacaataatccagacagtgtgaaactgagagacatagagatcaatgaacagaagtgagaatctagaaagatattcttactttctttgtcaattgattttcaatgaagttgcataggtaacacaatgttacatttaacaccatataaaatatcagctcaaacaaattagagacctaaacagctaaaatttatgagttaaaactataaaatttctaaaagaaaacacaggagaaaatttttattactttgggtagttaggcaaaagattcttagataaaataccaaaagcatgatctacaaataaaaaaaaaagagagagagaaattgggcttagttaaaatttaaaacttgagtgctccaaaagacattgagagaatgagaagacaagccatagacagggagaaaatatttcacaatttatcacaaattacatttgtgttgaagaacatgtttccagaataatgtggcaagttcttaaactcaatgtgtaagaagatgagcaact
